United States Patent 8,758,764 (PROTEINS AND NUCLEIC ACIDS FROM MENINGITIS/SEPSIS-ASSOCIATED ESCHERICHIA COLI) - sequence listing, part 4

SEQ ID NO: 10023 - DNA, 52491 bp, Escherichia coli
ataagttattgcccgaaattaatatattgtttattatcaaaccgagttatagcttttctctgaaaactaccgaataaaatatactgatagactgctgcctagaatttccagatcaggtgggctgcaagttgcagaccgttataatcatcggttggggtgttgaaccacactttacctgccgtcaacccgagattaagttgctcagtcagcggttgaattcgttgcaaactgatgctcttcatgctgccgtagcgtgtttctggcgtccagtcgtaggtgtaagcacctgttccgcggcttagccatagttgcgtataaccagcaccgcgcgggtccttcagacgcacggaaatcatattgctataactactacctgcatcgctggagtcataatgggtatagcggtaactggtgatcaccgggccagtatagagtgatacgccgccttgccaggcattgacttcgacatcatcgtaatatttagtgtagcgataaccggtcgtgaaaagcgtttttggcaacagggctaggttaatatcctgtcgaaaatcctggcgggcaaagaccggcgtattatccgcaaaggcaatacccgttcgggttgtcagccagttattccatttgtaccagactgcaccctggccgcgagtggcattgaaatgttcagtttcataatcacgacgcccctgggaaagattaaaaagcagcgttgcgttttcaacttttgctaccagttcagcatacgctaaattacggttgccatgttcgccagaataatcggtaaaatcgtagcccgcggtaatggaagttaacccggcataagcgggcaatgcactaaaaaaaaacggcactaataacgtatgctttatcattttaatctcctgtacggataagttcttgtcggagtgagtaagttccactaggtaaattacgttctacaatcacgcgcgggccaagttgtgtgttcggagaaataattcgcccaggcaaaataataacttgtacaccaaggcgtgaacgcttcccgatataacaacctaatttatcgcatccggtagcgataattccctctggagttcgaacagacacgggttgttcatccagacgatgattactggtacgtacttgtgcgcccaaatatgcctggtttgcaactaccgagtcggcaataaagcattgcggaccaatcgttgcttccgcttcaataaccgcatttttaatttcggtggcaaaaccaatttttacgccattgctgattattgtgccaggacgaataaacgcataattacctatcaggcagtttgcgccaatcactaccggcccctgaataacggcaccgtggcaaatacgggtattcgcgccgataacaacctcaccggcactttcatcaataatcacctggtctgcaatctgaacatttttctctttagcattaagcttcagatagtttttcagttcctgtgacagaaggttgggaataagcggttgacgcttccaccagtgcggaatagcgggtgggtttgtcgcgctgaggttcgcgtccagtaaaaaaggcaataagtccataaataatccagatggcataagctaataatacatacacaacggaaagcggtgctaaaggcaccaacaaccagcaacgatgaaaccaggcgctaaatgcaccaataacacaaactacgccgacccagataagcgggaacattgccaacaccacaccatgtggcccggtggtgatgaattcattaaaccaggtagtgagataaataccaacgccataaagcacaaccaacagcataggaaatatactgaagataccgaagcggctaaataaaagtcttttatgcaggcgcatacagaccgcgtagcccacaatccaacgccgccagcggcgccactcctcacgcggactgttacattcctgtgggtatacgatgcagcgattcgcctgccgaatacggtagccgtttgccaccaacgtccaggtgagatcaaggtcttcgactttagtacgatcagagaaaccgaacttacgcaatacatcagtacggaacatcccgcaggcaccgctgataataaacggtgcaccgcccagaaactgctgtagcgtgcgcttcataacaatcatcggcaactttacggtggcgcggatatgtggcagcagacctgccccttttaacgcggtggagggaattccgccaacggcatcagcgccgcgctcaatttctgccagcatatagcccattccatcattatcaggtggaacgaaagtatctgcatcacttaaaaatacttgatcacacgtggcgtattttagtccatgcattagtgcgccacctttaccggtgtttttttgcgtgacggcaacaaagcggtcgccccatttgcgtttgacttccgccatgaccgcttcggtattgtccgtggatccgtcgttaacgcaaattacccggcaaaaataagggttacgcagcagattatccagtgactgcgccagacacgggccttcgttataagctggtataatggcgtcaatacagcctttcttttgacagggtttacgtcttagcgtacttaaaaaccatagcaacattgctatggtcatgaagataaataacaaagttttcatttctattactccgttacaacaccatcttatggacaacaaaaccttcacacatagaatgactaacctgttgtcctcggaatttggcttgagcaattatgtattctggctgtatgtatcttcgatggatctggcttttatgcttttgtaatgctaatatttttttattaaaatggacctcatctacagattcaaaaacttgaggtaaaaatgacagacatgtacttggtgtttcgtatcctagtatttgaggaatataacgacaggcaaccattgatgcctgataaacagcaatgtgatcctgatgcctgtcagtattattcatggtgtaaactcgagtaatttccacatcctggggcgtttcattctcaattatgtattccagagatgatatcatctcttttatttgcaaatataatctggtatcttcaaaatttagagggattagtttattgcatcctaacatatttaatgcttcttgtgattccttgtgacgatcaatatactctgcgccacagcaaccaggtgtcatgacaacagatataatatatactttttcattagaataatatgaaagagatgcaccacatcctaattctatatcatcaggatgggcaccaattgctaaaatgccggttctttttcccgaagatgttgtagaattcaacatgtaatctatccttttagatatgccatatgaatccccatcataaattatcactatcataaaaattaatcttattaaatatactttatatttactttttcagaggcagagaagcatcatttatgcaacaagaagatcttcatttctgttaaaaaaacagagtttatatgctattacggatttcagtcgtagcaagttgaactgtgatcgcattaagactaatcttctggcttgtaaaggccttagttccgtcatgactctcccatcaggccatagttgagcaaaatcctgaaagaattatcacctattgtatcttcagatacgggagtttttgtccagtattgttggaataatcatgtgcctatattgttcttgtagttggaacgtcttataaataaaacgaaaaggcagtaagtttgttgtatttattgatatttttcattcagtcagttggcaataatcagttatggttgtattcaaaagtacagctagaacgaaattaaaataacgggagcatcgtacatgacttgatatttcagagggctaagtattaatatattactacgatctgtcatcattgactatcaatatattagttagttaaatatctctttgtgtcattctggctagtatatactcattatcatgaatgctgccatgcatagctaggtcatcaccaattaatgatattctctggataatgattcaagagtttaagttcattgtatatataagtttgtattcaaaggtaataaattccttgtttattatttctcatgaaaatagttaagaaggagtgaagagtctgtttttttggtaggagagtctttatttatgtgtttgctattaatgaatttttgttaaggtagcctcatttgtcataattttgctaatatatgtatcgtcatatgtcgtgttttactaaaaacttaactatcatgaactcgtgatagtaacaatatacccttaaggtagaactttttcttgatgagaaggtttaagtttgtagttcagaatattactgccaagatagtttatactaggatatgtatgggaaccatacagaagataagaacagatgttaatgtattacatgcggccattcaccgtattgagtggttgtttgagacattttcatctgtttgtttgtctttttctggaggaaaagactctactgtgctgctccatcttacggccgatgtggctcgcaggaagaaacgtcgtttctctgtattattcattgactgggaagctcagtaccagtgcacaattgcacacattctgaagatgagggagatgtatcgggatgtgacggagactttttactgggtggcactccccctgactacggtaaacggtgtctctcagtttcagccggaatggatatgctgggaaccaggtgtggagtgggttcgtcagccaccagatgacgctattacagatatgtcgtatttcccattttatcggtatgccatgacgtttgaagaatttgttccggcattttcttcctggtttgccggtaaccggtgtggagtggcaatactgactggtgttcgtgctgatgaatcgctcaatcgctttatgggactggtgtctcagcgcaaactgagatatgcagatgataaaccctggaccacagcgtcacctgaagggttttattacaccttgtatccgttgtatgactggaaagcccgtgatatatggatatataacgccagaacccgagctatctacaatcccctgtatgacctgatgtaccgtgccggcgtgccgttacgcaacatgcgggtctgtgagccttttggcccggaacagcgtaagggactgtggctttaccatgttctggagccggaaacttgggccaggatgtgtgagcgggtgtcgggtgctgccagcggggcgctttatgccaatgagagcggtgcctattttgccctgcgtaagcgtatcacgaagccgcctcatcatacctggcgtagctatgcgatgttcctgctggatgtgatgccggaaagaacggcagaacattaccgtaataaaattgctgtctacctgcgctggtatcagacgcggggcttcccggatgacatcccggatgaacaggagaatgacctggggagccgggatatcccgtcttggcgacgtatctgtaagacactcataaagaatgatttctggtgccggaccctctccttcagtccgaacaaaccccggcactatgaacgttatctgcagcgtatgaaagaaaggaggaaggaatgggggattctgtgacacctgaggtggaagtattgagcaacatgattcgacagtacttcagtcaggaacgatctgaagaagagaccatacgagcccttaatcatctgcgcagggtgttgcatgaggtcagcccttttgcacaggagcctgtggactgtgtgttgtgggtgaaagcggatgaggtggtggccaacgattacaatcccaatgtcatgtcttccagtgaaaaaaaactgcttaaacattcactggagcaggatggattcacgcagcctgtggtggtttcggaagagaaggagcattatctggtcgtggatggttttcatcgtcagttgctgggcaggaaagcggatacgagaaaacgtctgaagggctggctgccagtgacctgtattaatccggaaagaaagggacaggcatcacgtattgccgcaaccatacggcataaccgtgccaggggaaaacaccagataacgtcaatgtctgacattgtcagggacctttcgcgtctgggctggacagatgagcgtattggcacagagttgggcatggaccaggatgaagtgctgaggctgaaacagattagcgggctgacagagctgtttcaggaagagaatttcagcccttcatggacggttcgttgatattgtaaaatatgatagttggagtaaggggcaatagaaggagaatatttatcccaccttcttccgagtcgggataaatcaaaaggtattatccattgattcagtatctgggtgagagtaaataatctaaaaatagtattgcgttgtgaactgatatcacttttgaattacaaaggtataggctcagtaaccagctttataagtcattgtcgtagcaatgactatagagtcatgctggcgggaagaataaatattcacccccagatggaaaacaacgtcgaaaaaccttcaacaaacacaatacgttcgttagcctgcccgcaaagcgggcagatcaggacaaagaattccataacgattgtttttgtcatcagaaattccatacaaaacctatagctgcattaaaacctgctgcaggaatagtttcatgtgctgtacggtagcgtttgtctgtcaggttattgagtgctaggttaatccggtactgatcctcgttaccgaattctgtatttactgcaaagttgagagtggcccagcccggaacatttgtttcggtaccgttactgtcatcttttgcactagaggcagcacgaataaaaacatcagagattatgttggcctgacccatcacaagagtatgtttcagccctatacgtccgtttatcgctggttctcctgtattagttgtttttaatgttgaagtttcatattgccgacgaattaaattgccactgatatatggcgagaaaacccagccattatattccgcgcttatttccagtccccatgtttttgcccgatcaatattgtcataataatagtagctactacgggaggagttggtgttaccattgcaaactatactgccatcacagatcagacttgcaatataatctttagcttctgagtagtaaactgcgctgtcaatcagccactgattaccattatatcgtgcacctaattcaaagttattggagtgttcagccttaagatcaggatttccgtatgtgacactgccgcccgcagatgtctgcataaaaagctgggagagtgtgggaaatacgtagccttgcgcgaacgcagcgcgtaactccaagttatcgaaacctgaatagcgcaggcttgtagatgttaccatttcgtgatcactcgcagactctctggcaagagaggtatcgcttataatgcctgcggtatatgatactccgtcaccacgcgtcaactttgaagaaagccagtattggcgaactcccattgtccatgtccagtgatcggcgaatcgccagtcattttgtgcgaatagtgagactgtactttgctctgactcataataggagcgagttcgtgtttccttattaatgaagccggtcagagatttgcttgaggtcatgccaccggacctttggctgaccctgtcttgtttgtactgtgcaccggtaacaagttcattattagcaggcagcgaaaagtgactctgcaatgtgaccgcctgagtgtattgcttatcatgggtgtcagtcttgttatgaacggtcagagcctgaatcatcggactgggaacaggctgtgtcgtttttacttcgttggcaaattggcgctggatggtctgctcatacgcgtcgaaatgaattttttttagatagtcaccgtccacgtctgtgtcatagaataccccaactttctctcgttcaagtttaggtattttgacactaaatgcctcatagcttccgtctggatcctcatagtaagtttgcgtcgcgagtctgtagcgatcaagcgagaggccaaaacgatggtttccggagttataacccaaccatacaccctgactattgttacgatagttggtattcggcagacgtccatccggcgtatcacgattgccctgatcagaataactaccgttgatgcgataatcaaatccaccgatgctcccctggaccgcgattgattcttcccagcctgctgttgcggaattataaacagctttcacaactccagatgcaagtttgtcacctccctttttggttatgaagttaacaataccgccaattgcctgtgaaccgtacagtacggaatatggacctttcactacctcaacacgctccagcgcagactcatctatcaacagtcccacaccataattatctccggcgcgctgataagttacctcctgaccatcaatgagaattaaaacacgggaggatgcttcgccacgaatgcggatttgtttacggcctgccaaggagttgtctgttatctctactccggggatgtcctgcaaattatcggctatggaggcattggtggagttctgcaatgtttgttggtcaataacctgtatagtcgccgggctttcccaaaggttgcttgccgaacgattcgtggtcacgacgagcgtctcttcgttgctgatttttgtttctgaagaagttgcggttgcagtagaaactatcccagaaatgcataatgacagagtggaaaggatataaattcgacaaggtatattatataacatttcatccctcattaatacaaagtacaaatgattgctgtaatgataattattatcatttatgttctcatgtatctgtgattattgtcatcttcataaattgtaaatatcaaacatttttgaccttaatcatgttttttgatagatattttacgactgaacatatccgtcgtttcctctgactcgtgtcagtcggtctctggttgtatccacggaccgcactcttgacataagagtgcggtccgtggaaaacggagttgaaaaaatggtgtctgaaagaaggtaccatcattgcgatgacaaacactttggcgtggataatgtaattaattgctgaaattgaccgtatatgcggtaagactcatatcagtatcaggtccggttaattgctgatactgacataaactttttacaaaaggatgaatgcagaaggttactctaatggccagagtgatgacaatgatggtcagacgttgacctgcagaaactgcattttaattggtctataaagtctgcaagaggaatcagggtcagatcagtgagtcttatcgcggcccgaagctatgactgaaagaaggctggatacagaattgcaacaatttggcaatgtcagaacacagaagctttgcaagcaggtgaaaggttatgtctagaaaaaggagtatatcagaatacatctactgatgtacaaaacacaacaatagcttcatgatatataaatacgtgatgacgagtggtactccgcatggttatttaacttctcagcaccactaatgatcctgagcaacttcgtatttgggccattgccatggagtagaaagctgtgtctgagaatgcagaatttgagaaaagaattcgctttcttggagagcttctgaaaatggcacgctaacaacgctttgttaaaaaatgtgaatcacttgccgaggctgcattttctattcgaggagaatgttgacgtagatattacagaaatctcagcgcatcaggataaactgctaccttaggtcaaccaccaaaagaaaatacaatacgtccagtttgtatgcctttaataacacatcttttaaatgttgaagaattatcccgcctgctgaagaacgttgctctgagtgtgataaacctttttattcttgatgatgtcagcgagaagatggaatatatccccgactgggtcgtggttacccggttaaacatctggtggcgctaataaatctggcaagtcacattctgttgaatgctgtgacagtgccttaccgagagagcgaaattgtggtgttctagtgcatagtcgccaccattccggataattttattgcgttgttttacaacttcttttacagcgcagatctgtcgctgacgttgaatcaatagcctggatttcagaacacaatgcccgtttgctggttggtccggcagtagcattaattcattatctgaatgaaatgtgtcaatccacagaaaccgctgtcaatgacgcattttgtcggacgttaacacgagaaagtctggctattccgtaatgccatcttatttcgtaatggattgagaatgctggatttttaattatattacgcgcagtattaatcgcgtaaatgttttgcggtcagcaacggtgggggatccattgctctgttcaatgaataccatcatacatttgaatcaggagtcggtatgatgattttggtgacgggaggcgcacggagcgggaagagtcgccacgcagaggtgcttattggggactcttcacaggttctgtatatcgctacctcgcaaatccttgatgatgagatggctgcacggatagaacatcatcggcaaagccgcccggagcactggcgcacagtggagcgctggcaacatcttgatgaattaattcatgcagacattaacccgaatgaggctgtgttgctggaatgcgttaccacaatggtgactaatctgttgtttgattatggcggcgataaagaccctgatgaatgggattatcaggcgatggaacaggcgattaatgctgagattcagtcgttgattgctgcctgccaacgttgccccgcaaaggttgtattagtgactaacgaagtgggaatggggattgtgccggagagtcgtctggcacgacattttcgtgatattgccgggcgggtaaatcagcagttggccgctgcggcaaatgaagtatggctggtggtttcgggtattggagtaaaaatcaaatgagtaaattattttgggcgatgctctcatttattacgcgtctgcctgtaccgcgtcgctggtcccagggactggatttcgagcattattctcgcggtattattacttttcctttgattggattattgcttggcgcgattagcgggctggtcttcatggtgctgcaggcatggtgtggcgtaccactggcggcactgtttagcgtacttgtgctggcgctgatgaccgggggattccatctggacggcctcgctgatacctgtgatggcgtattttctgcacgtagccgcgatcgcatgttggaaatcatgcgtgatagccgtttaggcacccacggcggtctggcattgatttttgtggtactggcaaagattctggtgttaagcgagttggctctgcgtggcgaaccgatccttgcatcgctggcggcagcatgtgcggtcagccgcgggactgccgcattattgatgtatcgtcatcgttatgcgcgggaagaagggcttggcaatgtgttcattggcaaaattgatgggcgacaaacctgcgtcacactcggcttagccgctatttttgctgccgtattattgccgggtatgcatggtgtggctgctatggtggtgacgatggtggcgattttcatcctcggtcagcttctcaaacgtacgctgggcgggcaaacgggcgatacgctgggagcagccatagagtttggtgaactggttttcctgctggcactgctataaagagacgtgacatgcaaatacttgccgatttactgaatacgatcccagccatcaattctgccgctatgtcgcgtgcacaacggcatgttgacgggttactcaaacctgttggtagcctgggaaagctggaggcgcttgccatacaactggcaggaatgccggggttgaatggcataccgcatgtgggcaaaaaagcagtactggttatgtgtgccgatcacggcgtctgggaggaaggggtcgctatttctccaaaagaagtgacagccatacaggctgaaaatatgacccgtggaacaaccggcgtgtgtgtgctggcagcacaagcgggcgctaacgtccacgtaattgatgttggtattgatactgctgagcctatccccgggcttatcaacatgcgtgtcgcacgaggtagcggcaatattgcttcagctccggcaatgagtcgccgtcaggctgaaaagttgcttttggacgtcatatgttatacgcgggagctggcaaaaaacggtgtcacgctgtttggtgtaggtgaactggggatggcaaacacgacaccggcagcggcaatagtcagcacaatcactggccgggatcctgaagaagtggttgggattggcgcaaacctgccgacagataaactggctaataaaattgatgttgtgcgtcgggcgattacgttgaatcaaccaaatcctcaggatggtgttgatgtcctggcaaaagtgggtggatttgatttggtcggaatagctggagtgatgttaggtgctgcttcctgcggtttacccgtgttgctggatggatttctttcttatgctgctgcgctcgcagcctgccagatgtctcctgcaatcaaaccgtatctcattccttctcacttgtcggcagaaaaaggcgcgcgtatagcgctctcgcatttggggctggagccttatctcaatatggatatgcgtttaggtgaggggagtggtgcagctctggcgatgtccatcatcgaagctgcttgtgcgatatacaacaacatgggcgaacttgctgccagtaatattgttctaccggggaatacgacttctgatttgaacagctaaaaacgaaaagtctgataaaagctatacttatcggatagtattcgcgacttaggaaagggacatgatgcgtcgtgtaaatattctttgctcatttgctctgctttttgccagccaaaatagcctggcggtaacttatccattacctccagagggtagccgtttagtggggcagtcgcttactgtaactgttcctgatcacaatactcagccgctggagacttttgccgcacaatacgggcaagggttaagtaatatgctggaagcgaatccgggcgctgatgtttttttgccgaagcctggctcacaactcaccattccgcagcaactgattttgcccgccactgttcgtaaagggattgtggttaacgtcgctgaaatgcgtctttattactatccgccagacagtaatacagtggaagtctttcctattggtatcggccaggctgggcgagaaaccccgcgtaactgggtgactaccgttgaacgtaaacaagaagcaccaacctggacgccaacgccgaacacccggcgcgaatatgcgaaacgaggggagagtttgcccgcatttgttcctgcggggcccgataaccccatggggctgtacgcgatttatattggcaagttgtatgccatccacggtaccaatgccaattttggtattgggctccgtgtaagtcagggctgtattcgtctgcgtaatgacgatatcaaatatctgtttgataatgttcctgtaggcactcgtgtacaaattattgatcagccagtgaaatacacaacggaaccggatggttcaaagtggctggaagttcatgagccgctgtcgcgcaatcgtgcagaatatgagtctgaccgaaaagtgccattgccggtaaccccatctttgcgggcgtttatcaacgggcaagaagttgatgtaaatcgcgcaaatgctgcgttgcaacatcgatcgggaatgcctgtgcaaattagttctggttcaagacagatgttttaagagcgttggtaattagaaagtaaaaagcctgctcgaaagcaggcttttttgaatttggctcctctgactgggatcgcctttgccagtaagtggctaataagtaagctaaaccagagttatcttcctgtcaagaccaccagaatgaccaccaataggagctggctacataaatttggtttgagcttccctactgcatgtggtgatagttactatagtgtccctacgtgggaagcgctgatcctctcccctagtggaactgtgtctaaagagcgataacagtccgctcagggcgtgaagcggaagttgctaaatcagtctatgttaatcaacgaggagctggtagataagattgacactaaaaattatggtgatggttccaataacgtgtttgttatctggactttatcattaaaatcctctacaaaatccgagtgttttaaatttctaggcttcgtacatctacaatctgtactcgttgaaatttcttcatctccagagaagtactacaagttacgtatccatcaagaacgtgttatggaaggtatgatgcctgaagaaccaaaagccatagttatagaagatactgagtgggggtgtatccactcgcagtatcactaccaagataaagatcctgcgataataacatgtatcgtaaacgtaaataatactgacttaatagctacagagcttgtgaactcagtgttgaatacatcctgaatttcttctctcgatgctggtacacagcgatcatataaagttaccgcgaaagaaacgactgatcctaccctcgtaatatggacactgctctaagcgaggttctggttttcaaattgttccagagtgagaccgccacaccaactgtgccgtcgccagcgactgtaatcacattcgatataattaaacaccgttgcccgcattatttcccggctgataaagtgttctccatggagacattccactttcagtgaatgaaagaagctttccacgcaggcattatcgtagcagcagtgtaaatagacccattttagttccatacactttttgagatcccggccaaataatggcgctgtcggtattcctccggtgtcatattattcagcgattcatgcgggcgttcacagttatattttgataaccatttttcagtgatttcccgtacttcattcagcgttctgaacagataaaaatcgagtatttctgttcggtatgtccggttaaagcgctcaatgaaagcgttctgcgtcggcttacccggctggataaactccagttttattgcatgtttctctgcccattcagccagtgccagggagataaattccgggccgttatccagacgaagcatggccggatagccacggtttgccgcgatcctgtcgagtacacggaccactcgctgagctggcagattcagatcgatttcaatcgacaatgcctcacggttaaaatcatcaacgacattgaacatgcgaaaacgacggccacagaccagggcatcatgcataaaatcgacagaccagctcaggttcagactccggcaggcctgacggatactgagttcgaacgtcgttatcagatgagtaaccagctcacgcttaaaggctggttttaaagctttttttcgataacgtctttcagcgcccggttctccagactcaggtcggcaaacatttgttttagacggcggttctcgtcctcaagatccttgattttcttaatatcagaagcctccatgccgccgtatttggacttccagttgtaataggtggcttcagagattccggcctcgcgacagacatctttaacagttcgtccggcttcaaccgacttaatcacggcgatgatctgatgctcagtaaaacgggctttacgcatagcgctctccttcgttggcagattgattatgccggatgatctctaaatgtgaatggcacgattatgcgggatacttacaccaccgacggaatatgaaaatcaatattatcgacggctcagaagtgtctagattatccgtggcgattcaattctgcccatttgacgaatgaattagctgatagtcgtggtgataaagttgggactgcataggaaatagctcaatagttattttaggggtgatgagtggagaggctaatgcgagaaatgagttacatattttccattgagagaaataaacaggtgaacctctatattttgaagttagttttttatttgttaaatgaaattcaatacaatccagtcctaaagataggcctttacctcgatatttgatgtaagcttctttgagcgtccacattttccaaaaaagtaattgaccttcataacgaggaagtgaaactatgttagtagcttcctgtggagtaaaaaaatgctgactgatattcagataagagttgtctaaatctcttatttgttcaatatcgacaccaagctcgcagtgagaactaatagcaacggctactgtatctatagtatgggaaaggttaaaaaaaatcttttttgccaactgaggaaaaactataaatggtttgccatatttgcacgtactaaattgccatgattgtaatgagacatcaggttgatatctttttagtgctgttttgagcaggatacggcttaaaatatagagttctttatcactcacaaaatgaaactgatcatagcgttttatttcttcctcattgagatagtgaaggaagttatctctactggtttgatgaaaaaaactagtatgtccaattaatatatcaatcctcatttagataatctcattcctgttagcaatgtgtatagcgtgattcgtattccgagcttgtattttatgtttgatgtttttcacatgaaactttactgtgtttattgatatgttaagattatgtgatatttgagagtactcatcaccttgtgccagcatgcgcaatacttgtctttcacgcagagataacgggtttttttctttgaacttatccatgtttccccccatcctgaatggtatctgtgtatctgtgtatctgtgtatctgtgtatctgtgtatctgtgtatctgtgtatctgtgtatctgtgtatctgtgtatctgtgtatctgtgtatctgttgttttggcagtatttaagaggaatttacgatacaacggtttttatgtaaatgggaattacgcattattttctatgtggtggctgtatcaattcatacccgctacatcatgtatgtactgcatgacttacatgtttttgcttacagacagaatctaattcattgaagaaaaacatgtaatcagaatataaggattttttgggggtattcctgtaagtgataaaatgcaatatgattatatgaatacgcaataaaaaactatacttgcggataggtgtgccatttagaataatcatgttaaataatctataaatccgataataaggtgatggttatggataatacctctggagattttccatgtaataagatggacacgcgtaagcagttaccgctaacaccaagtcaacaggggtttttattccattccttaaaggataagaaaaggagtaactaccatgagcattttacatgcattttttctcagcatgtagatagcgcccacttcaagtgggcgctggaaacgttatttcgaaagcatgagtgttttcgcactgattataactgggagattgatgagcgcccttgtcaggtggtgaagaccgatgtgttgccggatatatatgtgttagactgtgagcaagaggaaatacgttttctactagctaatgatgacattatcattcctgtcccgcaggatgacggtattgatgctataattcctcaactgctacaggctgatttaaaatacccattttccttgaaaacgatcccagtccgggcctaccttattcagtcaacgaaagaaagtgcttttatactatcataccatcatattgtgatggatggctggagcttatcccttttcattaaacagttgctccaactctatggagcggctgtggtcagtggtgtgagggatgatagcgccattatcccctcatctctgaaaccccttgtagacacactgtcggcccgacgtcacacctttcagcacgactattgggctgcatatcttcgggagggaacaccaacttgtatcgtgccgctgtcacaatatcacacagatactgaagccgagaacaattcttacgttaatcaaacaaatcatgtggagatcaatttgtctccggatgtgtgtcagaaaatacagacgctatgcagcgattatcgtatcacccccgcagtaatcttctatgtggcctggggcatcctgctacaacgttggtgctatgctgacgatgtgttattcggcgcgacaatatcagggcgaaatataccaattgatggtatagaagaaacactagggctatttattaacacgttgccgctgcgtctgcgtgatgatggggcgacactgttgcaacacttacaacgtatgcaccaaacactaatagctcactacagcaatgaacatgatgccttagccagcatacaacggttggtacataaagaaggtcatgctggggatctttttaataccttagtggtgttggagaattatcccgttgatatgacattattgtcatgcgcgtcgcccgtggcaattcgccatctcagtgtacatgaacaaacgcactatccgctgaccttgaccatcactcaacagaagggattccgtttcagtattgcatatgcccttaactacctgaccaacaacatggcgcaagcgttgctgatgcacctgagttatctgcttgaacaactggtggacaatccgcagcgccccattgctgcgttggtaaacttgtccccatgccagcaggcgcaggtacttcaaccctatctggaacgcatggcatgccgggattgggatagtcaatccaacgtcatcgaacaatttcatcaagttgctgcgacttcgccagcacaggtcgcagtggttgatgaattgtgcgcgttgacctattcggagttggcagcacaagctgagcagctcgcggcttatttggtacagcagggtgttatggttggcgatactgtaggcataattagcgaacgccgggtaaacaccgtggttgccatcatcgccatcatgttgatcggggctgcttatgtgcccatcagccccgactacccagtgggtaggatgcaggaaattattgatgacagcggcttggcgctgttgctggtacatggcaaaccgctagatgcattaaacgttgcgcagagtgacctctgtgcatttcccgtcgcgccctcggtggtatttccggttatcacaccagattctcgcgcttatgtgatttattcatcggggtcgacgggtaagccaaaaggtatcgcggtggcgcaccgcggtttattgcgcctgatacaaggcgacagcccgctgaaggtggagagcggtgagacaacgctgctgacctgcccatttgagtttgatgtttcggtgtttgagatgtggtctaccttgctcaaccacggcaaactagtattactcagcaaacaggcattacttgatatcaatcacattcgccgcacgatcgctgatgaacaggtggcgcgcgcctggtttacctcatccttgtttaactcctatgtggcagaaggtgccgatttcttcggtatgttacaacacattacggtgggcggcgaagcagtatctgcgtggcatgtcaacgacgtgatgcaaaaatacccgcatctggtggtgacaaacggttatgggccgacggaaaacactatttttaccaccgcatatcgtttcaacgggttgcaacccgcccgagtcccgataggatacgcggtaccgggcacctcgctctacattaccgatctccatgggcatttgttgcctatcggtgccaccggtgaactagtggcgggtggagtgggggtcgccatcggctatcagaacaacccggcgctaagtgcgacggtttttgtccctgatccttttattcccggcggtatgatgtacaaaactggcgattatgcccggttgctggatgatggctgtgttgactgttttgggcgtaaagacggtcaaattaagatcaatggacaacgaattgaaaccggagagatcgagcagcgcctgctggagtgctccggcattatcgaggcggtagtggttccttaccgcgtacgtgaaacgctgcatattgcggcagtggtctgcgtcaatgatagctatgatgaggtggaagttcgagggcaattggctgacagattgccgccattcgctattccggaatccttggtggtggtgacggagattgcaaaaagccatagtggcaaggccgacttggcgcagttgcggtatctcctgcccgcaactcagtgcaacgccgtgtccaccacgatatcagaggtgcatagtgacatggaacatgcgctgcatgctatctggcaacgcgtacttgatagacaagacattgatagcaatgcctcctttttcgccctcggtggcacctcattggataccatcagggttaaaggggatattaagcggcaacttggcttggagattgatattaccgatctctttaagtacccaacgctcacggcgttagcacattttctcgatactgccgtatcgccggaggatgcaattccaacgcgtgctgttgtctacagcgacatgccggtggcgattgtcggtatggcgggacgtttccccggtgcggcgaatattgcagcgttgtggacgctggttgtaggaggggaatcgggattaacactgttcagtgatgaagagttgcgcgcgcatggtgtgacacctgacacgcttaaacaagcgaattatataaaaaccaaagggattgttgatgatcacgaatggtttgatgcggatttctttggttatactcccaacgaggcggaatgtatggatccgcaaattcgcttattgcatcagtgctgctggcaaactctggaacacgctgggtgcgatcctgccacctttactggtgcgattggcatttatgccggactgctgacatccccccactggcttaatgcggtaatgcaagacactaccgactctaccgccctgtacaaggccagtatcctgaatatccattccgtcacagcattgattgcccatgcgcttaacctcaccggccctgccgtgacgcttgacaccgcctgctccacttcggcagtggctatccaccaggcctgcatcgcactacgtaaccgggattgcgatgcggcattggcgggcggcgtttctatcgagatgcctgcgtaccggggctatgaatatcatgaaggcatgatcaatgcgcgagatggtgtctgtcgtcctttcgatagccaagcctctggcacagtcaccggtgatggcttaggaatgctgctgctaaaacgtctggacgacgcgctggcggatcgggactgcatctatggtgtgatcaaaggttcggcggtcaataatgatggcaataacaaaatcggctataccgcgccgagtgtgatcgggcaatcaacggtaatccgcaccagtttgcgccgtgccggttttgatagcgacagtatcggattggtggaagcgcacggcaccggtacggtgctgggtgatcctattgagttacgtgcgcttaatgaggtgtttggcccaacacctgttccgttttgtgtggtttcagcgctgaaaagtaatattggccacctcaactccgctgcgggagtggcgggcgtcatcaaaacaacgctcgccctgcatcatcaagtgttgccaccaacagcgcactttcgccaactcaatcctgctatagatctatcgcgttctgcattgtacgttaaccagcaagtccaaccgtggccgtcgacgcgtcctcgtcgtgcactggtgagctccttcggcatcggcggcaccaatgccagcatcgcactagaagcacatcaacatgaggacgacccttcagcgacgggggtacgcgacagctatctgttgttgttctccgctaaaacacccgctgcgttagagttgcgcgtggcctccacactggaatatgtcaagcatggagtaggggtgcgcctgccggatgtggcttatacattgcaaactggacgcacagcctttgaccatcggcgggcttatttggtgagtcgtgggtcgaaaatcgatctctcctgtgccacgatattgcaagcggaaatcttcaatggtcagcgcacgacagcggagatctgcttcatgtttcctggtcaaggtagccaatatcacggcatggccagcgcgctctatgctcatcaacccatgtttcgccagcacatggatcgctgctttgctgcattccaacgctattcgacggtcgatctcaaggcgttgttgtttgacgatgaggatacgcgggatattgatcaaacgcagttcacacaaccggcgttgttctgtgtcgaatacagcctagcgcgcaccttgattgatctggggattacgccggacagtatgatcgggcacagtctgggcgagtatgttgcggcctgtattgctggcgtatttactcttgaggatgcgctgcacgtcattgaggcgcgcggacgtttgatgcagtccatgcgtcccggtagcatgatggcggtctaccttagtcgcgaacagttgaccccatggctagctgcagaacggggtattgaactggcagctaataatagcgcgcatttttgcgtagtcgcgggcgagcaggcggccatttcccgtttgagcacacgcttagtcgagggcgggatacagcacaggcgcctgaaaacctctcacgcattccactcggccatgatgacgccgatgctgcacgattttgcacagttgctggggcaaatcccgatgcacgcgccgcacaagcgctttatatctaatgtaagcggtacatggattactgaggagcaagctacctcgccggattactgggtgcagcaagtgcgcaacgcggtgctgtttagcgaaggtgcggcgcaactgttggtacaacccacgctgtttatcgaatgtgggccgggtaatacgctctctacctttattcaaggacataaccaatacagcgatcagccgaccctgttgacgctacgcaaagccaacgcggcgatcgatgatgagcacatgttgcatcgtacgctggcggcgctgtgggtcaggggggagaatattgattggagacgctttaaccagacggcactcggcaagcacattccattgccggattaccccttcgaacagacttattactatcgctatggtgctgcactttccggttatcgccagtatccaaatcctctgcgccgtccgcaagatgagtggctccagcgtgtgctgtggcggatgcacgacacatccttgcgggaggcgttctatgcgccgggcgaattgatcatcattattagtgctgacggcgacaagttacagcagacgctgatgagtagtggtgtcgacagcatcacaatgccgctgccgatatcgtcagaggacgacgtgtgggataatgaccgtattctgacgcatttccacgacatctgcgcacttttagcacacaaaacctaccgacagttacattgcttgtatgctcccggtgcggaggcaggatcatcgttgacacagtcgctctcgggactttatcgtgttgctcgctggtgtatgcacagcaccacgccgctggcgtccttaacagtattgacccatggtgcgtttcgcgtacaggaagaggataatcccgaaccgacgctggcagcgttgtcgggcgcagtaaacgtgtttgcccaagagctgcacccgaccgaagtacgattgatcgatatcgatgcgcagagcagtgatgagaatctgaacttgctaacccagcgtctggccccgaaacaagaaacggtaatggcgctcaggcaggggatgctttacctgcgacgctttatcccgacacggctgttggcgcacttaccccctcaaacagggtgtataccgggcaacgtactgtggattatcggcggtgaaaaggggattggccgcatgatcggcgaagcgcttgctcagcgtgagggagtccgtgtggtactgagcagccgcacaggttatcaccatgaagcggtgcagcaggacgcattagacgttatccactgcgacgtgacgcaggcggaggcggttagagcttgtctggcaactctgctcgaacgctatggacggttggatggcgtgatttttgctgccgacgctaccaccacattgacactgcatcaattgagcgaatctgcgctacgcgacacgctaacggtgaaagaacggggtactgctaatgtgctgcatgcgttagcgcaacggaatctgctggatgagcgtctgctactgctgttctgtaactcgttggctgccgtgaatgcggagattggccagacaggctatgctaccgccagcgcctatttggatgcactggcacagcaactgcgtacccgctacaaggtgaatgcgctcagtatcgggttggatgcattgcgtgagcagggcatgttgttggatgctataaacggcagtgaatacgatgtcttgcgtggactgcgcccattgatgacgggaacgttgctacaggcttataaacaacaaggggctgacaccagctactacgcgcgattatcccccgagtccgattggctgctggatgagcaccggatatccggtatcgccacgctgccgggaaccggctatctggcgctggcgtatgaagctctgcgccattactttgtgcaagaccaaatctgcattgatgaattggtctttttggcaccgttgactgtgatggacaactgcagtgttgacgtttttgttgacatttcacctaacgggcaaggagttagtgtcgaggtgaaatcaatgacggagcgctttagtggcacgttaacaacccatgccagaggcagggcgacgcgtctgatggtagacgataatgttgtgtgcgatctcacggggctgatgcgcgagatgcacactatcactcctccaacaaaggaattatcgagcacgcacttccactatgggccgcgctggcacagcgtacaacaactgtatggcaataccgcccagactcaggttttcgcaacgctggccctgcccaccgttgccgctaatgatacgatcgcactgcaccctgcgctgttggacatcgccagcagtgttgtcgaacaactgcctggttttcatactgattcggtacctttcctttatcaggatttacgcctgtaccgcccgttgccgaacaccttacatgtggcgctgactgtcaatcggcacgatgaggagggtgacagctacgctttcacgctctacgacatggcaggcgagatggttgcccgctgtgcggcaatggtgaagcgcaaggtacagctccacatacaagatgtcgatgacgacacgcgactgcgcgtgcccagtgccgataactaccaactgcggctggccgctgagggggagggggcaggaaagctagcgttgtgccctacgccgcgcttagcgctgggggattcacaagtagagattgaggtactggccaccggactgaactttaaggatgtgctgttcaccacgggattgctccggcagcagccgggtgaggctccgctgcaattgggactggagtgcgccggacgcattactcgcgtgggtaaaaatgtcactgaatttgccccgggagaggatgttatggcggtgctaaacggtggttttgtccagtacgcacgggtagaaagcgattgcgtagtgagaaaaccagcccattgtcgcatcgaacaggcggctgcgctgcctatcgcatacctcaccgcctattacgcactggtggtgcgcgctaatttgcaacccggagaacgagtattgatccacagtgcggcggggggcgttggcttggctgcgctacatattgccaaacgctgcggagcacagattttcgccacagcaggtagcgagcagaaacgcgattacttgctttcgctaggcgtacatgccgtagctgattcacacgacgaacagttcgctgccactctgctgaccgcatcggacggacaggggatggatgtgatccttaactccctcacaggccgtctgcttgacgctagcctcgcgctgctggcaccgctgggccgttttcttgagctgggcagcaaggacattgtggaagacaaagcgctaccgatgcgtttcttcgcccaaggcggcacctttattccgattaattttcacgcggcgcatggtgcgtttagtcgctacctgcaacagattgtcgcttggatagatgataacacgctaccgctccttccatgcaaatccgtaccattgcccgaggttgcacgcgccttcgccaccctgaccacgccgcagcatattggcaaggtggtggtaacgcatcgcactgcggcaggcatggaccggctgaacgccatgatagcagaaaggcgcctcggcggctatgcgctcagcatgagcaatgccgaggtgatgcgccaattgtggccgatactgaacactcgcagtccgtgggcgcaactgctgctctcacctcgggcgatcgatagattagcgcggggcaaccgggtggatcgcggtgtaccgtctgccgctaacgatacgattactcagcagacagtgaaaaagcggccccgtccggaaattggcgtgccttacagccccgcgacacgtgaagtggaacgcgtgctctgccaaatcctggaagagtatctgggtctggatagagtaggcattgacgacaactatgccgaattaggggcaacctcactcgatatggtgcaactgagtgggcaaatggcgcgtcactatccgcaagtgagcgtggtgtcgctgtacaaccacgccaccgtgcgccagctggcgacgttttgccagcccccggagggcgagtcaaatgcgccatcaccacagcctgcagtacagacgaatacgcgcgcgaatcagatagcaaaacgtgctttgcaaattgcgaaaaatactgcgcgcagtcacacgtctttgcattaatccgggcgcctcctcgccctgaagaaaggtaatgaagtttatggaatacgcaagcgaaatgaacggcatggaaatcgccattattggtatggcggtccgtttcccgcagtcccggacgttacacgaattctggcataacatcgttcagggtaaagagtgcgtcaccttctttagcgaggaggagttgctggccgaaggcgtcgaacagagtactctggacaacccggcctatgtacgggccaagccctatatcgagggcatatgcgactttgatgctgcatttttcggttacagtcacaaagaggcgcagactctggatccgaaatcccgcgtattacatgaagttgcctaccatgcgctggaagatgcaggctatgcccaacgtaccagcgatctgatcaccggggtattcgtgggggcgtcagaagatgtggattggctacggcgttcgctgtcacagattggcggcgatgcgctgaatcgttttgagtctggcatctatggtcataaggatctgctcgcacatctcattgcctacagtctcaatctcaacggtccggtgtatagtctctacaccagttgttcgacttctctgagtgcaacgcatatcgcttgccgcagcttgttgtttggcgaatgtgatctggcgttggcgggtggaattactatcgatttaccgcagaagtcaggctacttctgtcaacagggcatgatccactccaccgatggccactgccgtccttttgacagtcaggcttctggcaccctgtttggcgatggcgcgggtgtggttgtgcttcggcgtttggaagatgctctggcagcgggcgatcgcatctatgcggtgatccggggtagcgcggtcaacaatgacggtaaacaaaaaatcggttttgtcgcgcctggtcatgagggacagaaggcggtcatttgtgcggcctgtcatctggcagaagtaagcccagaaagcatcggctacgttgaaacccacggtaccggcacccgtattggcgatcctatcgagttcgctgcgttgacggaggcgttcgatacttcacaccgccaatactgtgcactaggggctgtaaaggcgaatattggccacacccacgcggcggcgggcgtggctgggttaatcaagacggcgctggtacttcatcaccggaccattccgccgctcgccaactatcaaatgcctaactcgaagctggatctggcgcattcaccgttttatatcccgatacagccgcaggagtggcccgcatcgcggatgccgccccgcgctggcgtcagttcttttggcattggcggtactaatgtgcatatgattttggaagggctgaatcctgcggtgcgcgatgaccatgaccaagtgcgagcaccggtgtttatccctctctccgcgccgtctttcgagcagttggatgagctgacgcaacagcttaccccgttgctggctacccttgatgcgtcaacgctagcctacacacaacaagtggcgcgccccgtgtttgattgccgccgagtgatacaagtggaaaacgatggtacgcaagcgatgctggcatcgctggataacctaatgcccgacgctccttggggcctacactgtccagatctacgtactacgaacgattgtacttacgcacagtggctggcgcattcggcacattatcaacgcgaagcgactgctctgacggcattactcgacggcatgaatattccacccgcttattgccacgctgaaacgtgggcggcacaagcgaacagcagcctgctaatcagaggctgccagactatcgccgcgctaaaaacctggatgaacctgctaccgacattaacactgctgtcgggtgctggaacaggccttttgcctgccgctgcagccagtggcatgattgcgacgcaagacgtgttgcatttgctgtgggaaatggagcaaaaggcgcttcatctctggcttcctgagcgccatgaacctatccccggctacgtgctggcttggcaaggaaatcccatcaccgatgcacagcgtaacgacagagggttttggagtgaagcgctgttggcagatacccgagaactgggggagggcgttcacagtatcaactgggttaggctgccgccggaaataagagaagacgttgatgtattgcgctacgtggcgcaactgtggtgtgcaggtatcaatgtggattgggccgtgtggtacggcactccgctgccgcaacgcgggagcgcatcagcatatcccttcgcacacaaccactacccattgcctggacgggtaatgggtagtgtggagacccaacccgaagcaggacccgaaacgcaccacccttatcaggcacgtcccgtgttaagcgtacctttcgtagccgcacactcgcggggtatgcagtatatcacaggtctgatggaactgttgctggaaatatcgccggtcggggtggacgacgacttttttgaattaggcgggcattcgctgctggtgacgcaattgacctcccgtttagaacgcgatttcaacgtacatatcgatcttttgaccctgatggaaaaccccaatccgcgcaatatctacgcgcatatcgcggcgcaactggggggcgaagacaacctcgaaatagcctgtcagtaaaggagctcaatgatgaacgtggcggtaataggtgcaggagtaatgggaactggcgtcgctcataacatggcgcaatacggcatatcaactaacgttgtggatatttctcaatctcagttggataaatgccgacagatgatcgaagcgaacttacgcttatataattttcacccgcagcataaaaaaaagacgcatagcacagcggagataatggaaaatatccgtttcacaactgagttggacgacattgtagaatgtgatttggtgattgagaatattactgaggatatagagaaaaaaaatgcactatacacacggatgaatacgatctgcggcgcgtcgacagtgtttggtgttaatacgtccgccatatctatcactgcgttgtcaaaattaatgcgacatccggagaatgtagtcggcgtccattttatgaacccggtaccgctgatgcacaccgtcgaattaatccgtggtgtacatactgcagagcgtacactgaacatatttcaccacttatttgctcagttgaataaaaccggcatcgtggtcaatgattctccgggctttgtcactaatcgtgccatgatgatttttgttaacgaagccatatttatggtgcaggagcagatcgcccgtgctgaggatatcgatacgttgtttaaaacctgcttcgggcacaagatggggccactacaaactgccgatttgattggcttggatacgattttgcaatcgttgcaggtgctatatgaaagttttaatgatgataagtatcgccccagctttttattaaagaaaatggtcgatgcagggtatttgggcgtgaaatcagggcaggggttttatcgctatcaacagacgtacgccgagcagtgattctgggttaaccagatagggatatgaatatgaaaaagcaagatatgaaagccgccattcgggaatttctttcacgctcattacgtgggcatacgttgaacgatgatgacgatattttttctctcgggcttgtccattcgttatttactgtgcaaatcatactgtttatagaaaaaaattttcaggttgagctggaagtgagtgagttgaaaacagaacagattgctaccgtcaataaaatagtggagctcattcagcgacaaacaggcctggagtaaactatgtgcactgaaaattatgagctggctcagcaagaggcagtcctgtttgccaaacaacatctcgccctggctgcacagaatattgaacgtcagcagtttattgtgccagacattatttcttgcgtggcgcaggccgggtacttaggtgcgtcaatcccccaaaaatatggcggacgaggttacgattcttatcaactgtgcgctttgcatgaagtgatggctggggttcacggttcgttagaaaatctcataacagtgactggcatggtcagcacgctgctgcaacgcgtgggcagcgcagcgcaaaaagcccattatttgccaaagctggcaacgggggaattgatcggcgcgattgccctcacagagccgaatatcggcagtgacttagtgaacgtggaaacagaattacagcaggatggcgacggttggcggctgaacgggaaaaagaaatggatcacgctagggcagattgctgatttttttattgttttaatccactgtggtaatcaattagcgacagtgcttatcgatcgcaataccgacggctttactatcactccactcaacgacatgttggggttacgcggcaatatgttggcagagctgcattttaatgactgccgcctgaaggaggatgcattgctcggtccgctcacccctggggtaccgctggcggtgaattttgcgctcaatgaagggcggttcaccaccgcttgtggcagcctaggattatgtcgggccgctgtggatgtggcagcgcgctacatccgccagcgtaaacagttcaagcggcggttattttctcatggcattgttcagcacttgtttgccacaatgctgacccaaacgcgcagtgcgcaactaatgtgcttcagcgcggcggaataccgcgaaacgctgcacccggccatgataaaccaaatcctgatggcgaagtatgtcgcttccaaagctgcggtggacgtggccgggaaggcggtgcaactgctcggtgcgaatggttgccatgccgattatgccgtcgaacgttactaccgcgacgccaaaatcatggaaatcatcgaagggacatcgcaaattcatgaaatccaaattgcgatgaattacatgatggggagtgaagcatgacgaaggatgtcgcactgatgttccctggctccggttcgcaatatgtaggcatggcacggtggctgtatgagcgttatccgcaggtgcgtactctgtttgatgaagctagccagatcacggaacgggacatggcagcgctgtgcctgtcgggtactttggtacaacttgctgagccgacggcaatggcgctggctatctataccaccagcgtggcccactttgtcgcgtggcagcagtttttggcgcaaaccggtgtccatgtcaacctacgttatatgttgggtcatagtttgggcgaatatgctgcgctgacctgtagtggtgcgctgagcttttcccaagcactggcgctggtggcgatgcgtagccgtttagccagtgagatcgcccgcgaaatggacgcgagtaccactatcatcaagcaagggaatcaggcactggtggcagcggcgtgcgaggtggcggagcgtgaaacccgacagcaggtcggtattgcctgcttcaattcgccgcaacagtttatgttatccggacaaaactcggccattatcgccgccgagcaatacctgctggatcatgatcgccaagtcgaagtagtgccgctgattggtggtgttccttaccacagcccactattgaaaccttgcggacagcaattgcgcaaggcgctggatcgctgcgaatggcgacgtccgtgctgcccagtgatctccaatgtcaacgctcaaccctatcccgatacggtcacgccagtccagtggctagaacaacagctctctcagccagtgcagtggcagcgctctctcacctacctgacaggacacttgtcaccgatcgcgatagagatcggtccgcaaagtgtgctgaaaaacctgctgctggagaatcgctatccagcaccagtttacgcatttgacaatcgtcatgatcgtgcgcaactagcattggtgctgggggataacatggcggtgaagaccgatccggaagccgtgcgccgccaacgcatcacgctgctcactaacgccctgacagccacacgccatcaccgcgccgccgatgtggctgccagtgcgcaattgaaagaattgctcagtcgtttttttgagcgcatccagcagattgagcagcgcggcacatccagcgaagaggacattgcttttttgcatgagcttcttgaacagggatttcaactcaaaggcagtagtcaggcagaaatcgacgcctgccacgcgcggttggcttccgacaacggcggacaggcgtaacccgtcacgccattttacgtacttatctcgctttgaaggccagagttatggaacagcaagggattatgagacagttgcctaccgacgaccaaacgatagtcgactatttgtatcgtatcgccggagaatatggggaaaaagccgctgtattgatgggggacgcggcgctgagctatcacgatcttaatgcacgctctaaccaactggcgcattatctgcgtgggctggggatcggcgaggatcgtgtggtagctatccgcctgccgcgcggcatggcaatgctgattgccattttcgctattgtaaaagctggtggtgcctatttaccgctggcgtacaatgcaccgcgcagccgcattgaaaatatactgagcaacagcggcgctgtttgtctgatcggtactgacgatggtgatcgctggccgattcctcgcgtcgaaatcgacagcgcggcggtcagtgccatgccaacgacggatctgcgttaccgaccacatgcgcggcaactggcgtatattatttacacctccggttccaccggtgtccctaaaggggtggcgacggaacatgcagcgctgctaaaccgaattgtctggatgcagaacgcttatcctatcagttctcaggacgtgctgtttcagaagacggtgtacacctttgacgtctctgtctgggagatgttctggtgggcgatgtacggcgcatctgtagtgctgttaccgtccggactggagagcgatccgcgaaccttggctcgactgattcagcgtcaccgcgtgtcggttgtgcactttgtcccttcgatgctgaacctgtttgtcgagtatctggagatgaaacaggatcctcgtttgaccgcctcattgcgattagtgttttccagcggtgagaaactcacggtccacagtgtggctcgcttttatcaatcggtggcgcagggtgatcttataaatctctatggcccgaccgaagcagcaatcgatgtcagtcatcaccgctgcctgcgcgggtacgactacgacgatatccctatcggtcaagcgattgacggttgccgactctatgtgctggatgaccatggtaatccggtagcagacggcgaagagggcgaactgtatctcgctggtatcgggctggcacgtggctatctcaacaacgtggcgttaactgatcgctgttttactatacatccaactttgcgccatttagggaaaccggagcggctgtataaaactggagatctggtgtggcgcgacggggaaagccaacaaattcattacattggccgtaatgattttcagattaaaattagagggttgcgcgttgaattgggagaaatcgaagcccatgcgatgcgtttcccgggggtacagcaggcagtcgtggtggcggatcaggatgatcccgacaatcagttgatttacgcttttgtcgtcagtagcgtgccgctcaatttggcggccttaatggacgcactgtccaaaaacttgcctgcctacatgctgccgaaccgtttgttggcaatgtcagagttaccactctccgacaatggcaagtgctgtcgtaaaacgttgctcgacttggcgcgggcgtactcagccagtcgcgtcgatttacgtgaaactcccgccgtgcgctacctaccgttgtcatcggctcaatcgtcgatgtggtttatgcaacaattggcgccgcatactgcactatacaataaccccaccgccttgctgcttgaaggagaactggatcgcacgcggatggacggcgcgattcgtcaattgatgagtcggcatactctgttacgtgctatggcggaaacccacaatggacaaccagtattggcggtgcctcagtgcgtatcgtcgcaggcgttgctgaccatagtgccactcccctcggtgagtgatgataacgcgctacaggcgatgatcaaccagcgtgcggcacaccccatgcccttaacgtcaggcacaccgctgtgccggtttgaactgttgacgctcgatgacgatcgtagcgtattgttgattcatctgcaccacatcatcagtgatggctggtcgaaaggcgttttgttacgcgaattgcaggccgcatataacggtgaatcgctgacgccagaaccgttgttggagtatgccgactacatggagtaccaagaagagtggcgtcagagtgacgcctatcaggacgcgatgcgttactggcaaaataccctggcggggacgttgccgattcttgatatccccaccgatcaaccgcgtcagaaggtggcacgttaccaaggcgcgtttgttgccttcgcattgtctgccaacacatgcgagcgagtgttggcggcggcgcgtgcgcagcgcgtgtcgttgtataactatctgctgaccgccttcgtcctcctgctgcatcgtaatgcgcgtcaacaggaatacatcgtcggtatgccgattgctgcgcggctgacgaaagaacaggagcatatgatcgcgccgctggtcaacgtactaccgctgcgcttacctcttgacgaagcggcatcgttttccgagttagtacagacgatcagaggtattctgtttgccgctttcaggcaccagcgtctcgaatttaccgacatagtgcgcgcagtgaatgtggatcgcagcgccggacatttcccaatatatcagtgcatgttccaactcgacaatatgcctctggcgagcccgacactaaacggtgtcaacgttacaccattattgttggataccagtgcatctcaggtggatatttcgctaagtatgcagcatatcgatgggcgcatcaccggcactttcgaatacgacgctgggttatacagtgcggatcgtattcagcacctggtggcgcagtggagagaactgctagatgaggccagcagccaacccacgcagttagtccgcgatttgattcgtttcacccctcgagagcacgcttggctggcgcggcacaacgccactgaagttgctctgccgcccgtagataacctgctggcgctagtgttaccgcactgccagcagcgccctacacaggtggctttgcgccacgctgacgacgccatgacctatggcgaattgcaacaggccacgatgcagatgtgtacttggctgcgtgcgcaaggcgtaaaacgcggagaatctgtcgcactgcaactgcctttttgtttcgaattgattatcgcacaattggcgatcctctctttgggggcgagctatgtgccgctggatggtaacgcgccagcggcccgcaatgccctgatcttggcgcaggcaacgccgtgcatgctgctggtggcgcaaccgctggaatcccctcatgggctgacgataccttgggtgctagtgcctgactggcgtagcctgctgacagaaataccgaacctgccagttagtgttgcgccagatgctttagattgcgatgcggtggtgatctttacctccggtactaccgggcagcccaaaggcgtccgactcagccaacgtaatctggtcaacttaaccgcatcctttatatccagctatcaagtgacgcatcaggatgttttgctacccattacctcagtcgcgtctgctagctttgtcggggaggtactgccgctgctcgccgctggcggtaccttagtattggcgcaaaaagcgcagagtttggatagtgatgcgctcattgcgctgctggcatctcagcgggtgactatcctgagcaccaccccatcgctttctgccagcctctctgtgctggctcagtcgatgggatcgctgcgcttgtttctgtgcggtggtgaagcgttagagtatgagcagatagcgccgcttctgccgcacatggcagtggttaacggttatggcctgaccgaaagcggtatctgctcgacctactttcctgtcgcaaagcgtagggagcaagaaacgggagcattgcccattggccgcccgattcagaacacccaagcttatgtggtggatgcatataatcgtttggtaccgccaggtgcctgtggagaactctgtttctctggtctgggcatttcgcccggctaccttgatgcacgacaggatcccgagcgctttgtcgagttgccggaataccctggcgttcgggtgctgaaaactggcgatcgtgctcgttgggcaaccgacgggatgttgttctatctcggcagacaagatcgccaagtgcagatccgtggataccgagttgaactgggcgacatcgaaagcctactgaaacagcatccggatattgctgatgcgtgggtcgatgtgcgacgcaatgcggcggcaacgccgctactagtggccttctattgcagcgtcaacggcgttgcgctggatgctcagcaattgcgcgtatggctcagcctgcggcttccgttgcatatgctgccgttgctctacgtgccgctgagcgccatgccgctaggtgtaaacggcaaaatcgatccccagtgcctgccgctggtcgatctgcggcagttggaagggccgggcgagtatgtccctccggcaaccgaactggaacagcgtctggcggagatctggcagcagttgcttggcctggagcgtgtcggcaccaccacaaatttcttcgatctcggtggacactcacttctgctagtacagatgcagcaatacatcgggcagcagtgcggtcagcacgtggcgttggttgacctgctgcgcttcactaccatcaaacgcttggcggaatttctgctggccccggacgcagcgcaagggaccacaggagatcagacacaactgcgtgcggcgaagcagcgtttggcctttggtcacacgcgctgggcagccacaaccgacagtcatcactgattccactgaatgaaacgcgtgataaacctgaatatagggggaaagcaacatggcagagaatgattttggtatagctatcattgggatggcggggcgtttccctcaagccgatacggtacaggcgttttgggaaaatcttctggcaagccgagagtgcatttccttttacagcgatgaggaactgctggcgatgggaatcagtcctgaatttgttcagcacccagattacgtcaaggccaaaggggaggtagctgacatcgataaatttgatgctgctttcttcggtatcgcaccccgagaggcggagctgatggatcctcagcaccgtgtcctgttggaaaccgcgtgggcagccttcgaagatgcgggctatgtggctgccgattatccgggggatgtgggtatttttgctggcaaaagcatggattcctatttgatgctgaacttgatgccgcactttaaacgcgttttctcttctggcagtttgcaggcggccattggtaacgacaaagacagtatcactactaccatcgcctatcacctcaacctgcgcggcccggcgatcacggtgcagacttcctcatcgacatccttggtggcggtgtgcgtggcatgccaaagtctgttgacttggcagtgtgacatggcgattgctggcggagtaacgctggggccaccagcaaaaaccggctacttgtcgcaggaaggtgggatcaccgccgccgatggccactgtcgggcgttttccgataacagcagcggatttgtgcccggcaccggcgcggggctggtggtgttaaagcgtgttgatgaagcgctgcgtgatggcgataacatctatgcggtcatcaaaggatttgccgtcaacaacgacggttcggagaagatcagttataccgcgccgagcgtggatgcccaagcgcgcgccattgctcaggcacagcggttggcaggtttgacaccgcaggatatcacttatgtggaagcccacggtaccggtacgcgtttgggcgatccggttgagttttctgcgctaagccaagcctttgcgggcgcgtcacaaaagcagtactgtgcgctggggtcggtaaaaaccaatatcggccatttggatacggcagcgggcgtcgcagggttgataaaaaccgcgctggcagtgcagcagggaataattcccgcaacattgcactttgaacggcccaatgcacagatcgatctgaccaatagtccgttttacatcaacactacctgtcaaccgtggcaaccggaaagcggcatccgtcgcgcgggcgtcacctcgcttggcatgggcggcaccaatgcccatgttgtgctggaacaagcgccagccgttgacttgcaagcgcgagcgcctgtacctgcctacagtattttgccgttttctgccaagaccgacagtgccttatcctcggggctggcgcgttttgccgattttctgcaacatgaatcgctgccggataggcgggatctggcgtggacactctcacagggacgtaaagccttcgcacatcgcgccgcgctcgtaaccagagatctacatgctgccgggacgctgttgcagcaggccgcgacagcgccgtttgctcgtggtgtagcgcagacacagctcgggctggggctgttgttttccgggcagggtagccaatatcagcgcatgggccatcagctctatcaggtttggccggcctacgccgatgccttcgaccgttgcgcgacgttactcgagcgtgaataccaactggatatccgccatgagttgttcagagcagaagtctcgttagcccaaggcgaacgccttgcgcaaacctgcctcacacaaccgctgctgttcagcgtcgagtatgccttagcccaattgtggctcagttggggaatcacgccaacggtaatgattggtcattcgctgggcgaatgggtggcagcgacgttggcaggcgtgttctctttagaggatgcgttgcgcttggtggcgcgtcgagcagagctgatgcatcaggcaccaagcggtgccatgttgatggtggcgctgcccgaagcacagattcgcgcactgattaccgccccgctggcgattgccgctgttaacgcccctgactattcggttatcgccgggcctacgtcggagatcctcgccgtcagccagcgtctgacggagcagaacatcatcaacaaacgattgcatacctctcatgccttccactctagcatgatgcaagatgcggcgcaggcgctacgtcaggcatttgagaatgtacgactgaacccgccgacgctcaccatcatctctaccgtaaccggcgcgcacgtcagtgccgacactctcaccacaccggactactggattgaacagatgctgatgcctgtgcagttctccgctgcactgcaagaggcgcaagctacatttgatgtcgattttctggaaatcgggccaggtgccaccctgacccagctgaccaacggtcatgcattaggtgatcgtctcgcgttcagctcgctgccagcaggtgcccgcagcagcgatgagcacaaacatatcttagataccgtggcagcgctttgggtgcgagggcataacatcgatttgtctgcgtttgcaggtgagcaaccgcgccgtgtctctctaccgacctacgcctttgacaaaatccgttactgggtcgacagtccagaagaacagaggagcgccgtaacgccggtggcggacgcgggaagtgtcatccctagcgaaccgtcggtgcgccgtcagccgcgtccggcgttttcggtgccttacgcggctccagagagcaaaacgcagcgcggcttagtggcgatttgtgaagcattgctgggaattgacggcttgggcattgacgacaacttcttcgaagctggcggacattcattgatgctgggcatgttgctggcgcaggtacaggaacggttcgccgtcactctttcctttttcgacgtgatggaggatgccagcgtgcgcgcgttagcgcagttggtcgagcaggagcagcaggatgatggagggtccgcacttgccgtgctagttaacgacatgattaatgagtgacgttggcaaaagtatttaacacagcgaaaaggaaaggacggtcatgacgatacatcatgccgcattggcgcgaatgttaccggcggaaaaaaaggaaaagctattacgacagttggcgcaatcaggcgtgtcgcccagccgcattcccatcatcaaagcggatccggcgcaggcaatcccgctgtcgtttaatcaggagcggttgtggtttttgcaaaaatacgacagtaccgccactaactacaacctttatgtggtgtatcgtttgcatggcgtggtggatatgccgatgctcacggaggcattgcgccatgtgcaagcacgccacgccatcttgcgtacccgtatcatagtacgtaacgatcggccttgccaggtgatagatgatgcgtcttcgttagttctcgatacggtcacgctggcagcgcaggccccaacttcagcgctagatgcggtaattcagcaggtgataaacacccggttcgatctggcacgcggtcctctgtggggggtaactcagattattcaacccgatcaaggttgtcatttggtgttttgcgcgcaccatatcatcatcgacggtatctcgttacggctattgttcgatgagttacagcagcagtatgctcgattgcatgctggtaatgaaacgtcgctgcctccgccgccgctgcaatatgccgattatgccttctggcagcgcgaatggttccaggataccttgctggcgaacgaacttgcctactggcgtgcgcgtttgcaagacgcgcctctgctgtcgacatttccatcgctgcacccgcgcccggcacaaccctctacacatggttcccggttcagcatcaccctggatgaaacattaagcctcgcgttgaaacacgtagcccgcacgcaggaaacaacgccgttcgtgctgatgctgactgccttccaactggtgctgatgcgttacgctcagcaacagcgattggtgataggcatgccagtatcggggcgcattcgcccggaattgcagagtagcattggttattatgccagcactgcggttatctacaccgattttaatggggttgaggtagggcgcgaggcgctccagcgtgtgaaggccagcgtgaaagagacgcaggggcgccagcaactgccgtttgaaaacttggtgaatatgctggatctccctcgcagcctttcccattcaccgttgttccagatcctctatatctaccataaccacgtgaccccacgcgcttttaccttggctggtgcgtattgggagcaggtgacgtatcacaatcagaccgtcaaatacgacatgacagtcgaggtgttccaaaacgacgccacgttcgacgtctcctttgagtacgatttggggttatacgatgctgatgtggtgaagcagattgccgaggcgctgcgtcagcactgcttatcgttgacatcatcactggagaccccgataggggcgatccctctgcatgcaccggagaccgcaacgccgcggcgtgatccgctcaacgccactaacgtcccgtggctcgggccgcaggatgtgctgcgtatcattgaacagcgctgtgtgcagcacccaaagcaactggcaatacagcagcatgacggcacactgacctacgctgagctctgggcgcgtgtgcagttcatcgcgatgcgttttcgagcgcatggcatacaaccgggcgatcgtattggcgtgctgttgccacgtcacagggatgtgattgcaaccatgttggcgacgtggtttgtgggggcgtgctacgtgccgttcgatattcatcagcctgccgcgcgtttgcaacgccttatgcaacgcgcgcgtttggtctgtctggtggtccgtcagccgggagagtggggtgaaattgtacaactgtcgttgccggaattgatgcaggacatgtcgaatgcgatccggtattctacaccttgcgcgctgttgccggatatgcaggcctacctgttgtttacctccggcagtaccggtgaacctaaaggcgtgtgcgttgttcaccgcgggttgctgaacttgttgttggatatgcagcgtacctttgcggttggctcgcaagaccggctgctctcggtgacgacgccaacatttgatatctcattcttggagtatctgttgccgctgatctccggtgcgagtctctatctgacagaggcggaacgcgccgcagacagcttccgtatgattccgctgattgccgactatcgaccaacgctgatgcaggcgacgccctcgttctggcacgggctgttgatggcgggttggcgtggcgacccggaactatgtgtgctggcaggcggtgaagcgctgccaacgaaagtggcggaagaactgttgcgctgttgtggttcattgtggaacctctacggtcccaccgaaacaaccatttggtcgctgaaatcgcagataacccaagcggaaaacatcaccctcggcgctcccattgccaatacccgtatatacattctggacaatgagggccatccagtgccgcaaggcgttgacggcgagctttacatcgccggggatggtgtggcgcaagggtatgatgggcagcctgagttgaacgcacagttcttcttgtcagaaccaggggtccccggtggcaggatgttccgcactggcgatctggtcaggagtgatgcgcaggggcagttgttttttgttgggcgcaaagatagccagatcaaactgcgcggttatcgtattgagttaggcgaaattgaacggacgttggcacggcatccgcatgtggacgccgcggtggtggcctgtattgaaagagcaccgttacacaaagcactggcagcattcatcatcaccagtgagcctccctcgctattcgagcaactgaaaaacgagcttcggcagcaactgccagactatatggtgccaacgctgtggcagagggtggccgacttcccgaacactgacaacggtaaaatcgatcgtaagcggttagcggaaaatttcgttgccgatagctcccttgtgtcgccgcagacgcaagcgctgagcgacacggaacagatgttgctggcgctgtggatgcgctatttgccgataaaaaacgtcgatcctgagtgcgatttctttcgcttggggggacattcgctgttggcggtaacgttggtagcagagatcaaccgcacttttcactgcgccttgaccctgaaggacattttccactactccacactacgggcactgagtgcgcgtattgcacagcaatctatcacggacgctgccgcgtctcaggatgactgggtgatagtgcacgaccctgagcatcgtcatcaaccgttcccattgacggatgttcagcgcgcctactggcttggacgacagacgggtgctacctcgatcgcgacccacatctaccatgaatttgacgtagaacactttaatgttacgcgttttacccatgcggtgaatgcgctgatcgctcgccatgaaatgctacgtgcgcgggtactccccgacggtactcagcagattctggcgcaagtgccggcgtatcagttagagcagcgcgatctgagtgctttgtcccctaacgcacgaaacgatgccttgatggcgatccgcgatcggctgtcgcatcatgtgcatcccgcagatcgttggccgctgtttgatttcagttattcggcttgcacggcgcaacatggccgcttgcatttcagtctcgatctgctgattgccgatgctctgagtatgcgcacgctacagcaggagttgatgatgctgtaccgtgagccccatgtgtcactgccgttgctaccgttctcttttcgtgactacgtgcaggcgctgttggtagagcaggcgagtgaagcctatgcacgcgatcaggcctattggcaacgggcgctgccgcagctgtatggcccaccaacgctgcccgtacagggcgatttggcgcaactgtctgcgatcaggttcgtacgtcgccgtcatcggctgtcagcccacaactggggagtgctgagcgcgctggcccaacgcacacgtatcaccaagacggcattgttgttgacagtctttagccaagtgctggcacgttggagccttagcccgacgtttacgctcaatctgacgttgttcaaccgcccgcagggttaccccaacgcagaggcagttattggtgattttaccgctgtcagcttgctgaatgtttgttacgacagccagcactcttatgcccacaacgctcagcgtattcaggtgcaactgtgggaagatctcgaacatcgtcgtttcagtgggatccgcgccagcgaggcgctgatccatagcggtcgtttccatgcgccgatgccggtggtattcactagtatgttggatatcgacggggagacgactgcgcaagaccctcgggacacaacccgttttactctgtgtccggacgccaatattacccaaacaccgcaggtgtggctcgatcaccaggtgatcgagttggctggggagttgcatttcaactgggacgcggtcgagcaactgtttgataccacgctgctggatcagatgtttggtgcttattgtcatgcgctgcaggcgctggttgccatgccgcaaagttggtggggggtaaatagttctctggcgctgcccaccgttagtgcaccggtcacgcaggctcctgcacctacggccttgttgcaccatggattactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacgctggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcgaactgggggaagtcaaaagccaccttgaacagctcgacagcgtagggagtgccgccgtggtgtgccaccagggacagctgtatgcctttatcactgccgcagaaaacctgcatcctgacgatactgacgccctgttagcgcgtgttcgtgctcagttagccgtgcagttgccgtattacctgctgccccaacatttctttcttctcaaggtgctgccgatgacaggcaacggcaaaattgatcaggcggcaatggttcaagaggttatccaacgtatgtcgcaatctacatcacagaagtcgagggccctcgcgcacgcctcgccctatgaacagcaggtggccgctctctggtgcgaggtactacaacgagaacagatcggactgaatgacaacttttttgaagcggggggcggctcaatccagatcgtgctgttgcatcgccgtattgaggagatttttaaggttacggtacctattgctgagctatttcgcttaaccaccgtgaaaagaattgccggttatttgcaggctatgcaggacaatgcacgggcggtgaatcaaacacagcagcgtgatgcttcccgatcccgcgcccagcaacgacttgtacgtcgtcaccagcgtcagcgttaaggaaaaactaatgacttacagtgaaagcgatattgccattgttggcatgaactgccggtaccccggcgtgcacagcgttgcggcattcgaaacggtgcttcgcaccggatgcaacattttggaccccaaagtgaccccgagcaacggccacaatcacattacgctgaacaacgtctatgagcacatggcggagttcgatgccaacttttttggctacagccgtgcagaagcagaaatcatggatccacagcagcgcgtatttctgacctgtgcttgggagatgtttgaacaaagcggttacaacccgaagcagcacgatgcgcgcgtcggcctatatgcgggcgtgagtaccagcttctatttgcttactcacctgatgaacaacccagacaagcttgcacaactcggtggtctccaaatcatggtcggcaatgacaaagatcatttgacgtcccaactggcttaccgcctgaatattaccggcccttgcgtgacggttcaggccagttgtgccacctcgctggtggcagtgcatctggcctgcgaagggctgctgagcggtcagtgcgatatggcgctagcgggtggcgtcacgtttcgcatggaggagcagcgcagctatgaatcgcacggtgatgggctgcaagcagaggatggcctgattcatacttttgatgcgcaggcgagcggtacggtctacagcagtggtttgggcatggtgctgctcaaacgggctacagacgcgcaggtgcaaggggataacatccttgccgtcatcaagggaagcgccatcaacaatgatggcggtgcgcgcagtggttataccgtgccgggtgttgatggtcaggaagctgtgatgattgaggcgcatagcttggcggaggtgacgccgcagcaaattcagtatctagaactgcatggcagcggcacgccgttgggtgacgctatcgaattcgcggccatcaaacgtgtgtttgggacgccagcgccgaatgcgacaccgtggcgtctgggggctgtgaaacctaacgtgggtcacgtagaaatggcatctggcatcaccagtctcataaaaacggtgctgagtcttactaaccgggtgttttaccctacgctgaattttcaacgggctaatccgcaactggggttggaggacagcccgtttgaagtggtgtcccgtttaacgccttggccggagggcaccacgccacgcaccgctggtgtgagtgcgttcggattgggcggcaccaacgcacatctggtggtacaagcgccgttatcgacgccgcaggcgagggcgcagcagatggggccttgtgtcgttgtactctcggcaaaaaaccacaatgccctggaacagatgcaaaacgccctgctggcgaaactggccgcacatccagagatacgcttacaggacgtggcttacaccctgcgtcacgggcgtttctccgccccggtacgtaagtgtgtcatcgcagagaattgcacccagctagcccgacaactccgcgacgcaccgatggtggaggcaaccacgggttgcacgatctactggagattggggcaccgtttcgttgttgcactcgagacgcttagtgactggctggcgtgctctgaggtgttgtcacaggcggtgggacaactgctcgagcattttccgctcgaaccagcctgtctgcaagatctctcccctgcgcaacggacgtttatcagccagtatgcgctgatcgcgttgattgacgaacgggaaacgttgaatgtggtgctatgcggcgacggtgatggtggctatgctgccgccgtactacgaggagactgcacactagagcaagcatggcacaggttgaatgcgggccaaccgtttgatgatgtgccgacgaatcccctcttgcagcccgatgtctgctctttgatgctggacgacgcggcgagtgatgccaatcgcaccgcgctagaggcgttagggcagttatggttggctggcgtcagcctagattggcgctgggtggatgcggcggagcgtatgttgggcagtcaacgcatcgccctgccggggaccgtttttacaccgcagcgctattgggtcgaggccgtacggcctgccacgttctcccacgaatcgtcgaataatctcttatcccgcgcaacaaaatccgatattattgcagtggtgacggagatatgggaacgcacgcttggtgtcagcattgatgatcaccacgccagcttcttcgaactgggtgggcattcgctgttagcgtcaaccattttatatgatattcagcaacgttacggcatcacctgtacgctaagcgcattctttgccgatcccaccatcgagggattaagttgctatctgctcgaacaaggcggcagtgagacagcggtttcagcattgcctgatacggtctttgcccctgaccagcagcacctaccttttccgctgactgacgtgcaacaggcctattgggttgggcggcgaaaatccttgggattgggcaatatttccacccatatctatgtggaatatgaactacaggggctagatgaaacagcgttcaaccgcgcgctcaatgcggtgattgcgcggcacagcatgttgcgtgcaattgtcaacgatgacggtatgcagcagatattgccaaacgtgccggaataccacgttgccttctataccacccagtgcgaggatgcgtttcaacagcgttgccgtgagctgcgtgacaccctctcacatcagatgattgattgtagtcgctggcctctgtttcagatggaggtcgtggttgatccgcagcaaaaagcccggctacatgtatctatcgacctgctgatagccgatgcatggagtctggagttgttcattcgggaactagcttatcactaccgccatccgcaggcggcattgcctacattgacgtacagtttccgcgactatgtgctgaccttaaaatcctacgagaaaacgccgcagtttgaacgggcacgtgactactggcgcgcccgcatcgaaactctgccgccggggccacgattgccgctgcgtaccgaccccacgaagctggaaaaccccacattcgtgcgccgtagctattgtctatctcgtgctatctggcagcgcttgaaaacgcaggcgggtcagatgagtatcacgcctactacactgctgctcacggggtttgctcaggtgttggcgcgctttagttcctcgccgcactttagccttaacctgacgctgtttaatcgtctgccgttgcacgcagatatcaatcacttaattggcgattttactgcactgacgttgctggagattgatatgtcgcagggagaaaccttgcaggcgcgggcaaacgtgatccactctcaactgtggcgcgatttggataaccgcttgtttggcggtatccaggtctctcgactgctggtacaaactcaccgcgatccggcgaaatcggtgattcctatcgtgttcaccagcttgctcaatcaatatgaggcgagctgggaaacggatgatacgctgttcaaccaaccgcaggatgatctgtacagtatttcacagacaccgcaggtgtggctcgatcatcaggtaatggagcgtaacggggaattgcactttaattgggacgtggtggaacaattgtttgaaccggcgctaatggatcagatgttccagtgttattgccaactcctgcacgccctagcccagcgaccacagctctggcatgagactcaagatgtgctggcgctgcccaccgttagtgcaccggtcacgcaggctcctgcacctacggccttgttgcaccatgggttactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacactggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcga

SEQ ID NO: 10024 - DNA, 49010 bp, Escherichia coli
aggaggtggatatacactgccatcactgttgcaattggctgcctgacaccctggcaattgttcgccacttagggtcatttggcatgtcatgccataatctgagccaggcgttagccatactcacctcttctgataccgaatctttttactcacgagttgccggaagcgattcgatatggctattgtcagtcaatgtactgccacagcatttcctgccgggccaccacggttcatctgattgaaaccggcgattgccactgcgacaaaatcatcagcgtctctcaccagtcgctcccgcgtctccaccagctcccgaaaataagctgaactgtggctgcgcattctggccaccagcaaaggtggcattgccttttcgatcgctggtaacaacgcctgaattttttcaactgcatcaggggtgtctttctctacccagcggaaaattttctgggtattgcgagccagggcttccggatggctgtcgtcatacagttccgggaacgtcattcccagctcgaaataagtccgggctatttcagctgctggaactttctcaccgtctggatacgcccaggcattcattgccatgcggatgtgttcatgcttgattttcatgaatcagctccggtgcatttgatgtgttaaccttgaatccaacaggtaaaccgtcggttgggttaggataaatatcagggcgaatttcatgcggggtaacttcccacttcattagctgacataacggaattacctgctttgggggaacgtcaaagctaaaccattgccaaacagtctgttgagcgacccccatataacgacctatttcagcttgagtgtatttctgcctaattttttcgcgagtgctatctagcattttgctctcctctaaaaaactataagcaaagcctacaataaaaaactgtacacaatcaacagttttttattgtgatgcttttaacagtatttacctgtaaaattgaataatgatgaacgccctagaagtatctatgtacagaatcagcaagcttcttcaggaaactggatggagccaggctgagcttgcccgtagaattggtgtgacacaacaaactgttcaacaatgggtcagcggtaaggctacacctaaagcctcaagtttggataaactggttgaggttacagggcatccattgcattggtttttattgcctcctgaagagggggagcaaattttcacccctgacacgatgaaaattggtcctcgtcaacgcgaactgctccaggcttttagtgcgtttccagaggaagaccaagaaaaaatgcttcaagaaatcaaagacaagaaaaaatcaatggaagaaaccattgcccggtggttggcggcacaaaaaagccgccgggcgtgaccacagtacaagaagaggagttatgccatgagtacagccctttctccgatagtttcagaattcgaaactaccgaacaagaaaacagttacaacgaatggttacgcgctaaagtggcgtcaagccttgcagaccctcgtccctcaattccacatgatgaggtaatggctgaaatggagaatcttattgctcaaattgctgtaactaacaggagcgagtaatgttacccattttgtggctaccatctgctcgcgatgatttgcgtcagatcgtagcctatattgctaaggaaaatattcctgcagcacgcagactaaaaatacggattgaaacgtctgttttagccctctctgagcatccatatctatatccgccaagtgatcgagtatccggtttgcgggaaattgtggttcaccctaattatatcgttttgtaccgagtagcaacttcaagcattgaaattgcaaatattgtgcatgcccgccgacaatttcccttccctatctgaactgaacaattttcacactccctcattcgagggagtttttttgcccaacacaacaattaaaaactgttgacacaaaacagtttttaattgtagattatttccactacccaccccgccccacagaacgcagggcaatacttcgagttacccggcagtggtcaggggttaagtagccagcccgaggcgtaagaacatgacggcagggttcaactttaactatgcagcaggtttttgttccgctcccccggcgttaaggggaaatgaggtcagcatggatactatcgagcttggcaacaacgaatctctggtatgtggagtattccccaacctggacggaacgtttaccgcgatgacgtataccagaagcaaaacgtttaaaacggaagctggcgcgcgtcgctggttaaccagaaacactgactgatgaggttgacgatggaatttaaagatttaccaatgcaattccaggaaatggcagcgaatatagttcgttcccaactggcgactcttgacctgagtatcgtagaaaaagaaaccatcgataatatatccggtaacgtgcgtcgtgcctttatcggactgtacgaagagaagcaactctctgataaccaggatttacataaaaaatacttcttggaattaatggacatcattgataagggatttggcttgttaatgaaacagaaagggattcgaatgaacccccttgaaaattacttcgcaacaagaagcattaattcctgtgatttaaagcatcccgccacagacgggagtgttacagttagccatgagatttcgattaatcattaaaatcaatagctatttcaataagtgatgccatctcgttgcattttgttgaattcatcttacgtaatgagtcacaaatatctgatggttgtgatgctgctggcaacttagcagcaagtagcataattgccgtttttatagcagtgagttcatccgcaagtccagcaggagaaacatcgtggttaaactggatatttacatttttactagtcatttcaccctcctgagggttggtaattaaggagttctccacgggtcagatggagtgcgtgcgccggacacgggtgagaatccggcactgacagtttactgaaaggatatgtccctgaaaagtcagggcataacgcgaaagcgcacggcgaaattggtctctctgtacggtgtcgttaaatttagttcgaccgtgcgcttccggttgtggcaatccgcgaaatggcgcggcggtaagtatggcggggttattccttccccgttgaggacaccgggttgtcaggttgaccatacgcttaagtgacaaccccgctgcaacgccctctgttatcaattttctggtgacgtttggcggtatcagttttactccgtgactgctctgccgccctttttaaagtgaattttgtgatgcggtgaatgcggctgagcgcacgcggaacagttaaaaccaaaaacagtgttatgggtggattctctgtatccggcgttaattgttaactggttaacgtcacctggaggcaccagacaccgcatcaacaaagttcacttcggtgatgaaaggtaagagaaaatgttgaatgtagctattgaaaaccagtacgggtggaattatagtgcacctgcacctcataaaccgggtgccgggcgtggaaacccgaaagttactcgagcgcataaccgcgccgaagcggtttttttatgcgttaagcacagccacattcagataatggtggggcgtgcagggcagctgcaaggctggccgggttctcgagtgaccggtatttccacccctgtacgtctcgccacccttatggtcgtggaaagcctcggtggtgagttaattaacttaacacttgaggatgccatcatggctactacccttaccctttctcaccctgacgtaaccattgaaaatggtcgcgcagtcactacgtctattgcgatcgcagaattcttcggcaagcagcatcaccatgttgttcaaaaaatagaggccctcgaatgttctgaacgctttttaaccagcaacttttcgcgggttaaattcgagcaccgtggcaatacctacaatgcctaccaaatcaccaaaaacggcttcgttttcctggtgatgggcttcaccggcaaaaaggccgctgcattcaaggaagcctacattgccgagttcgaccgcatggaggaagaactgcgccggaataacaccacacccgctgacaaaataatcccgggtgatgaccgaaccctggttatccgcttcgacgaacacggctacatcaaattcaccgaaaccgttcctgatggcgcactggtctgtactctggatactttccgtttttatctggaaaagcagggatggactctcataaaccggggcgcaattaaaaatatgaccgtcgagcagttgctgagtattaaatagttttctggaatttccttcatatcacaaattattaaggagattattatgattgctcatcacttcggaaccgatgaaataccacgccagtgcgtcactcccggcgattacgttatgtatcagggaagaacatatgttgcatctgtcaatgaaattaaaaaacaccgactttatatccgggggctttgcactcagcattgcattaaggacaccatgattaaggtcttcctcggtcgtgacggattgcccgcaaaagcggaatcatggtgacgggcaattaaatgcgggatcagattatatttccgttatgactggataaaccacaaaacttataaaacacaaattaaccatgaatttatgccagcaatggcagggatttgttcacccttaaatctgtaatgaggtaaaacaaaatgagtaaagtctttatttgcgccgccattccggacgaacaggtaataaaggaagaaggtgcagtcgctgtagccactgccattgaagccggtgatgaacgtcgcgcccgcgcaaaatttcactggcaattcctggaacattatccggctgctcaggactgcgcttataaatttcttgtttgcgaggataaacctggtataccccgccctgccctcgattcctgggatgctgaatatatgcaggaaaaccgctgggatgaggagtctgcttcctttgtcccggttgagactgaatcagatccgatgaacgtcacttttgacaagctggcccctgaagtacagaacgctgtcatggttaagttcgacacatgtgaaaacatcaccgttgatatggtgattagcgcgcaggaactattgcaggaagacatggcaacattcgacggacatatcgttgaagcgttgatgaaaatgccagaagttaacgccatgtatccggagcttaagctgcatgccatcgggtgggttaagcataaatgtaagcctggtgccaaatggcccgaaattcaggcagagatgcgcatctggaaaaaacgtcgcgaaggtgaacgcaaggaaaccggaaaatacacgtctgttgttgatctcgcccgcgccagagccaatcaacagcacactgaaaattcaacaggaaaaatcagcccggtcattgctgccattcatcgcgaatacaagcagacatggaaaacactggatgacgaactggcctacgctctctggcctggtgatgtggatgccggaaacattgacggcagcatccatcgctgggcaaaaaatgaagttatcgacaacgaccgcgaagactggaagcgtatctcggcatcaatgcgcaaacagcctgatgcccttcgctacgaccgccagactatttttggccttgtccgtgaacgcccgatcgacattcacaaagaccctgtggcactgaacaaatacattactgaatacctgactacaaagggcgtgtttgaagatgaaggaacaaatcagagcgcaactgatactctctcatcgccagtaccagaaactgatgcagtggaaacggcaattccggacaacgaaaaaaccgaatgcaaagtggaaatcgaaccatctgtagagcgtgaggggccgttctacttcctcttcaccgacaaggatggcgaaaaatacggtcgcgcaaacaaactttctggtctggataaggcgctggctgccggggctactgaaatcacgaaagaagaatatttcgcccgcaaaaacggtacatactcaggttcacaacaaaatactggtgcatctgacacgaccgcacaaccagagccggtaaaagttacagctgacgaagtaagcaaaattatgcaggcagccaatatcagccagcctgacgccgataagttgcttgcggcctctcgcggtgaatttgttgcagggattagcgatccgaatgatccgaaatgggtgaaggggattgaaacccgcgattctgtgaaccagaaccagcaagaaacggaacagaacgaccagaaagcggaacaaaacagcccaaatacgcaacaaaacgagccagaaacgaaacaacctgagccagtagcgcaacaggaaccagaaaaagtctgcaccgcctgcggtcagaccagcggcggcaactgccctgattgtggctcagtaatgggtgacgcaacataccaggaaacattcaatggagaaaatcaggctgaatctcaggaaaaaaatccggaggaaacggaaggcactgagcatccgcacaaggagaacactggcggcgctcaggaccacgccagcgataataaaactggcgaaacagaaaattccttaattaagatgaacggtcatcgtgaaatcacatccaccagcagagtatggaatcacctgtcagtcgaccttgaaacaatgggagccaacaccaatgcacccatagtagttattggtgcggttttcttcgacccggaaacaggggaaatcgggccggtattttatatcgttatcagcctgactgacgcaatgaatacaggggctgttcctgatggtggcaccatcgaatggtggctgaagcagtccagcgaagccagagctgccattttaactgaccaggtaaaaatgaaagatgcccttttgcgttttcgggaattcgtcaatgaacactctgatgaaaaattcgttcaggtgtggggtaatggcgcaacgttcgataacgcaattttgcgcacctcatacgaacgtctggacatcccctgtccgtggcattacagcaacgatcgtgatgtacgcacaatcgttgagatggggaaaatcacagacttcaatgccagaagcgtaattccattcgaaggcgtgcgccataatgctctggatgacgctcttcaccaggcaaaatacgtaacagccactatacaaaaactgatcccgaatcaggctgatttttaatgttcaaccctgatcgccgctaaccgcatatagttagcggcggttatgagatatagctatgagcagcttatttttaaccgaagatgaattgctaatattaacgggctgcaaatatgcaagccaccagcgaaaatggttaatggaaaacgggcttccgttctataccaatcgtagtggcaaaccgattgtcagccgggatctatttacctgcaataaaactttaccaccacgcgaggtagagccgaattttggtgcgatctgatgggaagacgaaggaaaaatcctgaacacgaaaaattacctccaaatgtatacccaaataaatatagttatgtatggaaaccaacatccagagaatctgtaacactaaccgccatcaaggatggtttagctgctttatggaaaaagtatgaggaaactgtaaataatcgcgatcgtgcaatgacattcggtcgcttgtgggaaaaattcctcgccagcgcctgttacagtgatcttagtccaagaacacaaaaagattatctgcaacatcaaaaaaagttgcttgccgtattcggtaaggtaccagcggattccataaaaccagaacacatccgtcgatacatggacaaaagaggggaacagagtaaaacgcaagccaaccatgaaaaaagcagtatgtcccgtgtttacagttgggggtatgagcgagggtacgtgaaggctaacccatgtgcaggtgtaagtaaattcaaggccaaaaaccgcgaacgatatgtaaccgacaaagaataccaggcagtattaagcgtggcaccccttcctgtttttatcgcaatggaaattgcctatctgtgtgcagcgagggtttccgatgtgttatcgctgaaatgggagcagattggaaacgacgggatctttatccagcaagggaaaacagggaaaaaacagataaaagcatggagtccacgattacaggcagcggtcgaaaaagcaaaacagttaccaaaatccgcctatgtgatcagcaatcaatacggcaaccgatatatgtacaaaggctttaacgaaatgtgggtagaagcaagaaatcgcgcaggcaaagtttcaggtattttaaccgacttcacctttcatgatctgaaggcgaaaggaatttcagactatgaaggaagcagccgggataagcaacttttctctggtcacaaaaccgaagggcaagtgctaatctatgaccggaaggttaaagtttcaccaacacttgatgtcccgttacctgaaaatattccaagaaaatattccaagtaattccaagtgtgatttttgtcactgacttaatgatgtataagtgattgaattttggcggagagagggggatttgaacccccggtggagttgcccccactccggttttcgagaccggtccgttcagccgctccggcatctctccgttcagatggttgccatgatgccaggaaatttggcattttaacagtccctgtccgtgcaattttgttcaagtgacgagtttgcgagcaaaacgatgattaagtggccctggaaagtacaagaatcagcacatcaaactgcccttccctggcaggaagcactatcgatcccccttttaacgtgtctgacggaacaggaacaaagcaaattagtcactcttgccgaacgttttttacagcaaaaacggcttgttcctttacagggctttgagctgaattcattaagaagctgccggatagcacttctattttgcctgcccgttctggagttaggactggaatggctggatagttttcatgaagtcttaatttatcctgcgccatttgtggtcgatgatgaatgggaagacgatatcggtctggtgcataaccaacgtattgttcagtcaggtcagagctggcagcaagggcctatcgttttgaactggttggatatacaagattcttttgatgcttctggttttaacctgattattcatgaagtcgctcataagctggacacccgtaacggcgatcgcgccagcggagttccctttattccgttgcgtgaggttgctggctgggaacacgatcttcatgctgcaatgaacaacattcaggaagaaatcgaattggttggcgagaatgcggcgagcatcgatgcttatgctgccagtgatcctgctgaatgttttgccgtactttctgaatatttctttagcgccccagaactttttgctcctcgtttcccttcattgtggcaacgtttctgccaattttatcaacaagatcctttgcagagactgcatcacgctaatgatacagactcgttttcggcgacgaatgttcattaattaacaactttgcagattaattaaccaattgaaatggcttatgaaatttagtgttgacagacaaggtaccgctaagtaatatgcgccccgttctcacgattcctctgtagttcagtcggtagaacggcggactgttaatccgtatgtcactggttcgagtccagtcagaggagccaattttctgttttcttgcatccttgcgaatctttatctgatgttgattcaacaggttagtgtgaaaactcttctcggtgcattttgattttaccctacgcatcgggaaaaattggtggtcaaatctggggtcaggttagttcgataatggagtgacccccatatatcccttaccgacgcaaaaatccgcaccctcaagccttctgataaaccctttaaagtcttcgattctcacggtctgtatctgcgggtcaagccgggtggctcccgccactggtatctcaaataccgtattagcggtaaagaatcccgcattgcgctgggtgcctatccagccatctccctgtctgatgcgcgacagcaacgtgaaggtatccgtaaaatgctggcgctgaatatcaacccggtacagcagcgggctgctgtacgtggctcacgaacaccggagaaagtttttaaaaacgtggcgctggcgtggcataaaagtaacaggaaatggtcgcagaacaccgccgaccgtctgcttgccagcctgaacaatcacatctttccggtcatcgggaacctacctgtatcagaacttaaaccccgtcatttcattgacctgcagaaagggatcgaggaaaaaggtctgctggaggttgcgtcccgcacacggcagcacctgagtaacataatacgccatgcggtccatcaggagttaatcgatacgaaccctgcagcaaaccttggcggcgtgaccacacctcctgtcagacggcactatcctgccctgccgctggagcggctgcctgaactgcttgaacgtattggggcatatcatcagggccgtgaactgacccggcatgccgttctgctgatgctgcatgtgttcattcgctccagtgaactgcgtttcgcccgctggtcagagattgatttcacaaaccgagtctggacgatacccgcgacgcgagaacccattattggcgtgcattattccggccgcggggcaaaaatgcgaatgccgcatatcgtccccctctcagaacagtccatcgccattctgaaacagattaaggatatcaccggtaataatgaactgatcttccccggcgaccataacccgtataagccaatgtgtgaaaacacggtcaataaggcactgcgggtgatgggttacgacacgaaaaaggatatctgcggtcacggcttccgggcaatggcatgcagtgcgctgatggaatcgggtttatgggcaaaggacgcagtagaacgccagatgagtcatcaggagcgcaataccgtgcgcatggcttatattcataaggcagagcacctggaagcccgcaaagcgatgatgtagtggtggtcggattatctggaagcatgccgagaatcttatgcaccgccttatacaattggtaaaaataagtttatcccatagtatactaacgaatcccacactctggcaaattaccaccacctccacaggaggtggttctatatagacttttatcaacttcatgacgaaaaacacctattttatcccaaaagaagacaatagagtcacagaggaatcaaagagcgactcaattgtctttggacagtctggttgtgaggttagaaaacagttactcctacaccattaaatagggcgcaatgctcgctaatttctcccgggtttctgtcagttcgcgttccggcgtagattgcgcgatgattcccgcccccgcctgtatccagcagcgctggctatcctgaaatacggaacgcagaactagcgccgcatcaaagcgcgtatcgtccagcagcaggattgcgccggaataaagctctcgcggcgtcttctcaatttgcataatcgcgttcagagcagcatttttagggatacctgaggcggtaatcgacggaaacagcacggtaaacgcatcccaggcatccttgttttccgcaagctgaccgctcacgccagaccccagatgctgaacgctgccgcgctggcgaaccgacattaaatcttcaaccaccacgctgcccggctggcaaacagcctccagttcagcaatagcttctttgacagaaaggatatgctcaagcacctctttactgtcgtgcagcagttctgcctctttcgccttattatgctccgggtttcccatgcgatcgcgggtgcccgcaagcggttcagtgaccactttattgcccgtcactgacatcaccagttccgggctaaagcccagcgcttcgcgtccttcctgacggaacataaacgagcgcacaggcgtgtttgcctgccgcccgtataacagcgtggcgggcatatcaatccgcgatggcaggggaatggcgcgcgagacaatcactttgacatactcgccacggcggatctccgcaacggcgcgcgcaacctgttgtttatatgcctcaccattgagggcggtatccaccgccagtggtgcgttctgcgtcgttgtaccggcctcttttacccactcgcacaaacgtcggcacccgtcggcggagtccgcataaacggtgacatttcccttttcaaaaataagttcttcacggggaacggttaacgtcagcagcggccactccccggcgttaaaggcaatcccccgcgcatgcgccgcaaagttgaacccaacctgtccatatacccgacgtcctttcacctgaggatgcgccataaaacgacgcgcgcagtcggcaatggaatccaccgcccatttttgctccccagcatcatcaataaatgtcgcctgcgttccgtcggcattaatgtgcagccgtgcctggcaccctttgcctaaataccaacagggttgacgctcatagacataacactcttcttctgcgaactggcgtaaaacgccagaaatcgtcggtagccattgttcctctggtaacgccagatgtagaaactcactgattttcatcccttacctctctgtgttattcccggatcaatcaattgcgcttgtcatcagttctcttgccgaatgcagccggatataagcaacccacgccgccagcaacgtgaatgccccggcaaacaggaagcaggccgcatagccaaaatgttgagcaacaacgccaccgataacgccagccagaatggcgattgccgcgtcagtacattgaaagagggtgaagtcgacaccggcctgcaaaggcgatgaaagcgacatcagcgtggcgtaaagacagaccagcgcgcaggccagcgaaatggactggacaatgaccagacactggagaatctgcagcagcagatgacccggcgccatcatgagcgtcatcaccaccgccagcagcgcgatcccctggacgccataagccgtcaacagcgctctgccgggtgaggtgtatttcatcagcaatccgccggccagcgttcctgctatgcccgctgcaatattgccgccgctgaacagcgcgcccaatgcggacatgctcaacccatgatccaacaacagcggtgccagaagaggcagcacaaaccgcatgcctgaattcagcatcaataccagcagtaagcccaggcgcgcctgcttcctccttagcgcataacctaacgccggaacatgcgggatagtcgctgttcgcgtcggctccgtaatgcgccacagcgggagtgacagcgccataatcagcaccgccatcatcagcatggcgacaggccagccggatgccgccgacagcatcaggaacaccccgccgccgcacatcattcccagatagctgccgccgacctgcacgctgtttccccagccgtaacccgtgcgggtcagttgatcgacacaaaagccgtcgctggcgatatcaatggtggaggcgaccgtgcctgccaccataaacagaacaaataacgcgacgatttgcgtatcggggaatcccccttctcgcccaaaccagccaatcgctgcggcaatagtcaggatcgccgctagcgcgacctgaccacgcaggattaacatgcgggaacggcgttcctggctaccgggcggaagccgccagcgctcgatccacggcgcccaaataaacttcagcgcccagggcagcataaacagggttgtcgcaccggcaagcgccagcgaaccgccagcagcgcgcaccagcgcgggtaaggactgcatagacagcgccgataccagactctgcgtcacatagacgccggcaatagcaaaaatcacccgcccggtcgtcaacgtcagaggtttcacattcgactgaacatcactcatgcacccactctccagacgcggaacccccgtcgtcgcgccacacgcgcgcggccatttgcgcctgccacagcgcctgataacgtccatgatgtgagagcaattgcgcatgagtaccctgctcaaccacctgtccctcttccatcaccagaatgtttccggccccggcgatggtggataaacggtgagcgatgataatcaccgtccggttgtgaaccaggttatcgatcgctttttgcaccgccagctcgctttcaatatccagcgcggcagtcggttcatcgagaatgacgaccggcgcgtttttcaataacgctctggcaatggaaatccgctggcgctcgccgcccgatagctggccgcccatctctcccattggcgtcagccagccttgcggaagacgggaaataaactcaaggcactgcgccgcgcgggcggcctcttctacctcctgccgcgtcgcctgtgggcgcgcgatacggatattcgccagcagcgtgtcatcaaacagccagacatcctggaaaacaacagaaatcaggctattgagctgttccggcgtcaggcggcgaatatcgacgccgccaatagaaatctgcccttgctgcggatcggcatagcgcattaacagtttggtgaccgtagttttgcctgcgccggaggcacccaccagcgcgctcatactggctgccgggaacgtcaaagaaacatgattaagcgcgtggccgtcaccttcttcgtagcgatagctgacgttgtcaaagcggatatcgtaacgttccggcatctcgctttgctctgcgacgggaagcggtgctatcgccataaactgctcaatccgttgcagggcgctggcgatcagttccacaaccgaggtgtagctgataaacatcgccatcggttctgcgaagcgcataatcatcgcgacggcggcaatcaaaaaggcgaggttcagagtgcccgtcactacccagacgatcccggataacaccaccacctgtaggcccaactccacgacgctggcgatcagcatcgttgcgccagcgccctgacggtgagtgcgggtctgtaagttttccagcgcattgaaatgcgccagcagcgcccggcttttatcggcatcgctgccgcaggtgcgcaataccatcatcccctgagcaaattcaacgatatcgccgctcagacgctggtgcgcttcccccagcgtctgcatttgtcgccgcatcgccgggcggcgccagtaataaaacggcaccagcagagggaagatcagcaacatcaccagccccagccgccagtctatccacaatgtcgccagcgacgccgtcagcggcgtgacaatggtgagcagcaaaatattggctatcgcaataacataattgaggttttcatccacgctgcccagcagcaaggcgttcatttcacccgccctgccgcgctggagcttctccagcggcacgcggcgtaactgctcgccaagtcgcaggcgcaactcatgggtagcctgcgccagatgaccacggtattcaaagcccaggccataccagcgtagcaccagcgtcacaattgcggcgacgctgaaggccatagcccagttaagaagttgcggcgcgtctccccgtaacagcgcatcaatgatcggataaagacaggcaaaggcgatcccctgcatgaatgccgccagcaacagcgccagcatactgcgtcgcagcatcctggcctgactgccaacgctggagataagctggcgccagatgacgcgccaggccaggttatccgcaggattattgtctttcattttccaccacctcttcctgtgttccacccggcacccaatgctgcgcctgctgatagtgttgccagagccgttgatacaggccgccctgcgccaacagttgcgtatggttccccatttccctgagttgtccgtcggaaaacagcaatatcacatcggcctgagtcaccattgagagacgatgcgcgaccatgatgaccgtccggccacgcatggccgccgcgagcgccttgataagcgccgcttcgttttccgggtcagcaaacgccgtcgcctcatcgagcaccaggatggggcgatcctgcaaaagcgcccgggcgatagtaatgcgctgccgctggccgccggagagaaataccccacgttccccgactcgagtgttgtaaccttctggcagagcgctaataaaatcatgggcctgcgccactctggccgccgctataaccgcctccagcggcgtatccggcgcgcccagacgaatgttattggctatcgtgtcggcaaaaaggaagttgtcctgaaacacaaacgagagttgcttcatcagggtgtccgtctgcatatcacgcagatccacgccgccaatacggatatggcctttgtccgggtcggcgtaacgcagcagcaagcgcgccacggtgctttttccggcgccgcttggcccgaccagcgccacaatttgcccggcaggcacatgaaagctcacctcctgcaacgcggcgccagtacgcgcttgcggataatgaaagctcacctgctcaaaggtaatgctcgcctcttgcggctgctggtcagactgcggcagcgataactccggcatcgcgagaacctgataaatacgctgaatgcttaaacgcgtttgcgcgaccaggttattgagcatcatcattggcattacggcttcggccattccgctgcccagcagtaaaacggccacccacgcgataaaatcgaaactgccatagtgcaacaggccgtatcccgaccagatcaggacaaacagggtcgggagaggattcagaatcgagaaggaaaaacgcgctgaaaaaccggctttgcgataccaggttttgagcacatcgacccactcttcaagggcgcgttgatagcgcaaaaaactggtgctgccgctatcaaacgttctcaccacgggcatggcctgcacgaactcaataaccgccgcgctaacctgctcgcgcgccttatgataacgctgagccatattttccgaacgctggcgggcgagcacgagaacaaccgatccaaacgccagtacccccagcgtcgcgattgccagccgccagtccagccagaacaagataacgattgtcgccagcggcatgatgatcgcgcgggcatagagcggcgtgctgtcggccacaaaaatatgtaacgacttcacgtcatccagcatcactttcgccactgacccgctgcccatttgctgtaacacgccaggcggaagctgcaatgctttacgggctaacctgctgcgcagaatgttctccagatgaaaagccgcgtaatgagaggtgttgaacgcctgtaagcgcagaacaaaagttaagaccacgcagccgatcacgccgcccagcggccaggccggaatagcgtcaggcgtcgcgcgaatgtcacgcaggctccacgccagaaaaaggagcgcccccaggctggttaatgccgccagccccgccagcgccatagctaaaataaccttcctgcgaaccggtgtaatcacctgccagagaggaaatcgggacagcgattcagtattggatgattgagatgacatgggagtaactgaatttcctgatgaatttttacggacgccaaaaacgacaattcagggtggcgttctgagaattaatgtgaataataaccattatcaataactcatctaccccattcggttctatttatacccgcattggtctaagccacagggagataaccaggtcatgacggagtcaccgcaaacgcaatctgaaatctctattcaccagttggtggtcgggaaacctgcaaacgatggcaatattcctgctcagtgtgaactgctgcgctgttcgttgcaggaaggtatggatattttgctctggaggggccattttgcgcggccagagacgttgcagctacacgacgatctgggcaggattaacttctcgtgcatcctggaaggcacatcgcgctttgcgattcagggactccggcgccacaccgactgggagcttgcgcgcaatcgccattacattacccatacgccagactgtcgcggcagcgcctcctattgtggccgattcgagagcattaccctctccttcagccctgaaaccctcgcgctgtgggtgccggatattagcgcggtcattaagaataagatcgactcccactgctgttgccagcagcagcgttgtaatgctgaaacccacttaacggctcaggccttgcgtcacgcgctgatgcgcatgcacggcggcttcagtcatgaacaaaagccgtcgacgctatggttgcaggggcaaagtctggtcatgctcagcctggtgctggatgaacatcgcgaagacgccagttgcctctcctgccacttcaacccgatggaacgccagaaactgctgcgggcgaaggatctgctgctggctgatctgacgcaagcgccgggcgtcgcggagctggccagagagtccggtctgagcgttctcaaaattaagcgaggcttccgcgttctgttcaacaacagcgtctatggcctgtttcaggctgaacgaatgcaggaagccagaagacgcctggccaacggcaatacctccgtcatgacggtggcggccgatctgggctatgccaacgccagccatttctctgccgccttccagaaacagtttggcgtaactccttcgacctttaaacgcgggatgtaaccggggtcgcgcccccctaaactcctccctgacagaggcccggatacctcatccgggcctctgttctttccgcctgttaccaacccgaaacgggcataaataaacccgtttcgggtagcattcaattgttaataattattattctcatatgagtaatgcttttcggtaagacgtgccatcaggaggaagaatgatttctggcgcaccatctcaggattcgctgttaccggacaaccgccacgcggctgattaccaacaattacgcgagcggctcatacaggaactgaatttaacgccgcagcagttacatgaagagagcaacctgatccaggccggcctggattccataagattgatgagatggttacactggtttcgtaaaaatggctaccgccttacccttcgcgagctgtatgccgcccccacgctggcggcatggaaccagttaatgctcagccggtcgccggagaacgcggaagaagaaacgccgcccgacgaatcatcctggccgaacatgaccgaaagtacgcccttcccattgacgccagtacagcacgcctacctgacgggccgcatgccggggcagacgcttggcggcgtgggttgccacctgtatcaggagtttgaaggccattgtctgacggcgtcgcagctggagcaggccatcacgaccttgctgcaacgccacccaatgctgcatatcgcctttcgccccgacgggcagcaggtctggctaccgcaaccttactggaacggcgtcaccgttcatgatttacgccataacgacgctgaaagccgccaggcctatctggacgcactgcgccagcgcctgagccaccgtcttttacgcgtggaaatcggcgaaacgtttgattttcagctgacgctcttgccggacaatcgccaccgcctccatgtcaatattgacctgctgattatggatgcctccagctttacgcttttcttcgatgagcttaacgccctgctggccggagaatcgctgccggctatcgacacccgctatgatttccgctcgtatttgctgcaccagcagaagatcaatcaaccactgagagacgacgctcgcgcttactggctggcgaaagcatcgacgcttccccccgcgcccgtcttgccgctggcctgcgaacccgccacgctacgtgaagtccgtaatacccgacgccgcatgattgtcccggcaacacgctggcacgcctttagcaaccgggccggcgagtatggcgtgacgccgacaatggcactggcgacctgtttttctgccgtgctggctcgctggggcggcctgacgcgtctgctgcttaacatcaccttattcgaccgccagccgctgcacccggcggttggcgcgatgcttgccgacttcaccaatattcttctgctggataccgcctgcgatggcgataccgtcagcaacctggcgcgtaaaaaccagctcacgtttacggaggactgggagcatcgccactggtccggcgtcgaattactccgtgaactcaaacgccagcagcgctacccccacggcgccccggtggtatttaccagcaatctggggcgttccctctacagcagccgcgcagaatcgccgttgggcgagccggaatggggcatctcgcaaacgccgcaggtctggatagatcatctggcgttcgagcatcacggcgaggtctggctacaatgggacagcaacgacgcgctgttccctccggcgttagtcgaaacattgttcgacgcctactgccagttgattaaccaactctgcgatgacgaaagcgcctggcaaaagccgttcgcagatatgatgcccgccagccagcgcgcgatacgcgaacgggtcaacgccaccggcgcccccattcccgaaggcttgctgcatgaaggcattttccgtatcgctctgcaacagccgcaggcgctggcggtaacggacatgcgttatcagtggaattatcatgagctgacagactatgcccgccgttgcgcgggcaggttaatcgagtgcggggttcagcccggcgataatgtggctatcacgatgtcgaaaggcgcaggacaacttgttgcggttctggccgtcctgctggccggggcggtttacgttccggtttcgctggatcagcctgccgcacggcgcgagaaaatctacgctgacgccagcgtccggctggtgctcatttgtcagcacgacgccagcgccgggtcagacgatattcccgtccttgcctggcagcaggccattgaggcggagccgatcgccaacccggtagtacgcgcccccacgcaaccggcctacattatctacacctccggctctaccggtacgccgaaaggggtagtcatttctcaccggggagcgcttaacacctgttgcgatatcaatacccgctatcaggttggcccgcatgacagggtgctggccctctccgccctacattttgatttatcggtttacgacatttttggcgtactgcgcgcgggcggcgcgctggtgatggtgatggaaaatcaacggcgcgatcctcacgcatggtgtgagctgatccagcgccatcaggtcacgctctggaacagcgtcccggcgctgttcgatatgctgctgacctggtgtgaaggtttcgccgacgccacgccggaaaacctgcgcgcagtgatgctttccggcgactggatcgggcttgacctccccgcccgttatcgggccttccggccacaaggacaatttatcgcgatgggcggcgccaccgaggcgtctatctggtctaacgcctgcgaaattcacgacgtccccgcccactggcgctccatcccttacggttttccgctaaccaaccaacgctaccgggtggtggatgaacagggccgggactgccctgactgggtgccgggtgaattatggattggcggcattggggtcgcggaaggctatttcaacgatcccctgcgtagcgagcagcaatttttgacgctcccggacgagcgctggtatcgcaccggcgatctcggctgctactggccagatggcacaatcgagttcctcggtcgtcgcgacaagcaggtcaaagtcggaggatatcgcatcgagctgggcgaaatcgaaagcgcgctcagccagctggcgggggtgaaacaagcaaccgttctggcgatcggcgaaaaagaaaaaacgctggcggcatacgttgttcctcagggcgaggctttttgcgttaccgatcatcggaacccggcactgccgcaggcgtggcacacgcttgcgggaacgttgccctgttgcgccatctcgccagagatctccgcagaacaggtagccgatttccttcagcatcgcctgctaaaactgaagccgggtcacaccgctggcgccgatcctctccccctgatgaactcactcgctatccagccgcgctggcaggccgtggtggaacgctggttagcatttctggtgacacaacggcgactgaagcccgctgctgaaggttatcaggtctgcgctggtgaagaacgcgaggatgagcacccgcacttcagcggacatgatttaacgttatcgcaaattcttcgcggtgcccgtaacgaactgtcgttactgaacgacgcgcagtggtcgccggaaagcctggcctttaaccatccggccagcgccccgtatattcaggaactggcgacaatttgccaacagcttgcacagcgcttacagcgcccggtacgcctgcttgaggtgggaacccgcactggccgcgccgcagaatcgctgttagcacagctcaacgccggacagattgagtatgtcgggcttgagcagagccaggagatgctgctgagcgcccggcagaggctcgccccctggcctggcgcccgtctgtccctctggaatgcagacacgctggcgacgcacgctcactcggcggacattatctggcttaataacgccctgcatcgtctgctgccggaagatcccgggctccttgcgacattacaacagcttgccgttcccggcgcgctgctctacgtgatggagtttcgccagttaacgccgtccgccctactcagcacgctcctgttaaccaatgggcagccggaggccttgctgcataacagcgccgactgggcggcattatttagcgcggccggcttcaactgtcagcatggcgatgaggtcgcggggttacaacgcttcctcgtacaatgtcctgacaggcaggtgcgccgcgatccccgtcaacttcaggccgccctcgccgggcgtctgccggggtggatggtgccgcaacggatcgtattcctcgacgccttaccgctgacggctaacgggaaaattgactaccaggcgctgaagcgtcgtcatacccctgaagcggaaaacccggccgaagcggatttaccccagggcgacattgaaaaacaggttgccgccctctggcagcaactcttatcaactggcaatgtcaccagagaaaccgacttcttccagcaaggcggcgatagcctgctggcgacccgtctgaccgggcaacttcatcaggcaggttatgaagcgcaattaagcgacctgtttaatcatccccggctggcggattttgccgccacgctgcggaaaaccgacgtcccggtcgaacaaccattcgtccactcccctgaagatcgctaccagccctttgcgcttaccgacgtgcagcaggcttacctggtggggcgtcagccgggctttgccctgggcggcgtcggctcacatttctttgttgaatttgaaattgccgatctggacctcacccggctggagacggtctggaaccgattaatcgcccgccacgatatgctgcgcgccatcgtgcgtgatggacagcaacaggtgctcgaacagacgcccccttgggtgatacccgcacacaccctccatacgcctgaagaggcgttgcgggtgcgcgaaaaactggcgcatcaggtactcaaccccgaagtgtggccggtattcgatctccaggtcggatacgtggacgggatgcctgcccgcctgtggctgtgtctggataacctgttgcttgacggtctgagcatgcagatcctgctggcggagctggagcacggctaccgctacccgcaacagctgcttccgccgctgcccgtcaccttcagggattatctgcaacaaccctcgctacagtcgcccaatccagattctctggcatggtggcaggcgcagcttgatgatattcctccggcgcctgcgttgccgctgcgctgcttgcctcaggaggttgaaacaccgcgcttcgcccgcctgaacggcgcactggacagcacgcgctggcatcggctgaaaaaacgggcggctgacgcccatctcaccccgtcggccgtactgttgtcggtgtggtcaacggttctctctgcatggagtgcacagcctgagttcacgcttaaccttacgcttttcgacaggcgaccgctgcacccgcaaatcaaccagattctgggcgatttcacctcgctgatgctgctgagctggcatcccggcgaaagctggctgcacagcgcgcagtcactacagcagcggctgagccagaacctcaaccaccgcgatgtgtcagccatccgcgtgatgcgtcaactggcgcaacggcaaaacgtgcctgccgttccgatgcccgtcgtctttaccagcgcactgggctttgagcaggataacttcctcgcccggcgtaatctgctcaaaccggtctggggcatctcccagacgccgcaggtctggctcgatcaccagatttatgaatccgaaggcgaactgcgctttaactgggattttgtcgccgcgctgtttcctgccgggcaggtggagcgccagtttgaacagtattgcgcattgctaaaccgaatggccgaggatgaaagcggctggcaactgccgctcgccgcgctggtgcctcccgttaaacacgcagggcaatgcgcagagcgctcaccgcgcgtatgccctgagcactctcagccacacattgcggcggacgagagcaccgtcagcctgatttgcgacgccttccgcgaggtggttggcgagtctgtcacgcccgcagaaaacttctttgaggcgggcgcaacgtcgctgaatctggtgcaactgcacgttttgttacaacgtcacgaattttccaccctgacgttgcttgacctcttcacccacccttctcctgctgccctggccgattatctggccggcgtcgccacggtggagaaaacaaaacgacctcgccctgttcgccgtcgtcagcggcggatatagcgcgaagcaaactgattttccccggaacgccatcgcgaacgcatggcgttccattgactttgtgaatcttaggaaacgggaccgattatggataacttgcgcttctcttctgcgccgacagcagattccattgatgcatcgatcgctcaacactacccggactgcgaacctgtcgcggttatcggctacgcctgccattttcctgaatcgccggatggcgaaacgttctggcaaaatctgctggaaggtcgtgaatgcagccgacgctttacgcgcgaagagcttctggccgtcggtctggatgccgccatcattgacgatcctcattatgtcaatatcggtacggtgttagacaacgccgactgcttcgacgccaccctgtttggctattcgcgacaggaagcggagtcgatggacccgcagcagcgcctgtttttgcaggcggtctggcatgcgctggaacatgccggttatgcccccggcgccgtcccccataagaccggcgttttcgcctcttcccggatgagtacctaccccggtcgcgaagcattgaacgtgacagaagtcgcgcaggtaaaaggtctgcaatctctgatgggcaatgataaagactatattgccacccgcgccgcgtacaaactcaacctgcacggcccggcgttatcggtacagaccgcctgctccagctcgctggttgccgtgcatctggcctgtgaaagcctgcgcgcaggcgaatccgatatggcggttgccggcggcgtggcgctctctttcccccagcaggcaggctaccgctaccagcccggaatgattttctctcctgatggtcactgtcgtccctttgacgcctcggctgagggcacctgggccggtaacggtctcggctgcgtggtgctgcgtcgcctgaaagacgcgctactgtcaggcgatccgattatctcggtgatcctctccagcgcggtcaacaacgacggcaacagaaaggtcggctataccgccccttccgtcgcagggcaacaggcagtcatcgaagaggcgttaatgctggcggccatcgacgacaggcaggtaggttacattgaaacccacggcaccggcacaccgctgggcgacgcgattgaaattgaagcgttacgcaacgtctatgcgcctcgcccgcaggatcagcgctgtgcgctcggttccgtgaaaagtaacatgggccatctggataccgcggcgggcattgccggactgctgaaaaccgttctggcagtcagtcgcgggcaaattcctcccttactgaattttcacacccccaacccggcgctgaaacttgaagagagcccctttaccataccggtgtcggcacaggcatggcaggacgaaatgcgctatgcgggcgtctcctcctttggtattggcggcaccaactgccatatgatcgtcgcctcgctgcccgacgcgctcaacgcgcgcctccccaatacggatagcggcagaaaaagtaccgcgctgctgctcagcgccgccagcgacagcgcgttgcggcggctggcgacggattatgccggggcgctgagagagaatgcggatgccagctctctggccttcacagccctgcacgcgcgccgtctcgatctccccttccgcctggcggcgccattaaaccgtgaaaccgccgaggcgctcagcgcctgggccggtgagaaatcgggggcgctggtttacagcggccacggcgccagcggcaagcaggtgtggctgtttaccggccagggctcgcactggcgcactatgggtcaaacgatgtaccatcactcaacggcgtttgccgacacgctggatcgctgtttttccgcctgtagcgaaatgctcacgccgtcactgcgcgaagcgatgtttaaccccgattcggcgcagctggacaatatggcctgggcgcagccggcgattgtcgcgtttgaaatcgcgatggcggcgcactggcgtgctgaaggactgaagccagacttcgccattgggcattccgtcggtgaatttgccgctgccgttgtctgcggacactatacgattgaacaggtcatgccactggtttgtcggcgcggcgcgctaatgcagcagtgcgcaagcggcgcgatggtggcggtatttgcagacgaagacacgctgatgccgctggctcgccagtttgagctggatctcgccgccaacaacggtacgcaacatacggtattttccgggccggaagcccgtctcgcggtattttgcgccacgctctcgcagcatgacattaactatcgtcgcctgagcgtaaccggtgcggcgcactccgctttactggagccgatactcgatcggttccaggacgcctgcgcgggactgcacgcggagccggggcaaataccgattatttccacgctcaccgccgacgtcattgatgagtcaacgctcaaccaggcggattactggcgccgacacatgcgccagccggtgcgttttatccagagtattcaggtggcgcatcagctcggcgcccgcgtttttctggagatggggcccgatgcccagttggttgcttgcgggcagcgcgaataccgcgataacgcatactggatagccagcgcccggcgtaacaaagaggcgagcgatgtcctcaatcaggccctgctccagctttacgctgccggcgtcgccctaccgtgggccgacctgctggcgggcgatggacaacgtatcgctgcgccatgttatccgtttgatactgaacgttactggaaagagcgcgtctccccggcctgcgagcctgccgacgcagcgctgtctgccgggctggaggtggcgagtcgcgccgcgacagcgctcgatctccctcgcctggaagcgcttaaacagtgcgccacgcgactgcacgccatctacgtcgatcaactggtacaacgctgtaccggctatgccattgagaacggcgtggacgccatgaccatcatgcgccgtggacgtctgctgccccgctaccagcagctactccagcgcctgctgaataactgcgtggtcgacggcgattaccgctgcaccgacgggcgatacgtccgcgcccgccccattgaacatcaacagcgggaatcactgctgacggaacttgccggttattgtgaaggttttcaggctattcccgacaccatcgcccgtgccggcgatcggttatatgaaatgatgagcggcgcggaagaaccggtggcgattatcttcccgcaaagcgcctccgacggcgtggaagtgctgtatcaggaattcagctttggccgctatttcaaccaaatcgccgccggggtattacgcggcattgtccagacgcgtcagccccgccagccgttgcgtattcttgaagttggcggcggaaccggcggcaccaccgcgtggctgctgccggaactcaacggcgttccggcactggagtaccatttcaccgatatctcggcgctgttcacccgtcgcgcccagcagaaattcgccgactacgattttgtgaagtatagcgagctggatctcgaaaaagaggcgcagtctcagggtttccaggcacagtcttacgatcttatcgtggcagcgaacgtgattcacgccacccgccatattggccgcacgctcgataatctgcgccccctgctcaagccgggcgggcgcctgctgatgcgcgaaatcacccagccaatgcgtctgtttgacttcgttttcggcccgctggttcttccgctacaggatctcgacgcccgcgaaggtgagttattcctcaccaccgctcagtggcaacaacagtgccgccacgccggattcagcaaagtggcgtggctaccgcaggatggcagcccgaacgccgggatgagcgaacatatcattctcgccacgctgcccggtcaggcggttagcgccgtaacattcaccgcgccatcagaacccgtgttggggcaggcgctgacggataacggtgattatctcgccgactggtctgattgcgcaggtcagcccgaacagtttaacgctcgctggcaggaggcatggcgtctgctttcacagcgtcatggcgacgctctgcctgtggaaccgccccccgtcgccgccccggagtggctggggaaggttcgcttaagctggcaaaacgaagccttttcccgcggtcagatgcgcgttgaagcccgtcatcctgctggcgagtggctgccgctatcgcccgccgcgcctcttcctgcgccgcaaacgcattatcaatggcgctggacgcccctcaacgtcgccagcattgaccatccgcttacctttagcttcagcgccggtacgcttgcgcgcagcgacgagctggcgcaatacggcatcattcacgatccgcacgcctcttcacgactgatgattgttgaggagagcgaggatacgctggccttagcggagaaagtgatagcagcgctcaccgccagcgcagccggattgattgtggttactcgccgcgcgtggcgagtcgaggaaaatgaagcactctctgcatcccatcacgcgctatgggccttgcttcgcgtcgcggccaacgaacagccggaacggttgcttgccgccatcgatctcgccgaaaacaccccgtgggaaacgctgcatcaagggttgagcgcagtctcactatcacagcgctggctcgccgcacggggtgacaccctttggcttccttcactgtcgcccaatacgggatgcgccgctgaattaccggcaaacgtgtttaccggcgatagccgctggcatctggtgaccggagcgtttggcggattaggccgccttgccgtgaactggctcagagaaaaaggggcgcgacgcatcgccctgctggcgccgcgcgtggatgagtcatggctacgcgacgtggagggcgggcagacgcgcgtctgccgttgtgatgtgggcgatgccgggcaactggccacggttcttgacgatctggcggccaacggcggcattgccggagcgattcatgccgctggcgtattggctgacgcgcccttacaggagcttgatgaccaccagctggctgccgttttcgcggtaaaagcgcaggcggcaagccagctgttgcaaaccctgcgcaaccacgacggacgctatcttattctctactcttccgctgccgccaccctcggcgcgccgggtcagagcgcccatgcgctggcctgcggctacctggacgggctggcccagcagttttccacccttgatgcgccgaaaacgctctctgtcgcctggggcgcatggggagaaagcggtcgggcggccacgccggaaatgctggcgacgctcgccagccgaggtatgggcgcgttaagcgatgccgaaggctgctggcacctggaacaggcggtgatgcgcggcgccccgtggcgactggcgatgcgcgtttttaccgacaaaatgcccccgttacaacaggctctgtttaacatcagcgccacagaaaaagccgcaacgccggtcattcctcctgctgatgacaacgcctttaacggcagcctgagcgatgaaacagcggtgatggcatggctgaaaaagcggattgcggttcagctaaggctgagcgatccggcgtcactgcatccaaaccaggatctgttgcaactcggcatggactcgctgctcttccttgaactcagtagcgatattcagcactacctgggtgtacgcatcaatgcggaacgggcgtggcaggatctgtctcctcatggactcacgcagcttatctgttctaagccagaggcgacgcctgccgcttcgcagccggaagtgttgcggcacgacgccgacgagcgttatgcgcccttccctttgacgcccattcagcacgcctactggctggggcgaacccacctcattggctatggcggcgtcgcctgtcacgtcctgtttgagtgggataaacgccacgatgagttcgatctcgccatactggagaaagcatggaaccagctcatcgcacgccacgatatgttgcgtatggtggttgatgccgacgggcagcagcgaatcctggcgacaacgccggagtatcacatcccgcgtgacgatctgcgcgcgctttccccggaagaacagcgcatcgcgctggaaaaacggcggcatgaactgagctatcgcgttttgcctgccgaccagtggcctctttttgagctggtggtcagcgaaatcgacgattgccattaccgtctgcatatgaacctcgaccttttgcagtttgatgtgcagagttttaaagtcatgatggacgacctggcgcaggtctggcgcggtgaaacgctggcaccgctcgctattaccttccgtgattatgtgatggctgaacaggcgcgccgacagacatcggcatggcacgatgcctgggattactggcaggaaaaactgccgcaactgcccttagcgccagagctgccggtggttgagacgcccccggaaacgccacacttcaccaccttcaaatcgacgatcggcaagacagaatggcaggccgtgaaacagcgctggcagcagcaaggcgtcacaccgtctgccgcgctgctcacgctgtttgccgccacccttgagcgctggagccgtaccacaacatttacgctgaacctgacgttcttcaatcgccagccgatccatccgcaaatcaaccagttgattggtgattttacctccgtcacgctggttgattttaacttctcagcgccggtgacgttgcaagagcagatgcaacagacccaacagcgcctctggcaaaacatggcgcacagtgaaatgaacggtgttgaggtgatccgtgagctgggccgcctgcgcggatcacaacgtcaaccgctgatgccggtagtgtttaccagtatgctggggatgacgctggaaggcatgactatcgatcaggcgatgagccatctgttcggcgaaccctgctatgtattcacgcaaacgccgcaggtctggctggatcatcaggtcatggagagcgacggcgagttgatgtttagctggtactgcatggacaacgtgctggaacccggcgctgccgaggcgatgtttaatgactattgcgccatcctgcaagccgtcatcgccgcccctgaaagcctgaagactctcgccagcggcatcgccgggcacattccccgccgacgctggccgctgaacgcgcaggcggactacgacctgcgggatattgagcaggcgacgctcgaataccccggcatccggcaggccagagcggaaataaccgaacagggcgcgttgacgctggatatcgtgatggccgacgatccgtcgccatcagcggcgatgcctgatgagcacgaacttacccaactggcgctgccgttgcctgagcaggcgcagcttgatgagctggaggcgacctggcgctggctggaggcgcgtgcgctacaggggatcgcggctacgctaaatcgtcacggcctgtttaccacgccggagatcgcccatcgctttagcgcagtagtacaggcgctgtccgcgcaagcgtctcaccagcgtctgctgcgccagtggctacagtgtctgacggaaagagagtggttaatccgcgaaggtgaaagctggcgctgccgcattccgctcagcgagattcctgagcctcaggaagcgtgcccgcaaagccaatggagccaggcgctggcgcagtatctggaaacctgcatcgcccggcacgacgccctcttctccgggcagtgttctccgctggaattgctgttcaacgagcagcatcgcgttaccgacgcgctgtatcgcgacaaccccgccagcgcctgtctgaatcgctataccgcgcagattgccgccttgtgcagcgcagaacggattctggaggttggcgccggaaccgcagccactaccgcgccggtgctgaaggccacgcggaacacgcggcagtcgtaccacttcacggacgtctccgcgcagttcctcaatgacgccagagcccgtttccatgatgaatcgcaggtgtcttatgccttgttcgacatcaaccagccgctggatttcaccgcccacccggaggcgggttacgacctgatcgttgccgtcaatgtgctccacgacgccagccatgtcgtccagacgttgcgcagattaaaactgttgctgaaagccggcggacgtttgctgatcgttgaagcgacggagcgaaacagcgtattccagctggcgagcgtgggctttattgagggattaagcggataccgcgatttccgccgccgggatgagaaaccgatgctcacccgctccgcatggcaggaggttctcgttcaggccgggtttgcaaacgagctggcgtggcccgcgcaggaatcgtcgccgctgcgccagcatctgctggtagcgcgttcgcctggcgtaaatcgcccggataaaaaagccgtgagccgctatttacagcagcgctttggcaccggtctgcccattttacagatccggcaaagagaagcgttatttacgccgctgcatgccccgtctgatgcgccgactgagccagccaaacccacgccagttgccggggggaatccggcgctggaaaaacaggtggctgaactctggcaatcgctgctgtctcgccccgtggcaaggcatcacgactttttcgaactgggcggcgacagcctgatggcgacaaggatggtcgcgcagctaaaccggagagggattgccagggctaaccttcaggatctgttcaaccattcgacgctgagcgacttctgcgcccatctacaggcggctacgtcaggagaggacaacccgatacccctttgccagggcgacggtgaggaaaccctgtttgtcttccacgcttcagacggcgatatcagcgcctggctgccgctcgctaacgcgttgaacaggcgcgttttcggcctgcaagcaaaatcgccgcagcgctttgccacgctcgaccagatgatcgatgagtatgtcgggtgcatccgtcgtcagcagcctcacggcccttatgtgctggcgggttggtcgtatggcgcgtttcttgcggcgggcgccgcacagcgcctgtacgccaaaggcaagcaggttcggatggtgttaatcgatcccgtgtgccgacaggatttctgttgcgaaaaccgggcggccctgctgcgcctgttagccgaaggacaaacgcctctggcactgcccgaacatttcgaccagcagacgcccgacagccagcttgccgactttatcagcctcgctaaaacggtcggtatggtgtcgcaaaacctgacgctgcaagcggcagaaacgtggctcgacaacatcgcgcatctgctgcgtttactgactgagcatacgccgggcgaaagcgttccggtcccctgtctcatggtgtatgccgccgggagacccgcgcgctggacgccagcagaaaccgagtggcagggctggataaacaacgccgacgacgctgtgattgaagccagccactggcaaatcatgatggaagccccccacgttcaggcttgtgcgcaacacattacgcgctggctttgcgcaacctcaacgcaaccggagaacacgttatgatgccgtccgcctccccaaagcaacgcgtactgattgtgggcgccaaatttggcgaaatgtacctgaatgcctttatgcagcccccggaggggctggaactggtcggcctgctggcgcagggaagcgcccgttcaagagagctggctcatgcgtttggcattccgctgtatacctcgccggaacagataaccaggatgccggatatcgcctgtattgtcgtgcgttcgaccgtcgccggaggaaccggtacgcagcttgccagacactttctgacgcgcggcgtacacgtcattcaggagcatcccctccacccggatgacatcagttccttacaaacgctggcgcaggaacagggctgctgctattgggtaaacacgttttatccgcatacgcgcgcgggacgcacatggcttcgcgatgcgcagcagctgcgtcgctgcctggctaagacgccgccggtagtccacgccaccaccagccgacagttgctctactccactctggatttgttgttgctggctctgggcgttgatgccgccgccgtggagtgcgacgtggttggcagctttagcgattttcactgtctgagactcttctggccggagggagaagcctgcctgctgcttcagcgctatctcgatcctgacgatccagatatgcatagccttatcatgcaccgcctgctgctgggctggccggaaggtcatctttcgctggaggcgagctacggccccgtcatctggtcatccagcctgtttgtcgcagaccatcaggagaacgcccacagcctctaccgcagaccggagatcctgcgcgatctgccgggtctgatgcgcagcgcggcgcccctgagctggcgcgactgctgcgaaaccgtcgggccggagggcgtcagctggttgctacaccagttgcgcagcaatctggcgggcgaacatccaccagcggcctgccaaagcgtacatcagatcgcgttatcacgtttatggcagcagattttacgtaagaccggcaatgcggagatcagacgcctgacgccgccgcaccacgaccggttagccggtttctacaacgatgatgataaggaggcgctgtgacgcaatctgcaatgtgcatcccgctgtggcccgcccggaacggcaatactgcgcatctggtcatgtgccctttcgctggcggcagcagtagcgcgtttcgccactggcaagctgagcaactggctgattgcgcgctttctctggtgacctggccggggcgcgatcgccttcgccatctggaaccgctcagaagcattacacaactggcggcactgctggcgaacgagctggaagcatccgtatcgcctgacacgccgcttttactcgccgggcacagcatgggggcgcaggtggcgtttgaaacctgccgacttctggagcaacgggggcttgcgccacaaggactgattatttccgggtgccatgccccgcatctgcattctgaacgccagctcagccatcgcgatgatgccgactttatcgctgagctgatagacattggcggatgttctcctgaactgcgggaaaaccaggaattaatgtcgctgtttcttcctcttctgcgcgctgatttttacgccaccgagagctatcactacgactcgcccgacgtctgtccgccgctgcgcacgcctgcgctgttattgtgcggcagccacgatcgcgaagcctcctggcagcaggtcgatgcctggcgtcagtggctgagccacgttacaggcccggtggtgattgacggcgatcacttctatcccattcaacaagcccggtccttttttacgcagattgtccgccattttccccacgcattttctgcaatgaccgcgtggcaaaaacagcccagtacttcagaaaggtgacgcatgaattcttcctttgaatctctgattgaacagtatcccttacccattgccgaacagttgcgccactgggcggcccgttatgcctcgcgaattgccgtcgttgatgcaaaggggtcgttaacctacagcgagcttgatgcacaagttgacgaacttgccgcaggtctgtcatcactgggtttgcgttcgggggagcatgtaattgtgcagcttcccaacgacaacgcgtttgttaccctgctgttcgccttgttaagactgggcgttatccccgtgctggcgatgccctcgcaacgggcgctggatatcgacgcgctgattgagctggcgcaacccgtcgcttacgttattcacggggaaaaccacgcagagctggcccgacagatggcgcacaaacacgcctgcttgcgtcatgttctggtcgctggagagaccatgagcgacgattttacgccgctcttctcccttcacggtgagcgacaggcatggccgcagcctgatgtttccaccaccgcgttgttgttgctctcaggcggcacaaccggcacgcccaaactcatcccgcgccgacatgccgactatagctataacttcagcgcttctgctgaactgtgcggcatcagccaacagagcgtgtatctcgccgtcctcccggtggcgcataactttccgctggcctgccccggtattctgggaacgcttgcctgcggcggaaaagtggtgctgaccgacagcgccagctgtgatgaggtgatgcctttaatcgcgcaggaaagagtgactcacgtcgccctggttccggcgctggcgcaattatgggtgcaggccagggagtgggaagacagcgacctttcgtcgctgcgcgtcattcaggcaggcggcgcccggctcgacccgacgcttgctgagcaggttatcgccacctttgactgtaccctgcaacaggttttcggtatggcggaaggcctgctctgttttacccggctggacgatccgcatgccaccattctccacagccaggggcgcccgttgtcccctctggatgaaatccgcatcgttgatcaagacgagaacgacgtcgcgccgggcgaaaccgggcaattgttaacgcgcggcccttataccatttcgggctattaccgcgcccctgcccacaacacgcaggcctttaccgcgcaagggttttaccgcacaggcgacaatgtcaggctggatgaggtggggaacctgcacgttgagggacgcataaaagagcagatcaaccgcgccggagaaaaaatagccgcggctgaagtggaatcggcactgctgcgtttagcggaagtgcaagattgcgcggtggtcgccgcgccggacacgctgcttggcgagcggatttgcgcgtttatcatcgcgcagcaggtgccaactgactatcagcagttgcgtcaacaactgacccgtatggggctcagcgcgtggaaaattcctgaccaaatcgagtttctggaccactggccgctcaccgccgtcggcaagatagacaaaaaacgcctgacggctctcgccgtcgaccgttatcgccattctgcccaataagcgcaaaccgacccgaaacaggttgaaataaacccgtttcgggtagcaccaccattagaaatagttatcattttcaattcaccattgtcggtattttttggcgtttcgccgtcttacagggactcacaacaatgaaaatgacacggctttatcctctggccttggggggattattgctccccgccattgctaatgcccagacttcacagcaagacgaaagcacgctggtggttaccgccagtaaacaatcttcccgctcggcatcagccaacaacgtctcgtctactgttgtcagcgcgccggaattaagcgacgccggcgtcaccgccagcgacaaactccccagagtcttgcccgggctcaatattgaaaatagcggcaacatgcttttttcgacgatctcgctacgcggcgtctcttcagcgcaggacttctataaccccgccgtcaccctgtatgtcgatggcgtccctcagctttccaccaacaccatccaggcgcttaccgatgtgcaaagcgtggagttgctgcgaggcccacagggaacgttatatggcaaaagcgctcagggcgggatcatcaacatcgtcacccagcagccggacagcacgccgcgcggctatattgaaggcggcgtcagtagccgcgacagttatcgaagtaagttcaacctgagcggccccattcaggatggcctgctgtacggcagcgtcaccctgttacgccaggttgatgacggcgacatgattaaccccgcgacgggaagcgatgacttaggcggcacccgcgccagcatagggaatgtgaaactgcgtctggcgccggacgatcagccctgggaaatgggctttgccgcctcacgcgaatgtacccgcgccacccaggacgcctatgtgggatggaatgatattaagggccgtaagctgtcgatcagcgatggttcaccagacccgtacatgcggcgctgcactgacagccagaccctgagtgggaaatacaccaccgatgactgggttttcaacctgatcagcgcctggcagcagcagcattattcgcgcaccttcccttccggttcgttaatcgtcaatatgcctcagcgctggaatcaggatgtgcaggagctgcgcgctgcaaccctgggcgatgcgcgtaccgttgatatggtgtttgggctgtaccggcagaacacccgcgagaagttaaattcagcctacgacatgccgacaatgccttatttaagcagtaccggctataccaccgctgaaacgctggccgcatacagtgacctgacctggcatttaaccgatcgttttgatatcggcggcggcgtgcgcttctcgcatgataaatccagtacacaatatcacggcagcatgctcggcaacccgtttggcgaccagggtaagagcaatgacgatcaggtgctcgggcagctatccgcaggctatatgctgaccgatgactggagagtgtatacccgtgtagcccagggatataaaccttccgggtacaacatcgtgcctactgcgggtcttgatgccaaaccgttcgtcgccgagaaatccatcaactatgaacttggcacccgctacgaaaccgctgacgtcacgctgcaagccgcgacgttttatacccacaccaaagacatgcagctttactctggcccggtcgggatgcagacattaagcaatgcgggtaaagccgacgccaccggcgttgagcttgaagcgaagtggcggtttgcgccaggctggtcatgggatatcaatggcaacgtgatccgttccgaattcaccaatgacagtgagttgtatcacggtaaccgggtgccgttcgtaccacgttatggcgcgggaagcagcgtgaacggcgtgattgatacgcgctatggcgcactgatgccccgactggcggttaatctggtcgggccgcattatttcgatggcgacaaccagttgcggcaaggcacctatgccaccctggacagcagcctgggctggcaggcgactgaacggatgaacatttccgtctatgtcgataacctgttcgaccgtcgttaccgtacctatggctacatgaacggcagcagcgccgtcgcgcaggtcaatatgggtcgcaccgtcggtatcaatacgcgaattgatttcttctgattattgtaaaagggataccgaaaaggtatcccttttacaccactagttaaaaccagtaactcagcagagtcgcaaaaaatattaatccatagtgattatttaaacaatgaaattgcgattaggataaatagatttaactttctcgttcctttctctccttatactaaagaaataatcatatcaaaataaaaattcacaacagtgcaacattaaaaaatacaaccaacaaacaatcctatatacaaggcacatctccagaatataaaagcacagacaaacaacctaaaaaaacaaccccatacatataaattattttataggtaaaatagattatatattctcatagctaccacaaactatactagcctgaactatatttattctgctgcaatcaatgcatacataacacaaatatcactcaggtacactactcaaaccacgctgggatttttcctcaagttataatcatcaccccgaaaatcattcggcatttactcattaaatagtcaccccataggcctgtacatgtttactcagaaatatacatccttttctctgtcataaaccctctgattaatcataaataaatacttgtgacaccaatctttttccttaacggaacgaattgttgtgtagaaggagataatattatgtcaaaaaaatatcagccattgcttataactcattatatgtcaacatgggtcactataacggaagcagttgagatcactaccaaagccataaaacaaaaaattactcctagcgatatttatcgtcatgccttgagtggcaacatcctactatcggtctatttccagtctccagtgatacttaagaagatacaaacttttaatggaaaaataaaattcaggcagtttgtgggagacctacttgataaactatgcatgcttgacagggacggttttatttatggtcaaaatttaagactctgtacagaagccagatatatttgtcctgtgcaacaaattatagatacccccctgttacgcaaactcaaccagtttcgtacgtttgttcgtaatgtccgcccgggtgatgaactggatgtcccggcacaagttagtgaaaaaaatttaaccccgccgccgggtaacagcagtggcaaccttgagcaacagatagccagcacttcacagctaattggatctctgctcgccgaagatatgaacagcgagcaagcggcaaacatagcacgtggatgggcctcttctcaggcttcaggggtaatgacagactggttaagccgcttcggtaccgcaagaatcacgctgggcgtggatgaagatttcagcctgaagaactcccgtgacggcaaccctcgaaaatggcgattcgatgcaacaaacagtgaactatgtgccgaacgtcacgaatgctgaaatcacgctggcagcctcgaaggatccggtgattgccgacaataacgatctcacgacactaacagcaccgtcgctgatacagagggcaatgcgatagccaacactgaggtaacatttactctaccggaagatgtgaaggcgaacttcacgctgagcgatggcgacaaagcggttactgatgccgatggcaaagcgaaagtcacgctgaaaggtacaaaagcaggcgctcataccgtgacagcatcgatggttggcggtaagagtgagcagttggtggtgaactttactgcggatacgctcactgcgcaggttaatcttaacgttaccgaggacaatttcatcgccaataacattggaatgaccaggctacaggcaacagtgactgatggaaacggcaacccagtagaaggtataaaagttaatttccgcggaacctccgtcacgctaagcagcaccagcgttgaaacggatgatcaggttttcgctgaaattcttgtgacaagcaccgaggtcggactaaaaacagtttcagcctctctggcagataaacctactgaagtcatctcgcgattactgaatgccaaggtagatgttaattctgcgacgattaccagtcaggagatacctgaaggtcaggtcatggtcgcacaagacatagcagttaaagctcacgttaacgaccagtttggcaacccggtgacgcatcaacccgcgacattcagtgcagcgccatcctcgcaaatgatcatcagccagaatacggtctctactaatacgcagggagtagccgaggtcaccatgacgcctgaaagaaacggctcgtatactgtaaaagcatccctagcgaatggagcttcacttgagaaacaactggaggctattgatgaaaaactgacactcacgtccagtccgcttatcggtgtcaatgctcctaaaggcgctactctgacggcaacgctaacctctgcaaatggcactccagtggagggtcaggtcatcaactttagcgtaacgctagaaggtgcgacgttaagtggcggaaaagtgagaaccaactcttcaggtcaggctccagtcgttctgaccagcaataaagtcggtacatatacggtgactgcatcgttccataacggcgtcacaatacagacacagacaaccgtgaaggttactggcaacccaagcaccgcacatgttgctagctttatcgctgatccgtcgactatcgccgccaccaacagtgatttaagtaccttaaaggcaacggttgaggatggcagtggtaacctgatcgaaggtctcactgtgtacttcgccttaaaaagcggctccaccacattaacgtcattaacagcggtgaccgatcaaaacggaatcgcgacaacaagcgtgaaaggtgagataacggggagcgtcactgtaagcgcagtcacaagcgcaggtggaatgcaaacagtagatatatcgctagtggcaggcccagcagacgcctcgcagtccatccttaagaacaaccagtcatcactgaaaggggactttaccgatagtgctgagctacatcttgttctgcacgatatatcaggcaatccgatcaaagtttcttaagggatagaatttgtgcaatcaggtacaaacgtgccctatatgaaaattagcgcaattgattacagtcaaaatatcaacggtgattacaaagctactgttacaggaggcggagagggtatcgcaacgctgatccccgtattgaatggtgttcatcaggcgggtctgagtaccacgatagaattcattagcgcggaaaccagaccaatgacgggtacagtgtcagtgaatagtgcaaacctaccgacagcttcattcccttcgcagggatttaccggggcgtattatcagttgaataatgacaactttgcaccaggaaaaacggcggctgattattcgttttcaagctcggcctcctgggtaggcgttgatgctactggtaaagtgacattcaaaaatgacggtgatagcaatactgtaataatcacagcgcccccaagatccggtggtgctatttaccaaacagttcctcctgaatcgcgttcggtgtgactatgatcattttcggtgagtattgctttgatccaaaggctggttttctgtgatgattgaccagcctcagagtattgatgacaccaccgttcataacagatcggcattactatgcataagtactgcctcaaattctcgccaaaacactttttaatgcctttgcgaattcatccagacttatattgtcaattttttgcccaacgacgactgactccgaaacatcggccattgcgggccatcgcgttttgtaatcagcataaattgcaacaacaggggtattataggcacttgccatatgtaatattgaggtgtcaggagttattgcaatataagcatcttttatgattgctgctgaacgtttaatcgagggtgataaggataaacggtagacattattataacaatccactaatgccctggctttatcttcccctttgggtccataaacgatcactattggaatatctgtttcactttgaatttttgctattagattttctgcaatcgataatgaaaatgtacgttcctgcgagctaccgtctaaattgagcgcaatgtaagatcctaacgatcgcatttcctcgcgtacctcatcgagtacatcatcgcttaatggcaattcatatattgacctgactgccggaaaacccgcctcacgcatcataaatgcccatgtcatgggtacaggagtccggagattctgatccatccgggacgcgttcttacacaaaggggaatagcacttcatggttaaaccgacgacctggaaattcgtttttgctttcaactgactgataaatatcatcgttttcaggttctttttacgcatcgcctctatacaaagatccggcgtaccgtattgcagtgttatgttcttcgctaaatcttttatttcttttaatgttgcgtgatcctgcatagtcattgtgactaatgttaatttagtctgttcaagtttgagcgcattaaagacttctaaattaattgtcgacgtaacaattaatagatgcttaattttatgcaattcaagcgcccgaataacaggaaagatggccatagcatcgccaatctgatcgggaatatgtatgacaacaaagtctgttttttcaatattaaaattataagctttataatcgtagtaactaaatgcaatacgtctcaacaatgatactaaaaacataactaacctcgcctccctactggttataatgcaatgcagtctatcagaatcatcagggtgcaattttgtgcatatgcggacttttatgtttcatatctcgaacctgtgggccctctgcttaatccttaaacaacaccagcaactcctgcgctttcatcttccatcgaatttttcatgttgccgctaatcagccataaaatcatttgcagatgcgctctgtcgaggtagtctcataaggttcgtttatagatcgacggcaatgtgagttaccttttccatactaattataaaaagacagtacaaacaggatcattatggactccacgctcatctccactcgtcccgatgaagggacgctttcgttaagtcgcgcccgacgagctgcgttaggcagtttcgctggtgccgtcgtcgactggtatgattttttactctatggcattaccgccgcactggtgtttaatcgcgagtttttcccgcaagtaagcccggcgatgggaacgctcgccgcatttgccacctttggtgtcggcttccttttccgaccgctcggcggtgtcattttcggtcactttggtgaccggctgggacgtaagcgcatgttaatgctgaccgtctggatgatgggcatcgcgacagccttgattggtattcttccttcattctcgaccattgggtggtgggcacctattttgctggtgacactgcgtgccattcagggatttgccgtcggcggcgaatggggaggcgcagcgttgctttccgttgaaagtgcgccgaaaaataaaaaagccttttacagtagcggtgtacaagttggctacggagtaggtttactgctttcaaccggactggtttcattgatcagtatgatgacgactgacgaacagtttttaagctggggctggcgcattcctttcctgtttagcatcgtactggtactgggagcattgtgggtgcgcaatggcatggaggagtccgcggaatttgaacaacagcaacataatcaagcggccgcgaaaaaacgcatcccggttatcgaagctctgttacgacatcccggtgctttcctgaagattattgcactacgactgtgcgagttgctgacgatgtacattgttactgcctttgcacttaattattcaacccagaatatggggttaccgcgcgaacttttccttaatattggtttgctggtcggtggattaagctgcctgacaattccctgttttgcctggcttgccgatcgttttggtcggcgcagggtttatatcacaggcgcgttgatcggaacgttgagcgcatttcctttctttatggcgcttgaagcacaatctattttctggatagttttcttctccataatgctggcaaacattgcgcatgacatggtggtgtgtgtgcaacaaccgatgtttaccgaaatgtttggtgccagttatcgctacagtggtgctggagtcggttatcaggttgccagtgtggttggcggtggatttacgccttttattgccgctgcactcatcacttactttgccgggaactggcatagcgtcgctatttatttgctggctggatgcctgatttccgcaatgaccgctttgttgatgaaagacaatcaacgcgcttaatagcctggcgaagatcatccgatcttcgccttacacttttgtttcacattcctgtgacatactatcggatgtgcggtaattgtatggaacaggagacacacatgaataataagggctccggtctgaccccagctcaggcactggataaactcgacgcgctgtatgagcaatctgtagttgctttacgcaacgccattggcaaatatattacaagtggcgaattacctgatgaaaacgcccgcaaacaaggtctttttgtctatccatcactgaccgtaacctgggacggtagcacaactaatccccccaaaacgcgcgcatttggtcgttttactcacgcaggcagttacaccaccacgattactcgccctactctctttcgttcgtatctcaatgaacaacttacgttgctgtatcaggattatggtgcgcatatctctgtgcaaccctcgcagcatgaaatcccttatccttatgtcatcgatggctctgaattaacacttgatcgctcaatgagcgctggtttaactcgctacttcccgacaacagaactggcgcaaatcggcgatgaaactgcagacggcatttatcatccaacggaattctccccgttatcgcattttgatgctcgccgggttgatttttccctcgcacggttgcgccattataccggtacgccagtagaacattttcaaccgttcgtcttgtttaccaactacacacgttatgtggatgaattcgttcgttggggatgcagccagatcctcgatcctgatagtccctacattgccctttcttgtgctggcgggaactggatcactgccgaaaccgaagcgccagaagaagccatttccgaccttgcatggaaaaaacaccagatgccagcatggcatttaattaccgctgatggtcggggtattactctggtgaatattggcgtgggaccgtccaatgctaaaaccatctgcgatcatctggcagtgctacgcccggatgtctggttgatgattggtcactgtggcggattacgtgaaagccaggccattggagattatgtccttgcacacgcttatttacgcgatgaccacgttcttgatgcggttctgccgcccgatattcctattccgagcattgctgaagtgcaacgtgcgctttatgacgctaccaagttagtcagcggcaggcctggtgaggaagtcaaacagcggctgcgtacaggtactgtggtaaccacagatgacaggaactgggagttacgttactcagcttctgcacttcgttttaacttaagccgggccgtagcaattgatatggaaagtgcaaccattgccgcgcaaggatatcgtttccgcgtgccatacgggacactactgtgtgtttcagataaaccgttacatggtgagattaagcttcccggccaggctaaccgtttttatgaaggcgctatttccgaacacctgcaaattggcattcgggcgatcgatttgctgcgcgcagaaggcgaccgactgcattcacgtaaattacgaacctttaatgagccgccgttccgataataagttatgaaccttcttatcagaaatagatgtgaaggattaagtaagacatctggcaaatagcctgcaataaacgcgggctgtttgcttccttgggcagatgcgagttttattatcgtcttaatgatttccacatattaaaagcaagtatgctttcaaaacacaattataaaaaatcccgccaacaacattagtttttataaaattaaatataagattatggctttagaatatttttatttctaatagacgagatttttcctgttatgatataatatgctgaattaacacatgttaacgatttaccagtaatgtaaataaattttcgaggagatcattccagtgggacgtaaatgggccaatattgttgctaaaaaaacggctaaagacggtgcaacgtctaaaatttatgcaaaattcggtgtagaaatctatgctgctgccaaacaaggtgaacccgatccagaattaaacacatctttaaaattcgttattgaacgtgcaaagcaggcacaagttccaaagcacgttattgataaagcaattgataaagccaaaggcggtggagatgaaacgttcgtacagggacgttatgaaggctttggtcctaatggctcaatgattattgctgagacattgacttcaaatgttaaccgtacgattgctaacgttcgcacaattttcaataaaaaaggcggcaatatcggagcggcaggttctgtcagctatatgtttgacaatacgggtgtgattgtatttaaaggaacagaccctgaccatatttttgaaattttgcttgaagctgaagttgatgttcgtgatgtaactgaagaagaaggtaatattgttatttatactgaacctactgaccttcataaaggaatcgcggcgctaaaagcagctggaatcactgagttctcaacaacagaattagaaatgattgctcaatctgaagttgagctttccccagaagatttagaaatcttgaaggg

SEQ ID NO: 10025 - DNA, 46746 bp, Escherichia coli
tttttgaagggacttttataagggtgaaggaagtatacacgtaggctttctccaggggcgaacaaagttttacatcaacccgcattggtcctacactgcgcggtaataaagcgaggtaaaacaagtcatgcgtgtactgggtattgaaacttcctgcgatgaaaccggcatcgccatttacgacgatgaaaaaggtttgttagccaaccaattgtatagtcaggtgaaattgcacgctgactacggcggcgtcgtgcctgaactggcctcccgcgatcacgtgcgtaaaaccgtaccgttgatccaggaggcgctaaaggagtctggtttaacggcaaaagacattgatgctgtggcctataccgcaggcccaggattagtcggcgcactgctggttggcgcgaccgtggggcgttctctggcgtttgcctgggacgttccggcaatcccggtacatcatatggaaggacatctgttagcgccgatgctggaagataacccaccggaatttccgtttgtcgcgctgctggtttccggcggtcatacgcagttaatcagcgtgactggcattggtcagtacgagctgctcggagagtctatcgatgatgcggctggtgaagcgtttgataaaaccgcgaagctgctggggctggattatcctggcgggccattactgtcgaaaatggcggctcagggtactgccgggcgctttgtcttcccgcgcccgatgaccgaccgtccggggctggatttcagcttttctggtctgaaaaccttcgcggcaaataccatacgtgacaacggcactgacgatcagacgcgtgccgatatcgcccgcgcctttgaagatgcagtggtcgatacgttgatgattaagtgtaagcgagcactggatcagacgggctttaagcgactggtcatggcaggcggcgtgagtgctaaccgcacactgcgggcgaagctggctgaaatgatgaaaaagcgtcgtggcgaagtgttctacgcgcgtccggaattttgcactgataacggtgcgatgatcgcctatgccggaatggtgcggtttaaagcaggcgcgacggcggatctcggcgttagcgtgcgtccgcgctggccgctggcagagttaccggccgcgtaaaactattaggtgccggagagcaatttccggcaccgtcctcacttaaagcaacaccatgggcatccacagtaagccggtaatcaccagcaacacgaggaatatcagcccaaaaattgcccccagtcgccagtaatccaccgttggcagataaccactaccgtagtaaatcggactgggtccggtggcgtatggtgtaagaatgctccccagaccaattgccgcaccaaccatcaggcagaacaccggcagcgggatttccggcatcgccagcgcggcggcaatcatcatcggtgcgagagcggaggtatacgctgtggcgctggcaaaaaagtagcgcagcagataaaagaccacaatcaacgccaccatcactatcgttggcgaataaccgcttaagctgcctgctaacagtttgccaaaccagctaataaaaccggtgttgttgagtccggtagcgagggtgataagcgaggccagccagaagaaaacgttccacgccgctttattactgacaatgtcgtcccagcagataatgcgcagaagcagcatcagcgccaccacgctgtaaccgaccatcgcggcatcgatataatcaccgccaaaaatccacagcaccagtgcgcctaccatcagccccagcatccgtttttcacgcgaacagagcgggcccattgcctgcagttccgtctctgcccagcgcggcacctgatcgccagacttcagtatcggcgggtacagcacgtaagccagccagggaaccagcagaaccagtaaaatactgagcggcaacatcccgaggaaccagtcgccccagctcagcgtggcgttagatgcgcttttcatcagtccaattaacagcaaatttggagccatcgccgtcaggaaaatggcgctggtcacgcaatcggcaacaatccccatccacatgatgtacgagccaatgctgcgcgaactgctgtcgtttggttgtgattgatagagcggtggcaggttacggatgatgggatagataatccccgcaccacgcgccgagttggacggtgttacaggcgcgagtatcagctcggagaacatcactgcatagccgagaaacagcgtgcgatgccccatttttttcaccagaatcagagcgatgcgacgtccaagcccggttttttcatagcccgtaccaaacataaaggcggcgaaaataagccagataactgaattagaaaaaccagaaaccgcccaggagagggatttggcggtgaacttaaaacctggctgggcgagctgctccgggctaaacagcagccacggcgaaagaatggcgatgatggatatacccaccatcgccaccacggcacccggcacgggttcgaggatcagtccaacgatcacgccagtaaaaacggcaaagtagagccaggtatgactctccagccctgcgggaagcggaagtagagcaataatggcgatgaccgccagcggcgcaaggtatcgccaccattcagtggaaggtttcatcgtgttatgcctgagaaaaaggagaggggcgagcctctccgggagggttatttgatgtagtggacgtgctcgcagatctcttccacgatgggatcgcggcgttcggcgaacagctttttgttttcggctatcaggttgttgccgtgggtatctatagagacaatcagcgggccaaactctttgacccggcagacccacagcgactctggcatcccgagttctgtccagtgtacctcttcaatctcttccacttgagttgccgccagtaccgcacagccagccgggaaaatcacatgcagcgccttgaatttctggcagccttcttcggtcagcggccccattccgcctttgccgaccaccagtttcacgccggtctgctcgataaattcacgttcaaaactttccatacgcatactggttgtcgggccgacggacaccatctcccatttgtcgccgtttttgcgcacgatggggccagcgtggaaaatcgctttgccgttgagatcgtaagggatcggacgtttcagttcgatcaatcggcggtgacaaacgtcacggcaggtcaccagcgtaccggtcaggtagatcacatcgccgacgcgaatatcttgcagatcttcagctttgatcggggttgtcaggatctttttcataacgcgctccgggtatgagacagattttcaaaggtgagatcggcatgaactcgcagtgtgccgcgacgatgcgcccagcagccggtagaaacagcaacgccgatggttgacggatggcgagcggcagattcgatatgcacgcccatcactgaactgttgccagtcagcccttgtggaccaatccccagacggttgagtccttcttccaggcgtagctccagctctgccgcttttggattgggatggcggctgccaatcgggcgcaaaatggctttacgcgagagcactgcggcggtttccaccgaggtagcgatgccaacgcccacaagtaccggcggacaggcgtttacggcgagggtggagatattttcgaagacgaatttcactacgccttcgtagccttctgacggcattaacactttcgatcggccaggtagcgtgcagccgccgcctgccatgtaaacttcgatttccgcatcgtcaccgtcggggacgatatcccaggtgacccacggtacgccactgccggtatttttgccggtgtttacttcgtcaaaaatttctaccgcattgtgacgcagtggcgctttgacggttgcctcttccacggcttgtttgagtatgctttgcagctcgccaagcagtgggaaacgggaaccgaccttaacaaaaaacatgatttcgccggtgtcctgacaggcaggacgattcaggtcgatcgctttttgcatgttatcgaacatcgtgtggtagatgatttttcccatcgacgatgtttcggcatcctttagctgttttagtttatccaccacgtcatcaggcattcgggtagaaatcatggcggtaaagttagcgacaatctccgtcaacttattcactgcctgttgcttattactttcgctcatcatggcaactccagtttatgtatttgtctggaaaaattcaccgccacaaactaccactaaaaatgtggttttatattttttgccaccgtgaatatgtaattaacagttcgtgaatcaacgcgaaaataagaacgaatattgcgccagagcagggaatggtaatgttttgcgaaatacactgcgtttatcaaaactgcggatatttaacaatgctaaatagctggcctttagccaaagacttgcaggtactggtggaaatcgtccatagcgggagttttagtgctgcagcggcgacgcttgggcaaacgcctgcatttgtcaccaagcggatccaaatccttgaaaatacgctggcaacaactctgctgaaccgctccgctcgcggcgtggcgctgactgaaagtggccagcgttgttacgaacatgcgctggaaatcctcacccaatatcagcgactggtcgatgacgtcacgcaaatcaaaacgcgcccggaggggatgatccgcattggttgcagttttggttttgggcgcagccatattgcgccagctattaccgaactgatgcgcaattatcctgagttacaggtgcattttgaattgttcgatcgacaaattgatttagtgcaggataatattgatctggatattcgtattaatgacgcaattcctgattattatattgcgcatcttttgacaaaaaataaaagaatattatgcgcagcacctgagtatctgcaaaaatatccgcagccacaatccttacaggaattaagtcgtcatgactgcctggtgaccaaagagcgcgatatgacccacggaatatgggagttggggaacggtcaggagaaaaaatcggtgaaggtaagcggacatctttcctccaatagcggcgagattgtgctgcaatgggcgctggagggcaaagggattatgctgcgttccgagtgggatgtgttgccgtttctggagagtggcaaactggtgcgagtattgccggagtatgcacaaagcgccaatatctgggctgtttaccgggagccgctctatcgcagcatgaaattacgtgtctgtgtggaatttctggcggcatggtgccagcaacggctgggcaagcccgacgaaggctatcaggtcatgtagatccaccagaaatcactcgggatccttttcgcgctttcttttgaatttcgtccagatttttgtctcctgacgacgccacagacgctggatgttgtcatgatgacgcagcaggatcaggcaagagagcatcgaaaccgggaaggtgaattgtggcttaaaccaccagacataaaacggagcaatcagtgcactgacaatcgctcccagcgacgagtaaccactcaatagcacggtcagtaaccaggttcccgccattactccagtgagatcccagccaatgggtgcgatggcaccaaaagcggtagcaacgccttttcctcctttaaaaccgaagaaaacgggccagatgtgtccaagacaggcggcgatggcaattaagcctagccagaaggggctgacacctaattcatacgcgccccagacgggcaacattcctttcagaacgtcgaaaatcagtactgctacggctgctcccttgccaccgatacgtaacacattggttgcgcctggattgccggagccgctggttcgcggatcgggcaacccacacaagcggcaaaccagaatggcactggaaatggagccgcagaggtacgcgatgaggatcattccaggcgcgattgcactcataagctgttccgttttgaaaattcgtgttcaacgatgaatctgtggataatacgcacatttcgccggaagtggtatccggttagccaaaaagcaggcaggacgtgatggatattgtatttatagagcaactttcggtaatcaccactattggtgtttacgactgggaacagaccatcgaacagaagttagtgttcgatatcgaaatggcgtgggataaccgtaaagcggcgaaaagtgatgatgtggcggattgcctcagttacgctgacattgcagaaacggtggtcagccacgtcgagggagcgcgttttgcgctggtggaacgcgtggctgaagaggtggcggagctgctgttagcacgcttcaactcgccgtgggtgcgtatcaaactcagcaagccaggcgcagtggcgcgggcggcgaatgttggcgtaatcattgagcgtggcaataatctgaaagaaaataattaattttacagctgttaaaccaaacgattataacctggtcatactgcagtagttcggacaagcgttacatttttataatttaggggtttattgatgagcgatatgcactcgctgctgatagcggcaatattgggtgtggtcgaaggattgacagaatttctgccggtatccagcacgggccatatgattattgtcggtcacttgttggggtttgagggcgacacggcgaaaacctttgaagtcgtgatccagttaggatcaattctggcggtagtagtgatgttctggcggcgtctgtttggcctgattggcatccactttggtcgcccgttgcagcacgaaggagaaagcaaaggtcgtttaacgctgatccacatcttgctggggatgattccggcggtggtactggggctgttgttccacgacacgattaaatcattgtttaacccgataaatgtcatgtatgcactggtcgttggcggtctgttgctgattgccgccgaatgcctgaagccgaaagagccgcgtgcgccgggtcttgatgatatgacctatcgtcaggcgtttatgattggctgtttccagtgtctggcgctgtggccgggtttctcccgttccggggcgaccatttcaggtgggatgctgatgggggtgagccgttacgctgcttccgagttctcgttcctgctggcggtgccgatgatgatgggcgcaacggcgctcgatctctacaaaagctggggcttcctgactaccggcgatatcccgatgtttgccgttgggtttatcaccgcttttgtggtggcgctgatagcgattaaaaccttcctgcaattgattaagcgcatttcgtttatcccgttcgccatttatcgctttattgtggcggctgcggtgtacgttgtgttcttttgatgtgaagaacagtgtcggatatgatgctgacgcgtcttatcagattgcgtaggccggataaggcgttcacgccgcatccggcaatcaacgcctgatgcgacgctcgcgcgtcttatcaggcctacaactgtcgttgacatgtagccggataagacgcttacgtcgcatccggcaaaatatccaacactcactcaggttttgggcaacgctgttccttccagccagccaccgccgcaatccgccgtcgggtcagctcctcgcgaatctccacacctttaaatcccgcttcaacgacggcttttgtcggcactgactgtgccacttcccaggcttcgcgcaaccagcggccttgcgggtagtcggctgattcaaaaccggttctgccgcgcacatcagcctcgctggtcagcgccagttgctcgacacgctgcggtttacgccaggcgtcgatggaatcaaatagtttgacgatggtttttgggttcagcattgggaaggtgtggatgagatcgtgaaactcagccaccagtctggctaaatcgcgaatttcatttggcacgcgcagacgctggcatagttgttccactaacttcacacccgccgggccatgaccatgatgacgcggccaaagttctggtggcgtcagtcctttaccgagatcgtggcataacgttgcgaaacggacatcgacctgcggactcagcatcgccgccattgagagcgtcattaaggtatgaataccggtgtcgatttccggatgccacctggcaggggccggaacgccaaacagggcgtcaatttccgggaataaaacgcgcagtgcgccgcaatcgcgcagtacctggaagaacacctggggattgcgggtggtgagggcgttttccgtctctttccatacccgttcaggcgtcaggtgttccagttcacccgcatgggtcatctcgcgcatcagcgccagagtttcatcggcaatacggaaacagaggtgggcataacgcgcagcaaaacgcgctacgcgcaacacgcgtaacggatcttcgccaaaagcgggggaaacatggcgcaacagacgattttgcagatcgcccagaccgttgtacgggtcgataatctcgccgttatcgtcctgggccagcgcattaatggtcagatcgcgacgcttaagatcatcttccagcgtgacatccggtgcggcatagcaggtaaaaccggtgtaaccggaaccggatttccgttcggtacgtgccagtgcatactcttcatgcgtttgcggatgcagaaacacaggaaaatcgcggcctacctgctggtagcccgcgtcgagcatctcctgtggcgtactgccgaccaccacccaatctctgtctttgaccggtagccctaacaatgcatcccgaacagcaccaccgaccagataaatcttcacgccatcatcccttcgtcaaatacacaattcctaataataagacagtgcaacgaagaaggcgatttagttcatccagcgatctttgcgtttgcggcttgggatcaggtgcggcagtaccagaccgagcagcaagccaagccccagcacgccaccgccatacataaaccactgcatgatgatggtgcgctgtttgtcatccagctgtacgctggcggcatcgacctttttctgcgcgacaatcagctcgtttttcagtttctgattttcttcttttaacccgttgatcacgctgtcgctctgcgccactttttgctgcatttctgcggtgcgctgattccaggtgttatcgatattggtgagtttatcggtcagggttttgacctgattttccagatctggcacacgggagcgcaggcttggctcagtgctaagttgtttcaacgggatccaggcggtacggccagagctgtctttcacctgggcataattggtgttggcgtcagtttgtaataaggtcacttcctcgccggcgttaaccgtgcccacgaggcgataatgatctcccggaccgctacggacccaggtattcagttcatcagaaacatagcgcgtttcttcagcgtgtgagacggcagtggcgctaagtgcgagtaaagttaatccgatcaggcgtaattttggcatcaggctgtcgttattgtcatggaaagtggaacgatagtagtggcatcagtgtcgctacgcaaagcattcgacatcaatcggaatcctctgtgtcaggtcttgccactgcttcaaacttttacgcccgtcaaattgcccgttgcatggcaatttggcgcaaaatactatctactgacaaaaaagatcgcattaagttcgccgttcatcgtcacttatgtgacataaccgataagtaaaggctatggctcaggaaatcgaattaaagtttattgttaatcacagtgccgttgaggcgctgcgtgaccatctcaatacgctggacggcgagcaccatgaccccgtgcagttgctgaatatttactacgaaacgccggataactggctgcgtgggcacgatatgggcttgcgtattcgtggcgaaaacggtcgctatgagatgaccatgaaagttgcaggaagagtgacaggcggcttacaccagcgcccggaatataacgtggcgttgagcgcaccgacgctcgacctggcgcagttaccgacggaagtctggccgaacggcgaattgcctgccgatctcgcttcccgcgtacaaccgctgttcagcaccgatttttatcgcgaaaagtggctggtagaggttgatggtagccaaattgaaatcgccctcgaccagggggaagtgaaagcgggtgaatttgctgaacctatctgtgagctggaactggaactgcttagcggcgacatgcgtgcggtgctgaaactggcgaaccaactggtatcgcaaaccggattacgccagggcagcctgagcaaagcagcgcgtggctatcatctggcgcagggcaatccggcgcgtgaaatcaaaccgaccaccattttgcatgttgcggcaaaagctgatgtggaacaggggctggaagcggcgctcgagctggcgttagcgcaatggcagtatcatgaagaactgtgggtacgcggcaacgatgcggcgaaagagcaggtgctggcagccattggcctggtccgtcatacactgatgctgttcggcggtatcgtgccgcgtaaagcgagcactcacttacgtgatctgctgactcaatgcgaggcgaccattgcttctgcggtttctgccgtaacggcggtctactctaccgaaacggcaatggcgaagctggcgttgaccgaatggctggtaagcaaagcctggcagccgtttttagatgccaaagcgcagggtaaaatgagcgattccttcaaacgctttgccgatatccatctttcccgccatgctgctgaacttaaaagcgttttctgccagccgttaggcgatcgctaccgtgaccaattgccacgcctgacgcgtgatattgactcaatactgttgctggcgggttactacgatcctgtcgtcgcgcaagactggctggagaactggcaggggctgcgtcacgctattgcgaccgggcaacgcattgaaattgaacatttccgtaatgaggcaaacaatcaggaaccgttctggttgcacagcggaaaacgttaatcaggcaaggataaaatcgcttatgaagccgctctcttcaccgttacagcagtactggcagaccgttgttgagcggctgccagagcctttagccgaggaatcacttagcgcacaggcgaagtcagtacttactttcagtgattttgtgcaggacagcgtgattgcgcatccagagtggctgacggaactggaaagccaaccgccgcaggccgacgaatggcagcattacgctgcatggttgcaggaggcgctcagtaatgtgagtgacgaagccgggttaatgcgcgagctgcggctattccggcggcgcattatggtgcgcatcgcctgggcgcaaacgctggctctggttactgaagagagcatattgcagcagctcagccatctggcggagacgctgattgttgcggcgcgtgactggctgtatgacgcctgctgccgcgaatggggaacgccgtgcaatgcgcagggcgaagcgcaaccgctgctgattttaggcatgggtaagctgggcggcggggaactgaatttctcctctgatatcgatctgatttttgcctggccggaacatggttgtacccagggtggacgccgggaactggataacgcgcagttttttacccgcatggggcagcggctgattaaagtgctggatcaaccaacgcaggatggcttcgtctatcgcgtggatatgcggctgcgtccgtttggtgaaagtggcccgctggtgctgagttttgcggcgctggaagattattaccaggagcaggggcgcgactgggagcgttacgcgatggtcaaggcgcggattatgggggatagcgacggcgtctatgctaacgagttgcgtgcgatgctgcgtccgtttgttttccgtcgttacatcgatttcagcgtgattcagtcgctgcgcaacatgaaaggaatgattgcccgtgaagtgcgtcgacgcggtttgaccgacaacatcaaacttggcgcaggcggcattcgcgaaattgaatttatcgtccaggtgttccagctcattcgcggcgggcgcgaaccgtcgctgcaatcgcgcgctttactgccaacgctcagcgccattgccgcgctgcatctgctttctgaaaacgatgctgaacaattgcgagtggcgtatctgttcctgcggcgtctggaaaacctgctgcaaagcattaacgacgaacaaacccagacgcttccttctgatgagcttacccgtgcgcggctggcgtgggcgatggactttgctgactggccgcaattgaccggggtgctgaccgcacatatggccaatgtgcgccgggtgtttaatgaattgattggcgacgacgaaagtgaaactcaggaagagtcgctgtcggaacagtggcgtgagctgtggcaggatgcgttgcaggaagatgacaccacgccagtgctggcgcatcttagcgaggatgagcgcaaacaggtgctaatgctgattgctgattttcgcaaagagctggataagcgcaccatcgggccgcgaggacgtcaggtgctcgaccatctgatgccacatctgctaagtgatgtctgtgcgcgtgaagacgctgctgtcacgctgtcgcgcattaccgccttgctggtggggattgttactcgcaccacttatcttgagctgcttagtgaattccctgcggcgcttaaacatttgatttctctgtgtgctgcatcgccgatgattgccagccagctagcgcgttatccattattgctggatgaattgctcgatccaaataccctctaccaaccaacggcgacggatgcctaccgtgatgaactgcgccagtatttgctgcgcgtgccggaagatgacgaagaacaacagcttgaggcgctgcgtcagttcaaacaggcgcagctgttacgcattgcggcagcggatatcgccggtacgctaccggtaatgaaagtgagcgatcacttaacctggctggcagaagccatgattgatgccgtcgttcagcaggcgtgggttcaaatggttgcccgctacggtaagccaaatcacctgaacgaacgcgaagggcgtggttttgcggtggtcggctacggcaagctgggtggctgggagttaggctacagttccgatcttgacctgatcttcctccatgattgcccaatggatgcgatgactgacggcgagcgggaaatcgacgggcgacagttttatctgcgtctggcgcaacgcatcatgcatctgttcagtacgcgaacctcttccggcattttgtatgaagtggatgcacgactgcgtccgtccggggcggcgggaatgctggtgacatccgcagaagcatttgctgattatcagaaaaacgaggcctggacgtgggagcatcaggcgctggtgcgtgcgcgtgtagtgtacggcgatccgcagctcaccgcgcactttgacgcagtacgccgggagattatgacgctgccgcgcgaaggcaaaaccctgcaaacagaagtgcgggaaatgcgcgagaaaatgcgtgcccatctcggcaataaacatcgcgatcgctttgatatcaaagccgatgaaggcggaattaccgatatcgaatttattactcaatatctggtgttgcgctacgctcatgaaaaaccgaagttaacgcgctggtcagacaacgtgcgcattctggaactactggcgcaaaacgacattatggaagagcaggaagcgatggcgctgacccgtgcttacacaacgctgcgcgatgaacttcatcatctggcattacaggaattgccgggccatgtgtcggaggattgcttcaccgcagagcgtgaactggtgcgggcaagctggcagaagtggctggtggaagaatgaagtatggtattatcgcgcgcaaattttgaatctctcaggagacaggaatgaaagtaacgctgccagagtttgaacgtgcaggagtgatggtggttggtgatgtgatgctggatcgttactggtatggtcccaccagccgtatctcgccggaagcgccggtgcccgtggttaaagtgaataccatcgaagaacgtccgggcggcgcggctaacgtggcgatgaatatcgcttctctcggtgctaatgcacgcctggtcgggttgacgggcattgacgatgcggcgcgcgcgctcagtaaatctctggccgacgtcaacgtcaaatgcgactttgtttctgtaccgacgcatccgaccatcaccaaattacgggtactttcccgcaaccaacagctgatccgtctggatttcgaagaaggtttcgaaggggttgatccgcagccgctgcacgagcggattaatcaggcactgagttcgattggcgcgctggtgctttctgactacgccaaaggtgcgctggcaagcgtacagcagatgatccaactggcgcgtaaagcgggtgttccggtgctgattgatccaaaaggtaccgattttgagcgctaccgcggcgctacgctgttaacgccgaatctctcggaatttgaagctgttgtcggtaaatgtaagaccgaagaagagattgttgagcgcggcatgaaactgattgccgattacgaactctcggctctgttagtgacccgttccgaacagggtatgtcgctgctgcaaccgggtaaagcgccgctgcatatgccaacccaggcgcaggaagtgtatgacgttaccggtgcgggcgacacggtgattggcgtcctggcggcaacgctggcagcgggtaattcgctggaagaagcctgcttctttgccaatgcggcggctggtgtggtggtcggcaaactggggacatccacggtttcgccgatcgagctggaaaacgcagtacgtggacgtgcagataccggctttggtgtgatgaccgaagaggaactgaagcttgctgtagcggcagcgcgtaaacgcggtgaaaaagtggtgatgaccaacggtgtctttgacatcctgcacgctgggcacgtctcttatctggcaaatgcccgtaaactgggtgaccgtttgattgtcgctgtgaacagcgatgcctccaccaaacggctgaaaggggattcccgccccgttaacccgctcgaacagcgtatgattgtgctgggcgcactggaagcggtcgactgggtggtgtcgtttgaagaggacacgccgcagcgcttgatcgccgggatcttgccagatctgctggtgaaaggcggcgactataaaccagaagagattgccgggagtaaagaagtctgggccaacggtggcgaagtgctggtgctcaactttgaagacggttgctcgacgaccaatatcatcaagaagatccaactggataaaaaaggctaactggaaagcggttcacagatctcgcttcgtagcaggcagatctattgacgctgttgttttttcaacctaaagtaaaggaacaagggtaagggaggatttctcccccctctgatgagttgttagtaagtcgggaaacttaacagtaacaacacaaccagtatgatgacgaacttcatcataaccctttccttctataaggccccttcctcgggaggggctttcccgtttcagccccttgctgactccccgattgttgatgagcgccggaccccgcgcaacgctttcccagaggcagttttaccttccccgagcagtcacgcaaaatgctgcaacagcctgatcatttgcaccttttagcggaacgcagatataaaaaatccccggctttttgggccagggattattcatagaagagggtttactctgctttttcttcgacgggagttgttgagcttaaggatgaagtcaatgccgccagtgagccgcctgaaacgccaatttcattgagcaaggagtcaatcagcggtgcctgtgtgcggtaagagagtgcggctgataacgcttgttctgccaggtttccgccccccacattccccgtgtttgcatcacccgtagcgccaccacgattcagcccatcgacctgaataattttgatgccgtcgatagccttcataggctcaacggatttctcaattaccgcaggcagcgcctgcaataatgccagtttgaatttaaggctggtttgttcatcagaaagtacgttgatagcatcgttcagcgcacgttgtgcttctgcttccgccagaccctttttacgtgtagcttcggctaactcaacgatagccgccgcctgcatctctgcggcttctttttctgctttcgcccgcacggtcagttcaaccgctttggtttctgcatcctgcgctgcggcgatcaacgccacttgtttagcacgatcggcttcggcagtctggcgagtggtttctacgttttgttgggcgcttactgcttctgcgagtgcaaggttagcacgcgcttctgcctgggactgttgttccgatttggcggcaatagcgatcgatttcgtctggttagcgatttcggtgacctgctgctgttcgatctctttaatgcgaacttcacgttcggcctcaacctttcttgagcggacggcctgttcgcggtcgatttccgtttcctgaatctgtcgttcagccagaattcgcgtctgctctgcttcacgacgacgttcagcttcaaaagccgcaattttcgcattctgctcagcggtacgggttttaacctgctgctcctgctcaagcgtcataaacgcttcttgttgttcaatctccaacttgcgcgaaagtgcatcacggtttttctcacgcactgcgacttccacatcctgttcaacttcgttacgttcgcgacgacggcgctccgtctcctgagtcagtttggttaaaccttcggcgtcaaaggcattgttcggattgaaatgttctttcgaggtctggttaaagttggtaagtgaaacgctttccagttccaggccatttttcgacagatcttcagctacggtattttgtactccctgcacgaagttctcgcgggtatcctgtaactcatgcatggtcatttgtgccgctgttgcacggagggcatcgacaaatttatcttccaccagcatacgtaagtcttcaggcgacagggtgcgttgccccagcgtctgggccgcagtggcgatgccttctactgacggttttacccgtacaaagaaagccactacaacatcaacacgcatacgatctttcgtaatcaggctatcaatggttgagcggctgacttccagcttcagggtattcatattgatgggaattatttcatgaaagatcggcatcacgattgcgccaccgctcatcaccactttttgcccacttaaaccagtacgaacaaatgcttgctctgccgaagcgcgacgatagagcctggcgaaaataattccaataataaacagaatgcatacggcgataatcgcggtaaacatccaggagggcacagaattaacgatatcatccattattaaatttccttttgattaataaatcacaatatctggggccagggattattttccgccaaatatcgcgttgcagaaagtcggcaaataattaacactttgtctcctttagtgaaagtttttccttcttcaggctccagtagcaaataatgtatttggccaaattgatcggtgagttttccttcgcaagggttacctgaagtggcttgatggccggtaattaatgccatgctaccaacatattcttcttctgtaatagctgaactatggtcgcgtggaatccagggtgcaacgactttaccggtataatgcactgcaataattgtaaacagtaaactgacaggaaccacgaacaggttggggagtggtgattgccagagcgtaacgcaggcatgttgcaacaggatgccaataagaccaaaaaaaccagcgagtaagcagaggacgacgagagctggtaatcttccaatattgagataatgaagtgcctggctaatatgacctgtggttatggaatcataatggtcaagatgtgcatcaagagcaccggagagcatgtgaccgcagataagtgcaaaaatttctaaaaggccgatcaagagtacaaaggaaatagcgaaaagataaggggtgttatagtcggcgaataaaatcatatgtcactccaatgtccatttagtgacgcaatatttactttggaatagtttccttgcttacatttgtctttgttaataataacacatgttagagaggttctggaagagaaagtcttttaatatggtttttttatttttcactaaaaagtgtgatcggggacaatatatttacgcacgttatgtttaaaggcactacactgattggggaatactgaaatcagaaaaagcatatggccttaaaaggtatgcaataaccggaggatgtgcttatggatcatagtcttaattctttaaataatttcgattttctcgcgcgtagttttgccagaatgcacgcagaaggtcgcccggtcgatattctggccgttactggtaacatggatgaagaacatagaacctggttttgcgcgcgttatgcctggtattgccaacagatgatgcaaaccagagaacttgaattagaacactgatattacgggccgtctggcccgtttttgtggtgctttattctgctttatcaactggcgggatagccggaggagattgaagttctgctatcggattattgcgcgcttccagttcgctgatgcgctgctccagtaacgccagtttttcacgagtccgtaacaggacttgcgtctgaacgtcgaattcttcgcggcttaccagatcgagacgcgtcagctgcgcttgtagggtttggcggatttttttctccacatcttccccgaactccctgattcctttaggcattgattcgtgaacctggcgagcgatttgctcaatttttttcgggtcaatcattgtagtttccctgtactgataggtgttgagtgccattgtagtgcgataagggtaagtcataaaccagaattatgtgaagctatgcgttgctggcgctaatcattagcgttatagtgaatccgcttattctcagggcggggcgaaattccccaccggcggtaaatcaactcagttgaaagcccgcgagcgctttgggtgcgaactcaaaggacagcagatccggtgtaattccggggccgacggttagagtccggatgggagagagtaacgattctgtcgggcatggacccgctcacgttattttggctatatgccgccactcctaagactgccctgattctggtaaccataattttagtgaggtttttttaccatgaatcagacgctactttcctcttttggtacgcctttcgaacgtgttgaaaatgcactggctgcgctgcgtgaaggacgcggtgtgatggtgcttgatgatgaagaccgtgaaaacgaaggcgatatgatcttcccggcagaaaccatgaccgttgagcagatggcgctgaccattcgccacgggagtggtattgtttgcctgtgcattactgacgatcgccgtaaacaactcgatctgccaatgatggtagaaaataacaccagcgcctatggcaccggttttaccgtgaccattgaagcggctgaaggtgtgactaccggtgtttctgccgctgaccgtattacgaccgttcgcgcagcgattgccgatggcgcaaaaccttcagatctgaatcgtccgggccacgttttcccacttcgcgcgcaggcaggtggtgtactgacgcgtggcggtcatactgaagcgactatcgatctgatgacgctggcaggctttaaaccagctggtgtgctgtgtgagctgactaatgacgatggcacgatggcgcgtgcaccagagtgcattgagtttgccaataaacacaatatggcgctcgtgactattgaagacctggtggcataccgtcaggcacatgagcgtaaagccagctaatgacgtgaaatactaaatatgaaaatgccggggtgttcccggcattttgctgttcagttatagtttatttttacgatgggatcttttttgaaaggcccataaacgagagtctcccccggtttttgtgaaagttcagcctggtaatcacgggtaaccatcgctccagtctgacctggaatatatgtggtgaagcgtttgtactgattaaacttaatgtcttcttgtgttttttgatcagtaatacgcatcaacaaaccattacccatttccagatgcgtatcatcatgtaacgtatctgtcgtataaaagctggtggcaacatcaaattgctcggtacaatcggcagcaacatcttttatagtagatacgctaaatgcagcttttggtcgataagtagcaatagagtttgcagcaatttgcccgaaattaactatctggctttctggaaaaatccggacgtcgacactacagtcaaggaatgaaatattatctaatcccgtaatcacatagcgtaaattcttcgcgttagaggacatgtttgcccctccttcgccatcgaattgtaacacgttgactatgccaaagttcaccgtctgatctcctgctgggcggcttttgaattttacatagacgcgaaaatgggcattaaatgttacatttttttgaagggtactgccattgcatacagggtcataataatacccattatagtattgctcatatttatccaggcatgcatgagtatcaattctttcatttatcccttcataatctacaccattataagtcacgccaaaggttaaatatggattattcaacatgtcggcactatttatttggggtaatttgatccaggcatagatattttctgatggattgtctgttgtccatcctggtgcattgtcacaataaaccgtgatattaatatctccactctcccaaattttttgcccaggttgcgcgttctctggaattttgaacgctggtaaatctccatttatgagggttgttcctctgtacccatcctgatagcaatcaacagcaaaagctgaaacgttaaaaaacaggcaaagaatcgccagtaaacgaaaaagcgtaatcatattttccccttcttagcaggagagctttggcagagggattggatggaattacattcgactttaaacatctccagcccgccgtagtccgccacaaagcctaactggaaggtagagggcaggctgcttaggtgttgagttgcagaagtaaatggtaccaccataatactgtccgcaccgggcatcagtgtcttgccattagtgccgatataaccgacggtaatatgataaggcgtcgggttattcagggtcagaccggcggcggtgcgggtaatcgttactttttgcagaggaatcatctccccctcttttaactcaatcgcttttggccgccagaatagcttcaggcggctttgcatggcgatttgcattacattctgttctttggcgcgcggcggaatttctcgcacgttatagtagaacaacgtttctcggtcctgtggtaagtcgtttaacgaggccagtgccatcaggcgaatttgtatctgttcatcaggctcaatacgttccatcggcggcaatgtcgagatgtaatcacgcgtttttttaccgctggcatcttcaatccacgactgagccagatagggatcgattttactttggttggtcaggcgaaccgttgcgcttttattcgaagcattaaaaatgatgcgtgttctgtcgggagagacagtcgcctgggcaaagttgcagatccccagtaaacaaatcattcctgttgtgattaatggtgatttcattatattcatcctgaattatttgactgttttacaaggtaaaattattgcgctttcgctaatgttactttggtttggcggcgtgacttcacaggtattatcaccccaggttaaatgcagagtactattttcctgaataccgctgagataaacgaagccgtcttccgcgaccaggcccacatctttacctgtcgctttatccgtgacattcacacctagtggagggaagcgcccattttcctgacgaataacgccgacgatttggtaaccggtggtggcattcagttttgcgtagccgatggcaccctgggtgagcgtggtgcgaataaccgagttttcgacatcgacaccttctggcagatcgttattgttcacccgcaacatggaggtggtgtagttcgataacgaaggtatcacggcgatgcccagcccgttggtaacggtacggttagagttgatttcaatgccggagatgccatcggtatcgaccatcatgcgggcgttatcgccatagctataatcgtgaagggcgataccatgacgtgtagcggtaagtgaaccgtaccagcctgcggtaacagaattgtactgattcggctgtacactgccattaatgttcagacgtccccacggcgaatagtgctggtagctgccgcgcagtgttggttcgccatcacgtatattgtcgtccgttgccgacgctgaaatattccagatattgttgcgatctgatgaatcgtaccaggaaatcatctgcgaagtattactgcttcccgttcgctgcatactgtaggagatgttgcggttttgttgtaaaggtagagagaaagagaagtaatattgattctcttcgtcgtcatcccagcggattcgacttactgccagcgatgcagatatacctttgaaatcgccaatatcaaagtttttgcttacagatacggagtagttggtattgctggcgctgtcccaataagtattgcgtgtaacgttgagataagagtttaattccagcgtttcaaagtactggttcaaggaaatgacataactctctttttcattatcgattgactcatcgccattacgcgagctgaggtactcactcatcgacacgtaatctttatctgagaagcgataacccgcgaaggtaatctgactgcctgtcgattcgaaatgctttgcatagttgaagcgatagctgtaaccacgcagattgccgctattttgttgctgtaaagacgcgtctgctccagtgacatcaaaagaaagcgaaccgaattggttaaggttaaagccaataccggtagtgatagcctgataatcatcagcggtgaacatgccaccaccatacaacgacacattgttcagccagccccaggaggcttccgccgtccagaaaaagggattattgatatcgttatgcccgacggatgtcggttttcccagtgacgttttatagcgcacttgccctttacgggttaaatagggaatggatgcggagccaacctgggaaggtgctggtgcggccatcttcttcttccactgtgacatccagcagcccctgaaacgattgccccaaatcagaaatagtaaaagggcctggcgcgacagtggtttgataaagtacacgaccattttgtgccacagttactttcgcgttggtctgcgcgatgccggtaatttgtggcgcataaccctgtaaatctggcggcagcatgctttcatcactttccagcgatgcgccagtaaagtggaaggtatcgtaaagattggagctcaggtcgtactggcccatagtgaattttgacgaccaggaggggatagggcgaaacagataagttcgcgcaaattcgctgtcgcggtttaccgagcgtccatcagcaaaattctgattatattggtaatcgctacgtaagcgccatgcgccgaggttaaagcctaacgtaccataggagctgacgttttgggtgctgtctccgtgatgtggggcatactggctggcgtacacgttgtaatcaaggataaacccggcgataccggtatcccaaaactctggtggcgtccagtttgttgcctggtattttaaccatgcctggggaacacttagcgataatatcatcgtagctttatcaagtcgtgtcgttaactcctgacgttggcttaaatcgagacattcgctgccagctatgttttgcaatgattcaataaattccgtattaagaccgaaattagtcaaattttctttggttaagcagagtaacgaaccactttcattatcggcttttacccattccagtattaacgtttgtggcaacatatttttatttatttgcacacgaacgaggtatctaccaggggggatatagccttttttctcaaaacgagagatgtcgatattctcacggtcttctgcgtcaatcatatcgacgttgaattctacggcgtggactggcaaaacgaagagtagggaacacacaacgccagacagggcatttttaattgcatgggataacttatcccgggaaaacgtgtttttattgttcataaaaatccatttctaaaaaggcccaaagttgccgatgaaatttcatcggctttaccgcctggcgttgtgtaggtattgactaccgattacttgtagtcgagtacgtaattagcctgtgcctgcacgttacccggggtcgcggtgcgtcccagagactccatacgggctttaaagttcaactcctggtaagagttagtcgtcgggaagttgatagtgattggagtgccaagagtcacgttggtgttgtctgatttcaccagacgtacgcctacatcagttgcgccgccgatgttaccttccagagtgtttttaagcaggttggagtcggtagcgtcaacactggcagaactaaaggtgattttgactttatcaacagtgttagtgccgtcagataaaatacaatcctgcaaatgaatggtgacatctacaggcagtgatttctgaccgctttttaatacggtatcagcaacttcaccgaggtttattgtctgatcttcatcaccaggagcaatagaacaaggtgcatcgataacttcacctttaaaagtaattttacctgaaccctgattagcatcgtcagcaagagcgttaaaagcaacgcctgataacaatgcggttgcgaacatagataacaatgttttttttaacatgactataatcctttataaatggatgaggaaaatacaggtttgaatttaatattaattcagctatggacattaccataacctgagataatttgactcgttatttatattaaatgctgattaagtaaaacttaaaatataattccccgttatatattgaggtgtatatatctagatgtttgttgtttatcgttatttgtgataatttttttgtatgaattgcggcgaaaaaacaaccgtttgttgacaaaggtttacgcctaatgttgtaaaggggggagtgtatacttattataacgagtaggggcttaataatcgtgaagatataatatatatctagcgatgcttattaagttttattattaattagtaatgttttatcgggggataatatatattaatagccttggttgttcttttttttgaccagatatggtatataatacaacacttactatgatcgaaatcatatacttgatccagaattatgcgagtatatgaatgtattcaacgatggatatgtgaaattttaacgctaaatgtttagtaatgttaaattttgaaggtgaaaaggatgtttattgcctggtactggattgtattaattgttctactggctggtggctattttcttcatcttaaacgttactgtaaagcttttcgccatgacagagatgcgctgttagctgcccgaagtaaattagataaacgctccgataaagaagtgtttgaaaagcatcaataatacctttaataacgatacagatgttgcctttagcaatgggcaacatctgtcattatcgtctttaaccaattcccgccgtttgtagcagcactaaactgaatcccatcactgacattccacatagcacgccatagctggggttattattggggtcaatctctttggcgagcggcattaattcatcaacggagagcgccaccataattcctgcaaccgccgccatgattgccgccatgaccaccggagaaatcatgctgccaagaattaaccacgccagaacgccaccgagaatttcagccagtccggaaatgcccgcccacagaatcgcggtacgtttcgatcctgttgcagcgtaaaccgggcctgcaaccgccagaccttcaggaatattgtgcaacgctacggccagggcgatgccaaatcccagctccaggttgctgctcgccgtgacaaaggtggcaatcccttccgggaagttatgcagactgatgccgagagtgagcagaatggctgtgcgcttgatcgattttggcaacggctgcaccgatttttgcattaaatcctgcggatgcgcatgtggcaacatgcggtccaggccaaaatagccaagcagaccgaagataaacattccataacccaacacaggcgacattccttcggcggctaatgcggcaggaagcatttccattaatgagatgagcaacatgatccccgccgcaaatcctagcgaaaacgccagtaagcggttcgagggtttttgcccgagaacgccgagaaacgcgccaataaacgtggctgcccccgccagtatggtcagaatgagaggtactgacatcgacaactccttataaatcttcaccttcaggcagatcgtcaaaataactgatgatcatcatcattgttatccgggttcttactccgccgaacaagcgtattgtgaggatatcaaaatgacacctttagttaaggatatcatcatgtcttcaacacgtatgccagcattgtttttaggtcacggtagtccgatgaacgtgctggaagataatttgtatacccgcagctggcagacgttgggaatgacattgccacgcccgaaagcgattgtggtggtttcggctcactggtttacccggggaacaggagtgaccgcgatggagacgccgcccacgattcatgattttggtggcttcccgcaggcactgtacgatacgcattatcctgctccgggttcgcctgcgctggcacagcgtctggttgagctgttagcgccggttcctgtggcgctggataaagaagcctggggctttgaccacggttcctggggagtgctgattaagatgtaccctgacgccgatatcccgatggtgcagttgagtatcgacagtagcaaacctgccgcctggcatttcgaaatggggcgcaaactcgcggcgctgcgtgatgaagggataatgttggtcgccagtggcaacgtggtgcataacctgcgtacagtgaagtggcacggtgatagttcaccgtatccgtgggcgacgtcgtttaatgagtatgtgaaagcgaatctgacgtggcaagggccagtggaacaacatcctctggtgaattatctcgaccatgaaggtggcgcgttatcgaacccaacgccagagcactatctgccgttgttgtatgtcttaggggcgtgggatgggcaggagccaattaccattccggtcgatggtatagaaatgggcagtttaagtatgctgtcggtgcagataggttaataaaagaacccgaagccagaacgactggcttcgggtgttgctgagttagcctctgatgattttaagcgcccatgcgccactcataatgaccagcagcaccagacacataccaaaagccagcatacaagcctgagccatattcataaaatgccatggtggtagcagataccagccttcagattgctgatacatttccacaaaccactgttgcgtgctgctcagtgtgacgccatcaggaacgattggtgcgtcatagccacaatccccggtaggcttgaaccaatttggtgcccactgtgccagcggcaggttaaagggaaaagtgggatcggtagagcaaccctgtacgccaaacagtgaatcgggatccggattatgtactgcatggtggatatcgttcagtttgagcgaaaacttcagtcccaaaatgctgccgtaaaatgccatcacgcagccaattagctttaggatgatgttctttgggttgatcgctgcaaccaatcctccaataaccatcacaaacatggcgtagcgaatgtatacacattgctcacagggtgccatgtagagatagatctggaagaaagagtgcgccaggataattaacgcgcccatcgcaacggccattaacaaccacaacaagcgttgctcctgccatctgaccagtgtgtcaactggtgatgtgcgaagatctttccacattcccttaatacccatagcctgtttccctgttatttgcttgctaactcacggataaggtctgccatcgcgtcgatggatttgatgctcttggtgtagatcaagtacttaccattaacgacataggctggaactccctggattttggcgacatcataagaggctttccattttttcagtgtttcttgaaccgctggttctttcagtgccgcttcaaaatccgcctgactcatacctgcggcatccagaccggttttgataaaagcagccggatctttaccgtcagaccagcgttcttttttgtcgtgataagccgcgtagtaggcaaacttggctttcttaaactgagagttagcatcaaataaggaaatgcctgctgctttatctttattgatcaagaccgcaaagacttcgcttgcttgtttgccgtattcaccttttgtttccagatggaatggcgtgaaagcaacgatatctttcactttttccgataccggaccggtaaccgctttgtcgtacttgtaacagaacgggcaggcgtagctaaataccttaatcagcgttttgtcggcattcggaattggtttttccagaaccatgtaatccgtgccttcggtaaatgcagaagcggtaaatgaaaccgccagagctgcggtaagcagtatggttttaaatagtgatgagatccctaatttcgacatttttattcccttcttaattatttgaacatctgttgtggacggactaacagcgcacggtagtgagtctgattgggtttatctgacagcacgtcgatttccactttcacttctttggttttgtaatcgatttcgttcaacttaccgacggttggctgcccgacatcgaacaaatgaatagaaccaccgaagccaaacatggtgttacggtcggcttgatattcaatgatggaggtaatcgggctatagaaatcgtagccacgttctttaccgtattcccacacttgctgaacggtgcctttcttctcatcaatcttatattccacaaagcgagagtatttcatggttggtaaggcaggttgttccagatgacgcccatcgccattatcaaaaatggtgagcgttcctttgctggaaatccaggcggtatgctgggtgtaggtaaagtcgaagtctgagttttcgcacaggccattttcgttacaggtaattggcttaccgttagcatcaaccggtttcagcagcttgctggccagcggtttttcccaacctttagagggcgcaaggatccatttcacttgcttatcacgaccaatcttcacaacaccctggtggcgagaggagaggatgatagagtcatcttttgcgtcataggcgatagagttcacgtgcgcccagttgcggcctggccctacacccagcgcgtcgccgaacggtgtatctggttccagttttgcctgttgtcctgcatgggcaaggtcaacgttaacgcaaactgcacctgcatccagcgcgccgagcagtgcatcgcgtttcggatcgaggatcttggtcagatcccatacatcgacaacgcgaccagatttatcgacttcgaggatatggtcacgaatggtggtgacgtgtacgccgtcatcgcgacgatagttactcttacctacgcgcaacagtaccgtgccatttggcgtctcaatggactcatgagtggcgtcagcaaatccgcgcggtagtttgtgatcttcgagcacctgccccatcatgtcgaactcgtaccagtgctgaccttgtacagcggtaaaggtgccgcgtggcgtttcgcggatacccatcagataaccacgcttgttgatatcgcggtcacgaccatcgtagaaagtgtcttgatccagccaccagcggtattcaccttcggtatcgacgatgaaagtaaagggcgcgatatcaaaagggagtgcgccggttgccggacccgcatcaaggataccggcatttttatctttctcaccatgccagtggagatcggaaccttgggcggtaaaggtgtgggtattaaccagatagaggcgatcttcaaaacccggtgcgactttaataactttggtctgttgtaaatcggagatagagcggttatccatgtaattattgacgatggccgaagtgtgcaccacataatcatctttcatgaccttgccgttttctttccactcaacggtcactttgttagcaaatttctgataaagaccaaaaatcggtacaccatcgtaagtttttagtgattcctgacccacgggatagctgatttctacgcctttttcgcccttcccatggacggtaactttgacgtcagaaataacatggctatctaagtcaaccaaagcggtcagtggtgcattgccgtagggatcgacaatgaccgcacccagttgcccggcaggtggcgctggtttaaaacccgcagccatcacccccgatgctgacaaacccagggttatcgccacagttccggctacgagtgtttttctatatttatcaaacatggatatatctccttatataacgcaaatatataataatgatgaatatcgactgttgagagggtgctaataaattcgttacgtgaatataaatattaattcaataaagagtgagaatgcttttgtgtttcttttaaatatgttgttattcggtgaaacaaatatttatgtttaatggatagtaggggggcaatatatcaatcacaatgttcaatactgtgtagtgtgatccctgcaacattgttttttaattattaaatttaaatctggtgagataaaagtaaagtatttaaataatatcaaatagttatgttgtgatgtattcacttactttaattacaatatcgcttgcatatgacgatttaacattaaattgagtattaatgttaaataaaggttggatatgtatgtgtttatatattgatgggagttatgaatggtggattataagagattgccccgcttatcggggcaatattaagctgtattactcaacaaaaatatgcggataaaaccgagacatatcctgggtgatcaatgcacggtcttcacgaatgccaattccggcaggttgatcgttcaccagccagctaccaatcagcatatagctgtcgccgaatttcggtaacgggtggaattgctgaacaatcatcccttcttcgccatacggaccttccgctgctgcaatggttttgccgttctcaatgatcgacacgtttgcgccttcacgggagaagatcggtttaaccacatatttttccatttgcggatgatcatcttccgcaaaataagcgggcagcaggttcgggtgattcgggaacatctcccacagtagcggtagaagcgctttgttggagataatgctcttccacgccggttccagccagcgtacgcctgcatcctccagcttggtggagaacatctcacgcaacataaattcccacggatacagcttgaacaggttggaaatcacctgatcctgtaaatccgtgaactgacctttttcacctaacccgatatcgtcgatgtagaggaactcggtagcgatttcagcttccgtcgcgcagtcctgcaaatactgaatggttccgcgatcttccaccgtgtcgcgacagcaggtgagatgcagcaactggaagccatactgttcacgcagctcaacgaagcgatcgatcagcttttcttgcaaactgttaaactggtcgctgccctccggcaagttaccggcgttaagctgatcttccagccagatccactgaaagaacgccgcctcgtatagtgacgttggcgtatcggcgttattttccagaagtttaggttcgccagtgccatcccacgccagatcaagacgcgaataaagcgatggctggtgcgtcagccatgactggcgcacaaaactccaggtgtgttttggaatgcggaatttggtcatcagctcatcgctggcgatcactttttccaccactttcaggcacatctggtgcagttcggcggtgacttcttccagcttttcaacctgggcgagggtcaacttgtagtaagcatcttcacaccagtacggctcgccgtacatggtgtgaaaattgaaaccgtattcgtgggctttttcgcgccagtccgggcgctcggtaatactgactctttccatcggtatcagccacccattgaacgagaagaggtgccggttgtgctacgctgcatagtgctttgtttggcaacagattcaccaaaaccgccacgggtaacagtagtagtggtcgccggttttggtgccattgccgtcttcggtacggtcatggtgcggcctggctgggctgcgccatagtttttaccggtcgcgtcggtatatttaccgtaagccgggctggccgggtttttcgaggagaacagcggctgctgtgcaaatcccgcgccgccgcccatcagacgtcccatcatgtaaccggccatcagcggcatccagaaactcccgctggattgctgggcctgcgcctggttttctggtgccatgcctgcctgggctggtgcctgctggcactgaccttcaccaaattcagcaacacagtcttcacgggtggcgtatttcggcgcagtacgttcggcttctttcagcgcattgttgtacgcggtggtacattcggcgcttttgcctgggtttgcagctgaacagtcgtcagcattttgatagagagacactgtttcatcactcttttcacagccagccagcataaaaacagtggcaaccgcgagagcgactggtgtcagatggcgtgcgctccagtttttgcggaacgatgcgtggcgtatggattttgtccgtttcatttttgtcttccgggaccagtggtaaatacccatcagaatagaggatggctggtcgaaattgaagcgagaagggggaagaatgcggcagataacccgtatctttacgttgccttacgttcagacggggccgaagccccgtcgtcgtcgtcagttacggaaagggttatgaccgttactggtggtagtgcgtgcggatgtttgctgaacgacgggtgccgggctatcaggcgcataaccatcagcaatagcattctgttccggcgtttgcggggcaacgttttccggattagtggaaaccggtttgctcagcgcattgttcagtgccagcagatcctgctcgttcaacgtacccagagctgacttaatattcaactggttaatcaggtagttataacgcgcatttgccagctcttgcttagcgttgtacagcgtggtggtcgcatccaacacatcaacaatggtacgcgtaccaaccgagtaacccgcttccatcgcgtctaatgagctttgagcggaaactacggcttgtttgtaggcgttaatgctactgatagaagcattaatgttgttgaaggaggaacgtacggtttgcacgacgctacgatgcgcgctttccagttgctcgctggcaccaacaaagttgtactgggcctgtttcacctgcgagttaaccattccgccctgataaatcggcagcgagaagctcaggccaactttgttctggcccatattgctatcgtcatactgggtaccagcggcaccacgggtttttgaaccgctgtaagaggtgtcagaaattccggtagaggccgtcaaatccagagtcggtaagtgaccgtcctgcgcctggcgaatttgctcgcgcgccaggtcctggctcaagcgcgcctgtaacaacgacaggttacgtttttcggcttctttcagcagcgtgttaaccggctgtggtttgtcggttttaaagttttcgacattcagcgccgccagttccggatagtagttaccggtgatctggcgcagctgctctaccgcgttatcaaggttattacgtgcggtcacttcgttcgccagcacggtatcgtactgtgcgcgggcgttctgcacgtcggtgatcgctaccaggcccacgttaaaacgttgggtggtttgatctaattgacggtagatcgcttctttttgcgcctgtgtataggaaagaacgtcaatcgcattcaacacgttgaaataagcggtcgcggtgttgaggatcaaggtttgttgatcggtctgatacgtgacgtcctgaatcccagctgctttttcctgcagcgttaacgcacgccatttcgacatatcaaaaatggattgagttaactgcagggacgcactggtcgcgttagagttgatgccgttcgcgtcgcggtagccgttgctataggtgtaatctgcacctaaacctagttgtggcagtaatggactgcgcgcttcattaattttttcaaaggcagcatcacgatcggcggcagacttacgcaattccgggttactaaggcgtgcttgctgataaacttgcatcaggttctcggcctggctcaacgaactgaacccagagaggctcaggccgataagaatggggagcaatttcttcatttgcattccttgtggtgaagcagtatttagcgcgatcaaactgtaaaattattgcggattctagcagaagccgctaccgcaaaaggttggcgttacgtgccatagggcgttaatgtgcctcaatttaacacatgactgctcaaacggcagtcaaacgtcgctgaaattcacatttaattcactattagtgccaggacattaacaatgcttaagccagacaacctgcccgttacatttggcaaaaacgatgtagaaattattgcacgagaaacactttatcgcggctttttttcattagatctttatagatttcgtcatcgtctattcaacgggcaaatgagtcatgaggtacggcgggaaatttttgagcgcggtcacgccgcagtcttgctaccctttgacccagtacgtgatgaagttgtgctgattgagcagattcggattgccgcgtacgacaccagcgaaaccccctggctactggagatggttgccgggatgattgaagagggggaaagtgtggaagatgttgcccgtcgcgaagcgattgaagaggcgggactgatagtcaaacggaccaaaccggtgttaagtttcctggcaagcccggggggcaccagtgagcgttcgtcaattatggtgggcgaagtggacgccacgaccgcaagcggtattcacggtctggctgatgaaaacgaagatattcgcgttcatgtggtaagccgggaacaggcataccagtgggtagaagaggggaaaatcgacaacgcagcgtcggtcatcgctttgcaatggctgcagctgcatcatcaagcgttaaaaaatgagtgggcataaatgaagcgttacacacctgactttcctgaaatgatgcgcctgtgcgagatgaacttttcacaattgcgccgtttgttaccgcgcaatgacgcacccggcgaaactgtaagctatcaggtggcaaacgcacaatatcggctgacgattgtggaatcgacccgatacactaccctggtgacaatagaacagactgcgcccgcgatcagttactggagccttccgtcaatgacggtgcgtctgtatcatgacgcgatggtggctgaagtgtgttcaagccagcagatttttcgcttcaaagcgcggtatgattatcctaataaaaagttgcatcaacgcgacgaaaagcatcaaattaatcagtttttagcggactggttgcgatactgtttagcacatggagcgatggcgattccggtttattagcgtcgtgaaacctaaggacaccatttggaaagcctgttaacccttcctctggctggtgaggccagagtcaggattttacaaattaccgacactcacctgtttgcacaaaagcacgaagccctgttaggggtaaacacctgggaaagctaccaggcggtgctggaggcgattcggccacaccagcacgaattcgacctgattgtcgcgacaggtgatttagcgcaggatcaatcctctgcggcctatcagcatttcgctgaaggcatcgcaagttttcgtgcgccctgcgtctggctgccgggcaaccacgatttccagcccgcgatgtacagtgcgttacaggatgcgggtatctccccggcgaagcgcgtgtttattggtgagcaatggcaaatcctgttgctggatagccaggtgtttggcgtgccgcacggtgagctgagcgagtttcagcttgagtggctggaacgtaaactggccgatgcgccagaacgccatacgttgctgctgctgcatcatcatccgctacctgcaggttgtagttggcttgatcaacacagcctgcgtaacgcgggcgaactggataccgtgctggcgaagtttccgcacgtcaaatacttgctgtgcggtcacattcatcaggagctggatctcgactggaacggtcgccgcttgctggcaacgccgtcgacctgtgtgcagtttaagccgcattgttctaactttacgctggacaccatcgcgcccggctggcgtactctcgagttacatgctgatggcacgctgaccaccgaggtgcatcgcctggcggacgcacgcttccaacctgataccgcttcagaaggctactgatgtctacgcttctttatttacacggtttcaacagctcgccgcgctctgcaaaagcgagcttgttaaaaaactggctggcggaacatcaccctgacgttgagatgatcattccgcagttgcccccgtatccttctgacgcggcagaactgctggaatctattgtcctggaacatggcggcgattcgctgggtattgtcggttcgtcactggggggatattacgccacctggttgtcgcaatgttttatgctgcccgcagtggtggtcaacccggcggtgcgcccgtttgaactgctgacggactatctcggtcagaacgagaacccctacaccgggcagcaatatgtgctagagtcacgccatatttacgatctcaaagtcatgcagattgacccgctggaagcgccggatttgatctggctgctgcaacagacgggagatgaagtgctggattaccgccaggcggtggcgtactacgcttcctgccgccagactgtcatagaaggcggcaaccacgcattcacgggcttcgaagattatttcaacccgatcgtcgattttcttggtctgcaccatctctgacgatcaactcgaattgctaacttaaaccatgacgcaaacttataacgctgatgccattgaggtactcaccgggcttgagccggttcgccgccgtccggggatgtataccgataccactcgccctaaccatttggggcaagaagttattgataacagtgtcgatgaagcactggcgggccacgcaaaacgcgtggatgtaatcttacatgccgaccagtcgttagaagtgattgacgatgggcgcgggatgccggtagatattcacccggaagagggggtaccggcggttgaactgattctttgccgtctgcacgcgggcggtaaattctctaacaaaaattaccagttctctggcggcctgcatggcgtggggatttcggtagttaacgccctgtcgaagcgcgtagaagttaacgtacgccgcgatggtcagatctataacatcgcctttgaaaatggcgaaaaggtgcaagatttacaggttgtcggcacttgcggtaaacgcaataccggtaccagcgtgcacttctggccggatgaaaccttctttgacagcccgcgtttttctgtttcacgcctgacgcatgtgctgaaagccaaagcggtactgtgcccgggcgttgagatcacttttaaagatgagatcaacaacaccgaacagcgctggtgctatcaggacggtctgaatgattacctggcggaagcggtaaacggtttaccgacgctgccagaaaaaccgtttatcggtaatttcgctggcgatactgaagcggtggactgggcgctactgtggctgccggaaggcggtgaactgctgaccgaaagctacgtcaacctgatcccaacgatgcagggcggtacccatgttaatggcctgcgtcagggcctgctggacgcgatgcgtgagttctgtgaataccgcaacattctgccgcgtggtgtaaagctgtcggcggaagatatctgggatcgctgcgcctatgtgctgtcagtaaaaatgcaggatccgcagtttgccgggcagaccaaagaacgtctctcttcgcgtcagtgtgcggcattcgtttcgggcgtggtgaaagatgccttcatcctgtggctgaaccagaacgttcaggcggcggagctgttggcagagatggcgatttccagcgcccagcgtcgtatgcgtgcggctaaaaaagtggtgcgtaaaaagctaaccagcggcccggcgctgcctggtaaattggctgactgtaccgcgcaggatcttaaccgtaccgaactattccttgtggaaggtgactccgcaggcggatctgccaagcaggcgcgcgatcgcgaatatcaggcgatcatgccactgaaaggtaagatccttaacacctgggaagtctcttccgacgaagtgctggcttcgcaggaagtgcacgatatttcggtagctatcggtatcgatcctgacagcgacgatttgagccagcttcgttacggcaagatctgtatcctggcggatgctgactccgatggtctgcacattgccacgctgctctgcgctttgtttgtaaaacacttccgcgcattggtgaaacacggtcacgtttacgttgcactgccaccgctctaccgtattgacctcgggaaagaggtttattacgcgctgacggaagaagagaaagagggcgtacttgagcaattaaaacgcaagaaaggcaagccaaacgtccagcgttttaaaggtctcggggaaatgaacccgatgcaattgcgcgaaaccacgcttgatccgaacactcgccgtctggtgcagttgactatcgatgatgaagacgatcagcgtactgacgcgatgatggatatgctgctggcgaagaaacgctcggaagatcgccgcaattggttgcaagaaaaaggcgacatggcagagattgaggtctgataatcctcccgccagaagaataaaacatagcccggtatacaagtgtataccgggcttttttgatcaaaattccattttcaccgtgaattgcacttcacgcggatcgccaatctggttgcccagattatttgtggcgatggaagaggtgtaatacgttttatcaaacaggtttttgacgtttaattgcagagtgaccggatactgcaatttcattttgtatgcggcgaaggcatcggcaacgaaatagccaggcagataatagtcagccccattggttgccgaacgacggcttacaccatgtccgccaccgccaaacgtcagtgtgttattgcctggcatgttatgaatatcataggtcaggaatagcgaaccggtatgacgaggaacattcggcaatggtttccctgcataatcaggatcttccagaacctttgcatcggtatagccgtagctggcaatgatattaatgttttcagttaatgctcccgcaaggtcgacttctacccctcttgaacgaacgcggcctgccgttttggcgatggtttcatcaccaatactttcggtatacaacacattacgtttatggatatcaaacagcgcaatatctgcggtgataccatcgaatagctcgaattttgccccgacttcgtaagcattagatgattctggtggaagatcgccaatgtagctggcaattgacgactgcggcataaatgtttgcgaataattggcaaataaggataccgatggcgtcagtttgtagactaaccccagtttgggcgtccattgttcatcgcggctgtcagtattgacattaaaaggacggcctttacccgcatattgcgtgtaatactgatagcggatcccggcgacggcaatccagttatcggtcagatagagcgcgtcctgtgcataagctgagtagttctcctgtttgatcgtctgatcgctgtccgacgccgaaaccgttgtacatttgctggtattaccataaacagggttgtatatattgaaatctttagcttttttacagcgaatcatatctgtacgcagaagatcataatattcatatgacaccccacccagaatctcattatagaatccggcaatatcaacattcccttgcagatccgcacgagtagcatgcatacgctgggtagatccctgagttgcatcaacacgccgtgtcagtgttcctgtcgttgcatcatacgcggtaacacgcgcctgattatcgctgtatttatcctggctgtagctgtaatcaaagcgcgctgtccactggctattgagatgatattctgcgttgagttgcgccagatcggactgaccatctgtaatattaaacggttcgtcaaaacgtatttttcgatcaacgtttacgggctgtttcgtcgtaaggtcgaaaatcgttccacgatcgaatggagttttatagtcccgatgggaatagagcatggttactgttgcattatcaccaaaccaggtgagtgacggggcaataaatgtactgcgctctttaccgaagtttcgccagtaatcttcatcctgcacttccccggtaaggcgatacgccagctgagtgccttcaatgggacctgtgatatcaagttgcccagtgccgccaccaaaactggaggaggtggctgaaaccgaaccatggaatgttttttccgggcgcttggtcacgacgttaatcagtccgccaggatcgagaatgccatacagcgtggaggccgggccttttagcacttccacacgctctgttgcggcgttgaaactacgaggaagtacggttcgcagaccgttggtcatgatggagccatcccggtttgcgccaaacccacggcgtacaaaagcatcctgagtcccgcctaatgtattggtctgtaccacgttactgacgttataaagcgcctcatccagcgttgtcgcattctggttttccagaacctgatcgctaaccgtattgaccacctgcgggatatccagcatcggcatatcggttaatgtcgccgtggaggtgctcagaggttgataaccatcggttgcctcagttgcggtatttgcatctgctgtaacagtgattgtttcgccatctttggtcgttacagagtctgttgcatgaatcatcggtgccgcaaaaagcagtgaaaagagcgcccgacctttgagtcctgagaatgaaggtgtgaacatagccatttagtctgttatcccaaaaactcgcggattgtcgcgagtgaaaattgtttcttattgctcactaagcactatccgtttgttatttcgccatcggatatgtaattgagaatcattcaatcacgcagtaatgtagtagtaaatgagaaataacaaaaaattgctacatgtgtttttatgaaaagtttatacaatttgattgcttttaatttattgatatttaatgtttttatttttatgtataaaaatagtttacctgttatttaccttgtttttgtgtggcttttaactgcttgactactacattttgtggcgtcaaactctcaaaggagaatgagttttatttttgtttgtctttgattaagttggcgtacacgtggcacataacgcaaaagggcaggggctgatcctcgacaatgtttctgccgggtatcacaagaagatcattgttgatggtgtttctttctccgttcccacagaaaaaatgaccgttctggttggggcaaacggctgtggaaagtcgacgttgctcagcaccattgcacgtatcttgcaacccatgggcggttcgatattgcttgatggcaaagcgattcacgagcaaccaacgaaagcgttatcccgtagacttgggatcttgccgcagtcgccattattgccggagggcttaaccgtttatgaactggtatcgcgtgggcgttttccctggcaaaatttcatacgtcaatggagcgacgccgatgagctggcggtggaagaggccctgaaattaacgggtacgcaggagtttgcacatttacctgttgaaaaactctctggtgggcagcgccagcgttgctggattgcgatggtgttggcgcaaaagacgccttatatcctgctggatgaacccacaacctggcttgatttacgttatcaggttgaaattcttgagttattacatgatttaacgcgtcatcacgggcgtacagtcgtcgtggtgttgcatgatctgaattttgccgtcaattatggtgatacgttgatatttttacgccaggggaaagtggtgcgtgtgttgaatgagggggagcattgcacgcctgagctggtaaaagcggtctttgacgttgatgttcacgcatcaataaatcctctgacgggaaagccgtacttcatgccgtttcgtggtgtagaaaaagtatgatgcgcacagggctggttactgtaattttcctcgccttactgctggtgggatgcgtggtatatccagggattggtgcccgatttattgcaccacaaacggtgttgcaggcatttcttcattttgatccgcaaaacttcgatcacaacgtaattgtaagactccgtttgccgcgtttagcggcagcattgcttaccggtgcttctcttggtgttgctggtgctttgttgcaggctgtcattcgtaacccattgggggagccacatattttaggcttaaatgccggagccgctcttgctgtcgttgccgctagtgcgcttggactggcctttccggttggacgcccactgctggcatctacggggggcgcgttattgttcctgttgatattgctgctttcctccgcagggcgttcagggttaacgccaatgaaagttactttatgcggcgtggcgctatcggcgttcgtgtcctcaataacggctgcaatcctgattcttgacgaacaaacactgctggcgatgcggacatggctagcaggtgatttagcggggcaggattgggcgacgctgggtacgtccgcctggttttctctggggggatttgtgttagccctttaccttgcaccctcccttaacatgttggcactgggcgatcgcatggcgcaggggctgggcgtctctgtactccgcacgcgaacattcaccctgcttgcgatcgcgttgctctgtggcgcagccgtatcgattgctggccccattggttttgtcggcctgctagtaccgcagattgtccggcgtctggtatcagcggatctgcgcgttctgctccctctttcagcttgtgtcggcgcgcttttgttattactggcagatattattgcccggacgcttttcacgccccatgagttagcgaccggtgtcatgacggcgttagttggtgcgcctgtttttgtcattatggcgacgaggatgttcaaatgagtcggataatgaacgtcgggctacgcccactacgtgttggtaagttttcgacactggtgcgccctaaaaatctgctgttgcttggtgggctgttcctgcttgcggttggaatactgatattcggtctgatgcagggttctttctctgttccggcatcggaagtaggacgagcgttgtttgctccagaaaacgtaagcacagacgcacgttatattgtgcaggatattcgcttgccgagagtcatcatggcattgctatgcggggccatgttaggtatggcgggggccgcgatgcaatccattgcgcgtaacggccttgccgatcctggtttaatcggcgtcaaagaaggatgtagcgtggcggtgctgtggctgattttccagtttccaatgctgggaatgttctggcgtccagtggctggtcttgctggtggtctgttggtggctttaatcgtgattttttgtgcgcgcgatatttcccgcccgcgatttgttctgattggtattggtgtttcctggtttttcgccgccggtatcggtgtatttatgaccactgcagatgttcgagatgtacaaactgcattgatgtggttatcgggaagcctgcatgcagctaactggatgttagtcggtatttcagcctgttggatgttgccagccgctcttttattgctgttcaccgccaggactgcggatatcgctctgcttggtcatcaggttgcaaccgggttaggggtgaatagttctcgtctggcgttgttacgtgtcgccgcacccataatcctgacagccgtctgcgtttcgtgtgttggtaacatcggttttgtcggattgatagcaccccatatatcacgttttattctacgtggcgggcagacgacattactgctggggagcgcggtatcgggggcgttgttagttattctggcggatagcattggtcgtttggcttttttgcctttgcaactgcctgccggaatcattatctcactgattggtggaccattttttttgctactgctctggcagcgcaggaacagtttttaacgggagttatatgcgtttatttttttctctgctgatactgttgtcatttttttcccgtgcaacagaacctgttcaggtatttactgatgatttagggcgcaaagtcactgttcctgctcatccaaagagaattgtctctttacacgatcttgatatcactattcctctgattgagctcggtgtacctcctgtcgccagccacgggcgaactcggcctgacggtagccatttcattcgatctggcgcgttattgacaggtgtcgactttgataattcatcgatcgcctttattggtaccgctgatattgatattgaagcgattgtggcggcaaagcctgacctgatcatcacagaaccgacccgtaatacgcccattgaacaacttgaaaaaattgcgcccacggtgagcattgatcatctcaaagggggtgcgccagaaatctatcgcaagctggcagaacttacaggaacgcagtcgcagctggcgatacttgaacgccgctatcaggcacaaatcaatgcgctgaaggcgacgctggacagccaaaaaataacggtatcggtgattcaggcaaaccagggaaaaattaatgtgatgcatagctatcattcgctggggcgggtattacgcgatgctggttttcgttttccgccgctgattgagagcattcctgaaggtgggcgaatggatgtgagcgcggagcgtttacctgaactggatgccgattttgtttttgcaacctggcgcggtgacaccggtggtaaacctcaggatgagctggcagcaatggaaaaagtcatgccgggatggtgtcagtttctgactgcctgtcgttccgggcgttatgtgctgatttctcgtgaagaggcaatttctaactcctttgcatctctggggctgatggctgcgcagatacaatcacaaattgcagggcgacctctaccggaggctaaatgatccagaaagataaagcgcgggttgatatttttggtgagcgttttcgcactcgcgcgagtcagttaacgcctgggttaagagctgtcgccagctacattaatgagcatcgtgaagtggtactcgagcaaacggcgatggaaattgcggccacgttgaacacttccgatgccacagttatcagggctatacaggccctggggtttgccgggctgcgtgatctgaaacgcactctggaacagtggcttggtccagcccttagttccagcgaaaagatgtctacgacggtgagtaacttgacgagcgatgttaacaccgcaatcgactttgttcttgaagggcatttgtatacctgtaatgtcctgtcagagcctgaaaaccgccacgcgcttgcgcaagctgtagcgttgttggtgcaggcacggcaagtcgcaatttttggcattggcgcttcgggtattctggcggactataccgcacgactattcaaccgcataggtttgcctgccacggcactaaaccgtacgggtattggccttgccgagcaactgatcgcgcttcaacgtggcgatgttctgatcatgatggcgcaaaaatctgcgcaccgggaagggctgacaacgcttcgtgaggcgaggcggctggggatccctgttattttgctgacaaacgcgctggattcacgttttagcaaagacgccagtatcgtgattcatgttccgcgcggggatgaaaaagggaaaacgccgctacatggtacggtattgttgtgtctggaaatgattgtctggtcggtagcttccgcagtgccgcagcgtgcggttaaaaccattaagcgaattaacgatttccatcgaggactgaaaacgggaagaaagaatggctaatctgggctgagaccggtagcagcaccggcctctttttagaaatgtcaaagccccggctgcaggatacgaatattcatctccagcacgtcaccttttacggcttcgctatatgctttcatgtgcggggtttgcagatgcgcttcaagatgcgcgatgctttcccactgctcaatcattacgatagaatccggtgccatagactggaaactcacgccagcagcgcaatccaccattggcgcatagccgtggca

SEQ ID NO: 10026 - DNA, 45829 bp, Escherichia coli
gataaccggcaaacccagagaagaaatttctgctaactgcttatcgttaaggcctttttcaaactctgcgcgggttaacgctacccacggcgcgaccggtaaaccggcaccctgccacagaagtttgctgcgtagtttatccattgaaagcgcagatgccatcactccgctgccggtataaggcaagcccatcagctcgagcatgccctgcagcgtaccatcttcaccgccgcgaccgtgtagcgcgataaacactttctgaaaacccatcgacttcagttgcgtcacgtcgacttctttcgggtcgacaggatacgcgtcaataccgccttcacgcagcccggctaacaccgctgcgccagaattcagagaaacttcccgctcagcggaggtcccgcccaacaggaccgcgattttatcagtcatgttgttcttcctccggagtttgcggcttcagtttgatttcagctaaagaacgagcaatttttccgatattaccagccccctgaacgagaatcaggtcgttaccggttaataccggtgccagcatctcggctacctgcgccgggtccggcaccagaatgggatcaattttcccacgtccacgaattgtgcgacacagcgaacggctgtccgctcccggaattggcgcttcaccagccggatacacttccagcatcaacagggtatcaacctgcgtcagcacattggcgaaatcatcatacaggtcgcgcgtacgggtaaaacggtgcggctgaaacagcattaccaggtttttatccggccagcctgcgcgcgccgctttaatagtggcgtccacttccgtcgggtggtggccgtagtcatcgaccagcattgccgtaccgctttttccattcactggctctagcgggaattcaccgaggaaatcgaaacggcgccccgtcccctggaagctttccagcgcacgcaaaatagcctcgtcgtcaattccctcttccgtagcaaccgcaaccgcagctgcggcgttcagcgcgttatgacgacctggcgcattcagggtgacgcgcatcggctctttgtcctggcgcagcagcgtaaagtgcccctgcgggccaatctgctgataatcttctacacgcacgtcggcatcttcgctgaagccgtaagtcgtggtctgacgtcccacacgcggtaacaattcgcggatcaccggatcatcaacacacatcaccgcacgaccgtaaaacggcaggttgtgcagaaaattaataaaagtctgttttaaattctcaaagtcgccctggtaggtatccatgtggtcggcttcgatattggtgacaatcgccaccatcggttgcagatgcaggaacgatgcatcactctcatctgcttcggcaatcaggtaccgaccatgccccaaacgcgcatgaacccccgccgcttttaccagcccaccgttaacgaaggttgggtcgagtcccgcttctgcgtagatgctagaaaccatcgcggtggttgtcgttttgccgtgtgttccggcaatggcgatgccatgacgaaaacgcattaactcagccagcatttcagcacgacggatcaccggaatacgcgcttcatgagctgcaacaatttccgggttatcggcagaaatcgcgctggaaacaacgaccacgctggcatcacgtacgttttccgggcgatggttgaaataaatcgtcgctcccagattcattaactgctgcgtgaccggatttggcgctaaatcggaaccactgatctgataaccttcattggccagaacttcggcaataccgcccataccggcaccaccgatgccgacaaaatgtatgtgccgaacgcgacgcatttcgggcacgatggaacgcagttttgccaattgttgtgtattcattctttacgccattaacttcttaaattcatacgatgcaaaaggcatcgctacaattacgcccgggcagcccggctcacttcatttgccactcgctcggtggcatccggaatggatgcagcgcgggcgcgttctgccatggttaataagatttctcgcgaccacccggccagggtgttggcgacagcatccacgctaagctgtgactgctcgataattttggctgcgcccgctttttccagcggtagcgcattccagtattgctgacggtctttatgttgaaacggcacaaacaacgccggtagtcctgccgcggcgatttcactcaccgttaacgcaccggagcggcaaacgacgacatccgcccacgcatacgccgccgccatatcatcaataaattccgtcactttatgctgcggttgccccgcttcggcatacgcctgttcaacggattgttgcgaacctttgccgctctgatgccagatagtgactgaatcacccagtttcgcagcaacctgcggcattgtctgattaagaatgcgtgcgccctgggaaccacccactaccaacacacgaaccggaccttcacgtccagccaaacgttgctgcggcaacggcagcgccagcacatcggtacgcaccgggttacccaccacttccgcattaggaaaagcacctggaaacgcctgcatcactttggtagcaatcttcgccagccatttattggttaagcccgcaataccgttttgttcatgaagtacaaccggaatgcctaacgaccacgcggccagaccacctggacctgatacatagccgcccataccgagcaccacgtcaggtttgtacgctttcataatcgcccgcgcctgacgccaggcgttgaagatacgcagcggcgcagctatcagtgcttttataccttttccacgcagaccagagatacgaatgaaatcaatttcgatgccatgttttggcactaagtccgcttccatacggtcggcagtccccagccagcgaacttgccaaccctgagccattagatggtgcgcaaccgccagccccgggaatacatgtccaccggttccgcctgccatcaccattaatcgcttcccttgaccactcatcgtgaacctcgtacaaacgcctgcgctttctccagacgcgtttcataatcaatacgcaacagcatcatgatggctgtcgacataatcagtaagctcgaaccaccgtaactgatcagcggcaatgtcagacctttggtcggtaacatccccgccgccgcgcctacgttaaccagcgcctggaaactaaaccagataccaatagaacaggcgagaaaaccggaaaaacggtggtcaatttctaatgctttgcggccaatcgacatcgcgcgaaaagcgacgaagaataccattaaaagtgccagcaccacaccgacataccccagttcttcgccgataatggcgaaaataaagtcagtatgcgcttccggcagatactccagtttttgtaccgagttacctaaaccttgtccccacagttcaccgcgaccaaacgccatcaacgattgcgttaactgatagccgctgccaaagggatcttcccacgggttccagaatgcggtaacacggcggatacggtacggttcggcgaggatcagcaacacaaccgctgaaatgcccataccgataatggcaatgaactgccacaatttcgctcctgccaggaacaacatcgccagcgtagtcacaaacaacaccaccaccgtaccaaggtctggctgtgccagcagtaacactgccaacaccagaattacgcccatcggtttcaggaagccgcgcaggttattacgtacttcgtcgcctttacgcaccagatagttggcgatatagcaaaacagcgacagttttgtcagctccgcaggctggatacgcagcaaaccgagatcgatccaacgcgatgcccctttaaccgagctacccactaccagaacgatcatcagcaggatgatagatccgagcagcatcgtggcactgtagcgttgccagaactccatcggcagacgcagcgtaatgatcgccagaatgaatgccaggatcagatagacgccatcacgcttcgcgaagaagaacggatcgttggttaagcgttgccctatgggcattgacgccgaggtcaccatgataaagccaatcgccgcgaggccgaaggtcagccacagtaaggtgcgatcgtacatgatcaggctgtcggtatctttttcccgcgagcccatcacccagccctttagcgccgtggagatccagaccagaatactgaatcctggcaggcgcggcattttcaggcgagggagagataaacgcatcaacctaactccttcgccagacgggcaaactcattgcctcgttgttcaaagttcttgaattgatcaaggctggcacaggccggggagagcagaaccatatcgcccggctgaacacgcggagccagcaagcgcatcgcctgttccatggtttcggtttgttctgccacttccgggcgtagcgccgccagctgcgcgccgtcccgaccgaaacaatacagacgtacattatcgccattcaggtaacgcgccagtgggctaaagtccgccgatttaccatcgccccccagcaacaaatgcagcgtgccgtctacgtgcaggccattcagcgccgcttccgtactgccgacgttggtcgcttttgaatcgttaacccagcgcacaccgttatgctccagcacaacttcaaagcgatgcggcagaccagtgaatgtggttaacgctttcaggctgctggcacgcggtaaccctgcggcatctgccagcgccagcgccgccagcgcattggtgtagttatgctgcccggaaagtttcatttctttcacgttcagcactttctcgcctttcacccgcagccaggtttcgccctgctgatgattcaggtgatagtcgcccatgttgacgccaaagctgacgcagcgttcatccgcaccgcgaatcggcattgttaaggcatcatcagcattaaccacgcaaacttttgcgttttcgtaaatgcgcagttttgctgcacgatactgttgtaaaccaaacggatagcgatccatatgatcttcagtcacgttcagaatggtcgctgctaccgcctgtaagctggaggtggtttccagctggaagctcgacagttccagcacgtacagttcgcactcatcatccaacagcatcaacgcaggcaggccaatattgccacccacaccaacgttaacccccgccgctttcgccatttcacccactagcgtggtgaccgtgcttttgccgttagaaccggtaatcgccacaatcggtgcttgtgcttcacgacagaacagctcgatatcgccaacgatttcgattccggcatcagcggcagcgcttaaggatggatgcgccagtgcaataccgggactggcgacaatcagatctgccgccatcagccattcatcattcagaccgcccgtgtggcgttctacggcttcgggtaatttatccaggccaggcggtgtcatacgcgtatccataacgcgcggcgtcacaccgcgagcgaggaaaaagtccacgcaagaaagcccggtgaggcccaggccgataatgacgacatttttaccctggtaatcagccatgattaacgtaccttcagcgttgccagaccaatcaggaccagcatcagcgaaataatccagaaacgcacaatgacgcgcggttccggccagcctttcagttcatagtggtgatgaatcggtgccatgcggaaaatacgttgtccgcgcagtttaaaggagccgacctgcaggatgacggaaagcgtttctaccacgaacacgccccccataatcaccagcaggaattcctgacgcagcagtacggcgataatacctaacgcaccacctaacgccagcgaacctacatcgcccataaagacctgcgccggataggtgttaaaccacaggaagcccagccctgccccgactatcgcggtacagacaatgaccagttccccggcgtgtcgtagatacggtatgtgtaaatagctggcaaagttcatgttgccggtcgcccacgccaccagcgcaaaaccaccggcgacaaatacggtcggcataattgccagaccgtcgagaccatcggtcaggtttaccgcgttgccagtacccacaatgacaaagtaagccagcagaatgtagaacagccccagttgcggcatcacatctttaaagaacggaaccaccagctgcgttgcgggcgtgtctttgccggcaaggtacagcgcgaaggcaacacccagtgcaatgaccgacatccagaaatacttccaacgggcaatcaggcccttggtgtctttacgcaccactttgcgataatcatcaacaaagccaataacaccataacctaccagcaccaccagtacgcaccagacgtacggattggacgggtaagcccacagcagcacggagatcacaatcgccgtcaggatcattatcccgcccatggtcggtgtaccgcgcttgctgaagtgtgattcaggaccgtcgttacgcaccacctgaccaaaggaaagtttttgcaaatgagcaatcatacgcgggcccatccacaatgagatgaacagcgcggtcagcaggctgacgatggcgcgaaacgtcagataggaaaagacgttaaagccggaataatatttgaccaaatgttcggccagccaaactaacatgtcccattctcctgtaaagcgcgtactacctcttccatggcagcactacgtgaacccttaactaaaatcgtaattacctgttgctcagcaatcagtgatttaagacgcgcgataagcgcagttttatcggaaaaatgttcgccaacgccgctggcggtgctgatagcatggctttgtttacccacacttaacacgcagtcaataccagcagcttttgccgcttcgcccacctgtacatggcaggcttcgctttcagcgcccagttccgccatatcgcccaccaccagcacgcggtagcccggcatttcagccagaacctgaacagcggcggtcattgaaccgacattggcgttgtaggagtcgtcgagcagcaactggttttctgccagttttatggggaacagacggcctggaacagctttcagatttgccagccccgctttgatagcatcaagcgttgcgcccacggacatggagagcgcagcggctgccagcgcattcgcaatattgtgacgccccggcaacggcagcagaacatcgacgctacctgtaggggtttgcagggtaaattccgtaccgtgcgaggttacatggatattggtggcggtgaaatcgctgttggcggcattaggtgagaaacgccacactttgcgtgagccaattacgctctgccagttcagccagtcgttgttgtcggcgttcataatggcgataccgttttccggcaggccgctaaagatttcacctttcgctttcgcgacacccgcaagcgagccaaaaccttccaaatgcgccgctgccaggttgttgaccagcgccgcttccgggcgagtcagactcacagtccaggcaatttcaccctgatggttcgcgccaagttcaataactgcgtaatcgtattccggcgttaagcgcaacagcgtcatcggtacaccgatgtcgttattgagattgcctgccgtataaagtgtgttgccgcactggcttaaaattgccgccgtcatctctttaacggaggttttgccggaggaacctgtcagagcaaccacgcgcgccggaacttgctggcgaacccatgcagccagttcaccaaacgccagacgcgtatccttgacgattaactgcggcagatcaatatccagcggacggctaaccagtagtgcgcctgcgccgccagctttcgcctggtcggcaaaatcatgagcatcgaaacgttcgcctttcagggcaacaaacaggcagcccggcgtcagttttcgcgtgtcagtggttacagcatcaagggtaatatctgcaccttgcagttcaccgttgagaatatcggtaagttggctaagggttacgctaatcatgcaatcacccccagcagacgcgccaccgtgacgcgatcggagtagtccagacgctgattgccaacaatctggtaatcctcatggcctttgcccgcgaccagtaccacatcattctctttagcctgcataacggcgcaagtcaccgcttcagcacggccttccatcactttggcatatccggcatctaacattcccgccagaatatcgttgatgatggcacgaggctcttcggtacgcgggttatcgtccgtcaccaccgccacgtcagcaaactcttcagcaattgcgcccatcagtggacgtttgcctttatcacgatcgccaccgcagccaaagacgcaccacagcttgcccgcacagtgcaggcgcgccgcctgtaaggctttttccagtgcatccggcgtatgcgcgtaatccaccaccaccgtcggtttgcctggtgcagtgaacacttccatacgtccgcaaaccggttgcagacgcgcggcggttttcagcaaatcagccagcggatagccgagtgccagcagtgtcgccagcgccagcagcaggttgctgacgttgaatgcgcccatcaggcgactttcaatttccccatcgccccaactcgagctaaagcgaatggtcgcaccgctgtcgtgatagttcacgtcggtcgctttcaaccagcgtccgtgacagttcggattgatatgatcttccattgataccgcaaccgcgtccggcagttttgccagccagcggcggcccacttcatcgtcggcgttaataatcgcctgaccgcaatgatgctcagaataaagcagccatttcgcagcttcgtagtgttccatatcaccatgataatcaaggtgatcgcggcttaagttggtaaagaccgacgccgcaaatttcaatgccgccacacggtgttgtaccagcccgtgggatgaaacttccattgcgcaaaaagtcgcgccctgatccaccagccccgccagctcatgctgaacatcgactgccgaaccggtggtattttctgtcgggatcactttccccagcaggccgttaccaacggtgcccattaccgcgctggtttcgccaagcagttggctccactgtgccagcagctgggtcgtcgtggttttgccgttggtgcccgttacgcctacaagacgtaaattgtcagagggttcatggtaaaagcggcccgccagtgcagataaacgctcgttgagctggctgagatagatgaccggtacgccgtgcatttcacggatttcaccgtcggtcgcctcatctttcgcctctgcaataatggcagccacaccttgcgctatcgcctgcgggatatatcgacgcccgtccgcctgatgacctactacagctacaaagagatcgcccgccgcagccacacggctgtcgagtgtcatctctcgcagtgctcgcgaaggtgcgtctggcacccacggagcaagaaggtcgcgcaaattacgatctgccacctgtaccctcgccttgattaatcacaaattcatttttatcgcccgttgtcagcgcatccggctcgatgttcatggtacgcaatacgccgcccatgatggcaccaaagaccggcgcggaaacggcgccgccgtagtatttacccgcctgcggatcgttgataacaacaaccagcgcgaagcgcggctgactcgcaggcgcaacgcctgcggtataagcaatatatttattgatgtagcgaccgtccggcccgacctttttcgcggtaccggttttaatggcgatacgatagcctttaatcgccgccttcacgccgccgccgcccggtagcgccacgctttccatcatatgcaccacggtgcgaacaatggattccgggaagacacgttcaccgggaaccggggggtcaactttggtaatcgacagtgggcgataaatgccgtagctgccgatagttgcgtagactcgcgctaactgtaacggtgttaccattagcccgtagccgaaagagaaggtggccctctctatgtcagaccaccgttgtttttgaggatataagccactgcgttctccgaccaaccccaaattggtcgcttttcccagtccaaaacgtgagtaagtatctactaacgctgaggacggcatcgctaacgccagtttggaaacaccgacgttactcgacttctgtaataccccggtcagggttaattcgctgtagcgcgccacgtctttgatttcgtgaccgttaattcgataaggaacggtattgagtaccgagttttcccgcaccacgccacgttgcaacgcggtcatcaccaccatcggtttaaccgttgagcccggttcaaacacgtcggtgatggtacggttacgcatcgcttctttcggcgtgccgctcagattatttgggttgtatgacgggctgttagccatcgccagcacttcaccggtgttgacatccaccagcacggcgctaccagattcagccttgttaaaggccactgcgttgttcagttcgcgataaaccagcgcctgcaggcgttcatcaatactcagcgtcaggttgtgcgctgcctggctgtcagtagaagaaatatcttcaattacgcgaccatagcggtctttacgcacaatgcgctcacccggctgcccggtaagccatttatcgaaactcttctcgacgccctcaatcccttggctatcgacgttagtaaagccgatgaggtgagcagtcacttcgccggatggataataacggcgagattcttcacgcagatgaatccccggcagtttcagttttttgatgtagtccgccatgtcagggtttacctgacgcgccagataaataaagcgccctttcgggttggcgttaatgcgggctgagagctgatccagcggaatattgagcgcgttagccagcgccttccagcggtcaccgacgctgataccgccagcgtcatgcacttcttttgggtcagcccaaatcgcttttactggcacactcaccgctaacgggcgaccagaacggtcagtaatcatgccgcgggaggtggaaacttgctgaacgcgaagagaacgcatgtcgccctctttcaccagcatatccggggagataacttgtaaccacgctacgcgtccgagcagaaaagccagcgccaggagaatacagccgcataacaacgcaaaacgccaactgataaagttggcatgttcttcctgacgttttggtttctgcgttttcgccgctgctttcatgcgtcgcgtttatccttatttttgcactacgatattttcttgtgacggatcaacatgctgcatttgcagcttttccgtggctattctttccacccggctatggtcgccgagcgcattctcttcaaggatcaggttgcgccattcaatgtctaaagcatctcgctccagcaccagttgttcgcgctgagcggtcagtaaacgggtatggtgcgccgtggttaccacggtcaccgccgtcaaaataatgcaaatgaacaggcagagtggcagcttcccaaatcgcaaaagatcgtcaccgataacgccaggcaaggcatggcgctcgtggcttcccatcgatcctttaactttgcttagagcttctgtcactctgctgatcatgcgttcgtcctctctgcaatacgcagaactgaactacgggcacgagggttctcagccacctcttcttcgcccggcatcaacttacctagtgctcgcaactgacggccccccagttttttgagctgctcttctgtcatcggtaaccctgccggaacttgcggaccgcggctgttttcacgcataaaacgtttcacaatgcggtcttccagcgagtggaagctgatgatcgaaagccgcccacccggggccagcacattgagcgagctttttagcgcctgctctatctcctccagttcactgtttacccaaatgcgcaccgcctggaaggtacgggtcgcgggatgtttaaacttatctttcaccggcgttgcggcagccacgacttccgccagttctttggtgcgggtcatcggctgttcgcggttacgctcgacaatggcgcgggcaatgcgtttggcaaaacgctcttcaccataggttttcaatacccaggcgatatcggcttcttctgcggtttgtagccattcagcggctgactgcccacgggttgggtccatacgcatgtccagcggaccatcgcgcataaaggaaaagccgcgctcagcatcatcaagttgcggtgaagagacgccaagatcgaggagaatgccgtcgatcttgccgataagatcgcgctcggcaacgtattcgcccagcgcggagaaaggtccgtggatgatggagaagcgcggatcatcaatagtcttcgcaacggcgatagcctgcgggtcgcgatcgatcgccagcaaacgcccctcttcgccaagctgcgagaggatcagacgtgagtgaccaccgcgaccaaaagtcccatcaatgtagatgccatcaggacggatattgaggccattaacggcttcatccagcagcaccgtagtatgtttatagttttccatcattttatagagacaagtcctgcagtcgctccgataagtctccggtagccaactgctctgcgtcgatatcttccttgacctgttgatgccaggttgtttcatcccacagctcaaacttgttgaactgtccaaccagcatcacttcttttgtcagcccggcatgttgccgcagtactggcgcgattaacaatcgacctgcgccatccatctgacattcgctggcatgacctaacagtaggcgctgcacacggcgctcaaccgggttcatgctcgacagacgcgataatttttgctcgataatttcccattcaggcagggggtaaagcagcaggcacgggtgatgaatgtcaatggtgcaaaccatttgaccggcagcgttctcaagcagctgttcccgataacgggtaggcactgataagcgccctttgctgtcgagattgactaacgttgctccccggaacatgccagcctcaccccttattcccactttgccccacaatttcccactgaaaggagtttacggagcggaggaaaagcttgtcaagccagtcacaaggcataccgaggtaaaaaacccgatgtttacggctaatatcagcgttgtttattttacgtccaacgtgcgaagcaaattaacgttatgaatagctgtaagaaaaaatccctcatcgtcatcaccgttttaaaatgactcactattttccacagcaaatataaagtgtcagtttgcgacgcgagcggcattttaggacatatcttctctggttaacagtccctgttgcgtctgtgtggcgcttgatgccagcaggtttgcgcaaaaacaaagaaaagtgtttgttaaatcggcaattcatctctgcatgtaacaaaataatgcaaaaacgcgctgtcaatatcatttaattattgtgaatttcagcaggtgagttaattaacgggcgggtttaaaagcatttatcaataatagccaggaatagtcttatttactttaaggatattgatgtccattcccgtactcaacgcgccagagagaaattcacctggcgcgtacttttgttcgcggcttagctacggctgagcacgccgcggcgatagagattacgtttaatgcgcgttaaaccaggttttggcttacgcggttcatcgaggctcgccaggacaatctccagcacacgttctgcgacatcgcggtgacgttgagccactgccagcaccgggcactgtaagaagtcgagcagttcgttatcgccaaaggtggcaattgccaggtcagaaggcagtttgccgtcgcgacgtagcgtgacatccatcaccccttgcaacagcgcaaacgacgttgtgaacagcgcctgcggcatcggatgcgtttccagccatttttcgaataactgggcagctgcctcccgctcatagctgttggcataaaggaaatgcacttcgcgcggatcatctttccaggcagtacggaagccttgttcacgcaggaagctgacagaaagctccggcagcgcgccaagataaagcaccgtctcggcgggaaacttacgtaactcttccgccagcatttcggcatcatcctgatcggcaccaaccacgctggtgaagtgttcacgatcgagggcgcggtccagcgcgacaatcgggaacgggtcgttagcccagcgttgataaaaaggatgctcaggtggcaacgacgtcgaaacaataatggcatcaacctgacgctgtaaaaggtgctcaatgcagcgcatttcgttgtcgggctgatcttccgagcaggcaatcagcagttgataaccccgttgccgcgcctggcgttcaagatagttagcgatgcgggtatagctggtgttctccagatcggggatcacaagaccaatagaacgtgtgcgtccagcacgaagcccagctgccacggcgttcgggtggtaattgtgctcacgcaccacagccatgactttttcaacggttttgtcgctcacacggtattgcttcgctttgccgttaataacatagcttgcagtggtccgcgacactcccgccagccgagcgatttcatccagtttcacaattgccccttgcgtaaaatgtaaaaaccatagccattgtactggtatggattaaattcattaacatctaagcgcagaaaattaactgcggcaactgcttttattccaggttcccactgatttcgcaaaaaaagcccaacgtgacatgttgggctgcaaattgcgcattgagatcattctcaacgcattattttatcgccgcgcgaaagtccgaccacaccagagcgagcaacttccacaattttcgccacatcgcgaatcgatgctaaaaatgcatcaagcttatcgctggtgcctgctaattgaacggtataaagcgagggtgtgacatcgataatttgcccacggaatatttccgtattacgtttcacttcgtcacgcccgtaaccgctggcctgaattttcaccagcatgatttcccgctcaacgtgcgcgccctgccccaactcgctcacgcgcaagacatcgaccagcttgtgtaattgcttttcgatttgctcaagcactttttcatcgcccacggtctggatggtcatacgcgataatgtcggatcgtcggttggcgcaacggtcaggctttcaatgttgtagccacgctgggaaaaaaggccaatcacgcgggataacgcgcctgattcattttcgagtaagactgataatatccggcgcataatcaggttctctccgttttgcttaaccacatttcatccattccgcccccgcgaatctgcatcgggtagacgtgctcactgccatcgacggtaacatcaacaaacaccaggcgattattgcgcacctgttccagcgcctcgctaagtttgctttccagttcttgcggatgagagatctggatcccgacgtgaccataggcttccgccagacggacgaagtctggtaaggactgcatataagattgtgaatgacggccggaatagatcatgtcctgccactgcttcaccatccccagatagcggttattgagattcaccaccagtacgggcaactcatattgcaacgcggtagacagttcctggatgttcatctgaatactgccgtcaccagtgacgcaaaccacggtttcttctggcaacgccattttgacgcccagtgccgcaggtaaaccaaaacccatcgtgccgaggccgccagagttgatccagcgacgcggtttgtcgaatggataataaagcgcagcaaacatctggtgctgcccgacatcggacgtcacgtaagcgtccccatgagtcaaccgccaaagagtctcgatcaccgcctgcggtttaatcttttcactgtgagtgtcatatttcaggcactgacgagcgcgccactgttcaatctgctgccaccagtcgcggatctcatccagcggttgatgggcggattcttgcgacaggagttcaagcatttgttctaggacctggcgagcatcccccacaatcgggatatcagcagtcacggttttagaaattgaggttggatcaatatcgatatgcagaacagtggcatttgggcagtactttgccagattgttcgtcgttcggtcatcaaaacgtaccccgacggcgaaaatcacatccgcgttatgcatcgtcatattggcttcgtaggtaccgtgcattcccaacatgcccagtgcctggcgatgcgttgccggaaacgcccccagccccatcaaagaggaaacaacgggcagattcaacacctccaccgcttctttcaactgcagatggcagcccgccgtgattgccccaccgcctacgtagacaaccggtttttttgccgccaccagcgtttgcagagcgcgcttaatttgccctttatgcccggaggtcgtgggattgtaagaacgcatactgaccgactccggccagacatagggtaatttgttcgccggatttagaatatctttcggtaaatcaacgaccacgggtccaggacgaccacttgccgctagccagaaagcctttttcagcacctgcggaatgtcttccgtttgcttaaccagaaaactgtgtttaaccaccgggcgagaaatccccaccatgtcgcactcctgaaaggcatcataacctatcaacgaggtcgctacctgcccggaaaggacaactaatggaatggaatccatataagcggtggcaatgccagtaatcgcattggtcgcccctggacccgacgttaccagcacgacgccgacttccccggtcgcgcgcgccagaccatcggccatatgcaccgccgcctgctcatggcgaactaaaacatgatcgataccacccacggtatgcaatgcatcgtaaatatcaaggaccgcgcctccaggataaccgaatacttgtttaacgccctgatcgataagcgatcggacgaccatctcggctccagacaacatctccatggcctgcctcactgtttgacggaaaaaatgtgtaaaacacattaaccgtccgatcttgcttaagcaattggcagacagagacataaacacggggtaataagaataaacaggaggaaaggtgaaaagaaacgataaaatcctccattacagaggatgaaattgataataaatcggctgaatcctacaacttacagcaatttctctatttttttaattaatcctaaaatagagagcacaaacattcagaataaaattctacattcaataaaaaatgcagaataaaccagacattgatgtctgacctattctgcattcagttagcgtttgcaaattgagactaattgctcttccatccactgatggcctttatcgcgcccggcagcttcatgccaggagagataacaggttctgctgttttgttttaacggcagcggtaatacctgtaactctaaggattcagcgaactcttcagccaaccaacgcggcgcaatagcgaccagatgcgtttgcgacaccacgctaagtacgctcatcattgccatgccctgatacgcgatactggcttgcttatctaccgtgtcataccaggtttgactaaatgatgcgaaacgatcgagcgaaaccgcagcgtgttgttcgttataaacatcatgcttcagtaacgggcctttaattgttggatgatttttgctggctaccaacaccatttcatctttaaataatggcacactggtaaattcagggcgatggaagtcttcataactaatcacaaactccgtttcctgataacgcagctgatgttcagtgttctgatttaatgaagacttgaacataacatgtatatttggcgcaatctgctcaatgtgattataaatctgcgaggtcagaatgctgtctaacgggctgcaaacacaaagatgaaatacacgttcactgctcgcgggttcaaaacctgaaccaggcaattcattttgtactagttgcaatgcctgacgaactgagccaaaaagttgaaatgcgcgagcagtcggttgaataccacggccataacgaacaaaaagctcgtcattaaacatcaccttcaggcgtgcaacagcgttactgaccgcaggttgcgacattcccagagcatgagcggcacgggtgatgttttgctcctgcatcacggcatcgaaaacggttaataagttgagatcgaccatgcgtagctgtggcttgcttaactccgccgtctctggatgatctgtttgtacctctggcatacttaactccactgtcacacttaactccctttcccttattggaatgcagagaaataatcctcgagaatatgatttatcatgcatataaaataagaaaaagcaaaatgagtaaaattaggaaaacataaagatacaggttctgataaaaacagaatccactgccgagcaaagagtcatttactacagcataataatccataatgtttttgttgcgaaaacaatctaatcataactaccacgaatactcaatcatccacaaaatggattaaatgtgttttttaataattaatttatatgtttaatgcattaattcttaacattaattgatcaataatattcagcaaatgaatatcaaaaaattcgcaaaacatataattcaatacaaatcatcaggataggttttgtaacgcgtgcattttatccccctttccctcgttgattagatgcaaaaaattattctgaaatatgtcaaccgatgaaaagcatcggcggttaagcagaaattaatatcgcttgttttaaccaccgcagcacaattagctaattttacggatgccgaactcacaatggcgtgacgtttttattgcttcagggttgacatccgtttttgtatccagtaactctaaaagcatatcgcattcatctggagctgatttaatgactcacatcgttcgctttatcggtctactactactaaacgcatcttttttgcgcggtagacgagtgagcggcatccagcattaagccagcacgcagtcaaacaaaaacccgcgccattgcgcgggtttttttatgcccgaagcgaggcgctcaaaaagagacaaggacccaaaccatgagccagcaagtcattattttcgataccacattgcgcgacggtgaacaggcgttacaggcaagcttgagtgtgaaagaaaaactgcaaattgcgctggcccttgagcgtatgggtgttgacgttatggaagtcggtttccccgtctcttcgccgggtgattttgaatcagtgcagaccatcgctcgccaggttaaaaacagccgtgtatgcgcgttagctcgctgcgtggaaaaagatattgacgtggcagccgaatccctgaaagtcgccgaagccttccgtattcatacctttattgccacttcgccaatgcacatcgccaccaagctgcgcagcacgctggacgaagtgatcgaacgcgctatctatatggtgaaacgcgcccgtaattacaccgatgatgttgaattttcttgcgaagatgccggacgcaccccaattgccgatctggcgcgagtggtcgaagcggcgattaatgccggtgccaccaccatcaacattccagacaccgtgggctacaccatgccatttgagttcgccggaatcatcagcggcctgtatgaacgcgtacccaacatcgacaaagccattatttccgtacatacccacgacgatttgggcctggcggtcggcaactcactggcggcggtacatgccggagcacggcaggtagaaggcgcaatgaacgggatcggcgagcgtgccggtaactgttcccttgaagaagtcatcatggcgatcaaagttcgtaaggatattctcaacgtccacaccgccatcaatcaccaggagatatggcgcaccagccagttagttagccagatttgtaatatgccgatcccggcaaacaaagccattgttggcagcggcgcattcgcacactcctccggtatccaccaggatggtgtactgaaaaaccgcgaaaactacgaaatcatgacaccagaatctattggtctgaaccaaatccagctgaatctgacctctcgttcggggcgtgcggcggtgaaacatcgcatggatgagatgggatataaagaaagtgaatataatttagacaacctgtacgacgctttcctgaagctggcggacaaaaaaggccaggtgtttgattacgatctggaggcgctggccttcatcggtaagcagcaagaagagccggagcatttccgtctggattacttcagcgtgcagtcaggttctaacgatattgccactgccgccgtcaaactggcctgtggcgaagaagtcaaagcagaagccgccaacggtaacggtccggtcgatgccgtctaccaggcgataaaccgcatcactgactataacgtcgaactggtgaaatacagcctgaccgccaaaggccacggtaaagatgcgctgggtcaggtggatattgtcgccaactacaacggtcgccgcttccacggcgtcggcctggccaccgatattgtcgagtcctccgccaaagccatggtgcacgtactgaacaatatctggcgtgccgcagaagtcgaaaaagagttgcaacgcaaagctcaacacaacgaaaacaacaaggaaaccgtgtgatgtcgaagaattaccatattgccgtattgccgggggacggtattggtccggaagtgatgacccaggcgctgaaagtgctggatgccgtgcgcaaccgatttgcgatgcgtatcaccaccagccattacgatgtaggcggcgcagccattgataaccacggacagccgctgccgcctgcgacggttgaaggttgtgagcaagccgatgccgtgctgtttggctcggtaggtggtccgaagtgggaacatttgccgccagaccagcaaccagaacgcggcgcactgctgcctttgcgtaaacacttcaaattattcagcaatctgcgtccggcaaaactgtatcaggggctggaagcgttctgcccactgcgtgctgacattgccgcaaacggctttgacatcctgtgtgtgcgcgaactgaccggcggcatctatttcggtcagccaaaaggccgcgaaggtagcggacaatatgaaaaagcgtttgataccgaggtgtaccaccgttttgagatcgagcgtattgcccgcatcgcatttgaatctgcccgcaagcgtcgccacaaagtcacctcaatcgacaaagccaacgtgctgcaatcctctattttatggcgggagatcgttaacgagatcgccacggaatacccggatgtcgaactggcgcatatgtacatcgacaacgccaccatgcagctgattaaagatccatcacagtttgacgtcttgctgtgctccaacctgtttggcgacattctgtctgatgagtgcgcaatgatcactggctcaatggggatgttgccttccgccagcctgaacgagcaaggttttggtctgtatgaaccggcgggcggctcggcacccgatatcgcaggtaaaaatatcgccaacccgattgcacaaattctgtcgctggcgctgctgctgcgttacagcctggatgccgatgatgcggcttccgccattgaacgcgccattaaccgcgcattagaagaaggcattcgcactggggatttagcccgtggcgctgccgccgttagtaccgatgaaatgggcgatatcattgcccgctatgtggcagaaggggtgtaatcatggctaagacgttatacgaaaaattattcgacgctcacgtagtgtacgaagccgaaaacgaaaccccgctgttatatatcgaccgccacctggtgcatgaagtgacctcaccgcaggcgttcgatggtctgcgcgcccacggtcgcccggtacgtcagccgggcaaaaccttcgccaccatggatcacaacgtctctactcagacgaaagacattaatgcctgcggtgaaatggcgcgcatccagatgcaggagctgatcaaaaactgcaaagaatttggcgtcgagctgtatgacctgaatcacccgtatcaggggatcgtccacgtaatggggccggaacagggcgtgaccttgccggggatgaccattgtctgcggcgactcacataccgccacccacggcgcgtttggcgcactggcctttggtatcggcacttccgaagttgaacacgtactggcaacgcaaaccctgaaacagggccgggcgaagaccatgaaaattgaagtccagggcaaagccgcgccgggcattaccgcaaaagatatcgtgctggcaattattggtaaaaccggcagcgcaggcggtaccgggcatgtggtggaattttgcggcgaagcaatccgtgatttaagcatggaaggtcgtatgaccctgtgcaatatggcaatcgaaatgggcgcaaaagccggtctggttgcaccggacgaaaccacctttaactatgttaaaggccgtctgcatgcgccgaaaggcaaagatttcgacgacgccgttgcctactggaaaaccctgcaaaccgacgaaggagcaactttcgataccgttgtcactctgcaagcagaagagatttcgccgcaggtcacctggggcaccaatccaggccaggtgatttctgtgaacgacaatattcccgatccggcttcgtttgccgatccggttgaacgcgcgtcggcagaaaaagcgctggcctatatggggctgaaaccgggtattccgctgacagaagtggctatcgacaaagtgtttattggttcctgtactaactcgcgtattgaagatttacgcgcggcagcggaaatcgccaaaggccggaaagtcgcgccaggcgtacaagcgctggtggttcccggctccggtccggttaaagcccaggcggaagcggaaggtctggacaaaatttttatcgaagctggttttgaatggcgcttgccaggttgttcaatgtgcctggcgatgaacaacgaccgcctgaatccgggcgaacgttgcgcctccaccagcaaccgtaactttgaaggccgccaggggcgcggcgggcgcacgcatctggtcagtccggcaatggctgccgccgcggctgtgaccggacatttcgccgacattcgcaacattaaataaggagcacaccatggcagagaaatttatcaaacacacaggcctggtggttccgttggatgccgccaatgtcgataccgatgcaatcatcccgaaacagtttttgcagaaagtgacccgtacgggttttggcgcgcatctgtttaacgactggcgttttctggatgaaaaaggccaacagccaaacccggacttcgtgctgaacttcccgcagtatcagggcgcttccattttgctggcacgagaaaacttcggctgcggttcctcgcgtgagcacgcgccgtgggcattgaccgattacggttttaaggtggtgattgcgccgagttttgctgacatcttctacggcaatagctttaacaaccagctgctgccggtgaaattaagcgatgcagaagtggatgagctgtttgcgctggtgaaagccaatccggggattcattttgatgtagacctggaagcgcaagaggtgaaagcgggagagaaaacttatcgctttaccatcgatgccttccgccgccactgcatgatgaacggtctggacagcatcggcctgactctgcagcacgacgatgctattgcgtcttatgaagagaagcaaccggcgtttatgcgttagtttgtacaccgtccggcactcaatcgccaaaaagaaaaaagccagcagataatcactgctggcgtggcgattaacaccaatactcagtcacacatgatgtccgcaaatcagtagtcagaatgactcccctcccactgcatcagctcttcaagcatggttaatcgttgtgggacgcttaaccaacgcaaccagcacaacttcgctgtcgcggtaaaatagtgctgataaaactgacgcatggggcacctccttgcttcatcgttaggaattattgacttaatatagggaaaataaaattgctgtcttttgcgcaggagttccccttttatgccatctgctcgtctgcaacaacagttcatccgcctgtggcaatgctgcgagggtaaatctcaggagaccacgctcaacgaactggcagcgttactgagttgctcgcgtcgtcatatgcgcaccctgctcaacaccatgcaggatcgcggctggctgacgtgggaagcggaagtcgggcgcggtaaacgttcacgcctgacattcctctataccgggctggcgcttcagcaacagcgggcggaagacctgctggagcaggatcgtatcgaccaactagtgcagttggttggcgacaaagcgactgtgcggcaaatgctggtttctcatctgggccgcagcttccgccaggggcggcacatcctgcgcgtgctctactatcgtccgttgcgtaatctgctacctggcagcgcattgcgccgttctgaaacccatatcgcccggcaaatcttcagttcgctaacgcgcataaatgaggaaaatggggaactggaagcagacatcgcacaccactggcagcaaatatcaccgcttcactggcgtttctttttgcgtccaggagtccattttcaccatggtcgtgaactggaaatggacgatgtgatcgcctctttaaaacgaatcaatacgcttccgctctattcgcatattgctaacattgtgtcgccgacgccctggacgctggatatccatctcacgcaaccggaccgctggttgccgttactgctggggcaagttccggcaatgatcctgccgcgcgaatgggaaaccctcagtaactttgccagccatcccatcggcaccggtccgtatgcggtgatccgcaacagcaccaatcaactgaaaattcaggcattcgatgacttcttcggttaccgggcattaatcgacgaagttaacgtctgggttctgccggaaattgccgacgagccagccggagggctgatgctaaaaggtccacagggcgaggaaaaagagattgaaagccgcctggaggaaggttgctactatttactgttcgacagccgcacccatcgaggggcgaatcagcaagtcagagactgggtaagctatgtgctttctccgacgaatctggtctatttcgctgaggaacagtaccagcaactgtggttcccggcttatggactgctcccccgttggcaccatgcccgcaccataaagagcgaaaaaccggctggtctggaaagcctcaccctgaccttttatcaggatcacagcgagcatcgggtgattgccgggatcatgcagcagattctggcaagtcaccaggtcacgctggaaatcaaagagatcagctacgatcagtggcatgaaggagagatcgagagcgatatctggcttaacagcgccaactttacgctgccgctggatttttcgctgttcgcgcacttgtgcgaggtgccgctgctccaacactgtattccgatcgactggcaagccgacgccgcccgctggcgcaatggcgaaatgaatctggcgaactggtgccaacaactggtcgccagcaaagcaatggtgccacttatccaccactggctgatcattcaggggcaacgtagtatgcgcggcctgcgcatgaacaccctcggctggttcgattttaaatcagcgtggtttgcaccaccggatccatgattgctggttgataacaaaatcactacactaacgccgttctcaacggggtgccacgcagccgcgtgcgctgagaaaatacccgtcgaacctgatccggataacgccggcgaagggatttgaggctccttctcaagtcctttgccactcttttgtgaggtgcaaagtgttaaaaaaatgtcttcccctgctgttgctgtgcacagcgcctgttttcgctaaacctgttctgactgtttatacctacgattcctttgccgctgactggggacctggtccggtagtcaaaaaagcctttgaagcagactgtaattgcgaactgaaactggtggcgctggaagatggcgtttcgcttctcaaccgtctgcggatggaaggcaaaaacagtaaagccgatgtggtgctggggctggataacaatctgttagacgccgccagcaaaacagagctgtttgctaaaagcggtgtggcagcggaagccgttaacgttcctggcggctggaataatgacactttcgtaccgtatgattacggctatttcgccttcgtctatgacaagaacaaactgaaaaatccgccgcaaagcctgaaagaactggttgagagcgatcaaaactggcgggtgatttatgaagatccacgtaccagtacaccggggctgggtctgttgctatggatgcaaaaagtctatggcgataacgccccgcaagcctggcagaaactggcgaagaaaactgtcacggtcaccaaaggctggagcgaagcctacggcctgtttttaaaaggcgaaagcgatctggtactgagttacaccacctctccggcttatcacattctcgaagagaagaaagataactacgccgccacaaactttatcgaaggtcactatctgcaggtggaagttgccgcccgcaccgctgccagcaagcagccagagctggcgcaaaaattcctccagtttatggtttctccggcttttcagaatgcgatcccaaccggcaactggatgtatccggtagcaaacgtcactctgcctgcaggatttgaacaattgaccaaaccagccaccacgctagagttcacacccgccgaagtggcggcacaacgtcaggcatggattagcgaatggcaacgcgccgtcagccgttaattcccggctggttaattccaggcgtaagcgccgccacgctggtggtggcggttgcactggcggcgtttctcgccctgtggtggaacgcgccgcagggtgactgggtggcagtctggcaggacagctacctgtggcatgtggtgcgcttctccttctggcaggcgtttctctcggcgctgctctctgtcgtacccgcaatattcctcgcccgcgccctctatcgcaggcgctttcctgggcgacagatgctgttgcgtctgtgcgcaatgaccttgatcctcccggtgctggttgctgttttcggcattcttagcgtctatggtcgccagggctggctggcctcgctctggcaatcacttggtctggagtggaccttttcgccctacggcctgcaaggcattttgctggcccatgtgttttttaatctgccgatggctagccgtttattactccaggcactggaaaacattcccggcgaacaacgtcagcttgccgcccaacttgggatgcacggctggcattttttccgtttcgtcgaatggccgtggttacggcgacaaatcccgccggttgccgcactaatctttatgctctgtttcgccagcttcgccaccgtgctatcgctgggcggcggtccgcaggcgaccactatcgagctggcaatctatcaggcgctgagttacgactacgatcctgcccgcgcggcaatgctggcgctgatccagatggtgtgctgcctcgggctggtgctgttgagtcagcgattgagtaaggccattgcgcctggtaccacactgctgcaaggctggcgcgacccggacgatcgtctgcatagtcgcatttgcgacacggcgttaattgtgctggcgctgctgctgttgctgccaccgttactggcggtgatcgtcgatggggtaaatcgccagttgccggaagtgctggcacaaccggtgctgtggcaggcgctgtggacctcgttgcgtattgcgctggcggcaggcgtattgtgcgtagtgctgaccatgatgctgctatggagcagtcgcgaacttcgggcgcggcagaaaatgctggcgggtcaggcgctggagatgagcggcatgttgatcctcgccatgccggggattgtgctggctacgggcttctttttactgctcaacaacactatcggcctgccacaatctgctgacggcattgtgattttcaccaatgcgttaatggcaatcccttatgcgctgaaagtgctggaaaacccgatgcgcgatatcaccgcccgctacagcatgttgtgtcagtcgctgggcattgaaggctggtcacgcttaaaagtggtggagctgcgcgccctgaaacgtccactggcgcaggcgctggcctttgcttgtgtgctgtcgattggtgattttggcgtggtggcattgttcggtaacgatgatttccgtaccctgccgttttatctctaccagcaaattggctcctatcgcagccaggacggcgcggtcaccgcgttaattctgctgctgctctgttttctgctgtttaccgtgattgaaaaaataccggggcgaaatgttaaaactgactgatatcacctggctttaccaccatttgccgatgcgttttagcttaacggtggaacgcggcgagcaggtggcgatcctcgggccaagcggcgcaggtaaaagtaccctgcttaatttgatcgccggttttctgacgccagccagcggtttgctgactatcgacgacgtagatcacaccacgacgccgccgtcacgccgtccggtgtcgatgctgtttcaggagaacaacctgttcagccatctgacggtcgcgcaaaacatcgggctggggctaaatccggggttgaaactaaatgcggcgcagcagaagaaaatgcacgcgattgcccaccagatggggattgataatttaatggcgcggttacctggcgagctttccggcggtcagcgacagcgcgtggcgttagcgcgttgtctggtacgcgaacagcccattttattgctcgatgaaccgttttccgcactcgatccggcgctacgtcaggagatgctgacgctggtgagttcgagctgccaacagcaaaaaatgacgctcttgatggtgtcgcacagtgtggaagatgcggcgcggatcgccacgcgctcggtggtggtcgccgacgggcgtatcgcctggcagggtaagaccgatgagttgttgagcggtaaggcgagtgcttcggcgctgttgggaattaaaggttaatatgcactgtcggatgcggcgtgaacgccttatccgacctacgggtagtgcgttttgcaggcctgataagacgcggcaagcgtcgcatcaggcaacccgcacaaggctatcccctaaaccccaaccactttacgcaaaatatcgatatacaccggcatcaacgggtggcgaattaacaccaccagcgccaccacgccgatggcagaaatcaacggcgtcagccacaacaaacgaccgcgggacaaataatgactcaaacggtcagtcgctttaccgctgcgccataaccgccagcacagccagcctccaacccacaaaaacaccgctgttgccagcagcaaccatttaaactcaccgctctgcatcccggcaggaatatcgatcgccgcacccgccagaatccccggcaggaagtaaaactgtggccacagcaagcagccgataatattcggcgtaataaattttgccaccgggagatccagcattcccgccaccattggcaccagcggacgcgtcggaccgacaaaacgaccgaccagaatggtgaacatgctgtgctgatgcagcgcatgttcggttttatcgagtaatgctttgttcttcttcagaaatgaccagcgatgcaacggctttttaaaacgccagcccagccagaaggagatccagtcgcccatcaggcagccaataatccccgccagccaggcgtaccagaaacttaactcaccgctaccaatcagcgctcccagccccgccatcagcaccgtaccgggtagaatcaaaccgaccagcgccagcgactccagaaaggccaccaacaccaccgccatcaatgaatacacggtggattgggtaataaagtgttccagcaatgcttgcataatgtgcctgtcaaatggacgaagcagggattctgcaaaccctatgctactccgtcaagccgtcaattatctgattcgttaccaattatgacaacttgacggctacatcattcactttttcttcacaaccggcacaaaagacaccctctgcctatcattcgatagtctcaaaatattccacctgcagagaatcacggtgctcaatgatgcaataacgctggaaattatttgcataatcacttttatcatgaaaaaaccatatacaatcgttttgtagactcggtcccattcttttcaaaaaatctattagctttgctttctgaagaaaaatgttatctatatttcgccatgtaacaatcactcttgtttgcatatcatcaacattatagtaatagctatactcggctacgtttgatatgtttggcaaatttcgcaaactctctggcgtataaaggaaaaatggggaaagttcatgctgtgtatagtgatgttcctttgacatcaatgagatataagcatagaaaaatataaagaataaaactaaaaatgataataaaatataaatatattttgacatctctactcacgacctgtgcggataatgagggtttaagaaaagaaaaagcggtctttcaaagggagattctgaaaactttatagctcccgaacttgataatgaactatacaactcatgatttattctgtttttatctttataataattagtaacaggtctattattatattgattatataacaatattgaaaaagactcatctaatggctttatataatttaaccattctggaagcttcttttttattagttgattttttttaaaaggaggatgggttgtaaataagaatggcgtaaactcagtatttttaaaattccctggcgctccatatgtatcccatatttgtaaggcttttgtgtaagataaaggttttgccaataaaagtggatcggggcctgttccaaatacacgataaaaaccaatcaagtctgagactaaatcttctgcactaaatccgctatcagtataccagttaaaaataaatgagttttgccatgcttcaaacctcttcgcagttccatacattaacgttaaggcaactcttgctttaagagtgggtgaaagacatgaacgaaccataaccttcgtataaacaccggtatgaaatgtaagatctactcctaatatttttttccgaattcccatttcctgatgataatcaacaggaaaataccaatcatgaaattcatcgtaatatgttgaaaaatgttcttgctccaattttctttttaatattctggcatcttgtccctgagcatgccccaaatcgatccaacctaactcttcggtataaactaatccatactttttcgttgttgcaaatattccatcagtaatatcgttacgtttgctcatcacaatctcccctcaaaaaaaacgtatagcaaataatatcaataaggaaaaatattatttttcaatatttttttgtatacaattcattttatgaatgaatttacaaagatagctgcgcctgatgccgctacacttttgccagaccatgttctcctctgagggagtaactggcgtttttcatagaatgccgtacttttttcaacaactgccacatcgaacggcatttatggtggcgtgaagtgcctgccataaccgctcaatgtggtgttcctacgatgaacaaaccgcttgatatattctcctgatgcaaccggacaatatgttcatgatgggtatcccgatacataagccttcgttttatttttacaaaaagaaatcgttgtcgatattttatcaagaaaaaaaataattcaggtaaaacgattcaactaaaaataactaaaattaatcccccgtgaaatatataaataacgtcagatgaagaaagcaagggggttcccccccttctttcttattattcacaacctgccctaaactcgctcggactcgccccggtgcattttttaaatactcgcgagaaatagagttgatcatcaaaaccgacattgcgaccgacggtggcgataggcatccgggtggtgctcaaaagcagcttcgcctgactgatgcgctggtcctcgcgccagcttaatacgctaatccctaactgctggcggaacaaatgcgacagacgcgacggcgacaggcagacatgctgtgcgacgctggcgatatcaaaattactgtctgccaggtgatcgctgatgtactgacaagcctcgcgtacccgattatccatcggtggatggagcgactcgttaatcgcttccatgcgccgcagtaacaattgctcaagcagatttatcgccagcaattccgaatagcgcccttccccttgtccggcattaatgatttgcccaaacaggtcgctgaaatgcggctggtgcgcttcatccgggcgaaagaaaccggtattggcaaatatcgacggccagttaagccattcatgccagtaggcgcgcggacgaaagtaaacccactggtgataccattcgtgagcctccggatgacgaccgtagtgatgaatctctccaggcgggaacagcaaaatatcacccggtcggcagacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcgttaaacgagtatcccggcagcaggggatcattttgcgcttcagccatacttttcatactcccgccattcagagaagaaaccaattgtccatattgcatcagacattgccgtcactgcgtcttttactggctcttctcactaatccaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttttcgcaactctctactgtttctccatacccgtttttttggatggagtgaaacgatggcgattgcaattggcctcgattttggcagtgattctgtgcgagctttggcggtggattgcgccaccggtgaagagatcgccaccagcgtagagtggtatccccgttggcagaaagggcaattttgtgatgccccaaataaccagttccgtcatcatccgcgtgactacattgagtcaatggaagcggcgctgaaaaccgtgcttgcagagcttagcgccgagcagcgcgcagctgtggtcgggattggcgttgacacaaccggctcgacgcccgcaccgattgacgccgacggtaacgtcctggcgctgcgcccggagtttgccgaaaacccgaacgcgatgttcgtattgtggaaagaccacaccgcggttgaagaagcggaagagattacccgtttgtgccacgcgccgggcaacgttgactactcccgctatattggcggtatttattccagcgaatggttctgggcaaaaatcctgcatgtgactcgccaggacagcgccgtggcgcaatctgccgcatcgtggattgagctgtgcgactgggtaccagctctgctttccggtaccacccgcccgcaggatattcgtcgcggacgttgcagcgccgggcataaatctctgtggcacgaaagctggggtggcctgccgccagccagtttctttgatgagctggacccaatcctcaatcgccatttgccttccccactattcactgacacctggactgccgatattccggtgggcaccttatgcccggaatgggcgcagcgtctcggcctgcctgaaagcgtggtgatttccggcggcgcgtttgactgccatatgggcgcagttggcgcaggcgcacagcctaacgctctggtaaaagttatcggtacttccacctgcgacattctgattgccgacaaacagagcgttggcgagcgggcagtgaaaggtatttgcggtcaggttgatggcagcgtggtgcctggatttatcggtctggaagcaggccaatcggcgtttggtgatatctacgcctggtttggacgcgtactcagctggccgctggaacagcttgccgcccagcatccggaactgaaagagcaaatcaacgccagccagaaacaactgcttccggcgctgaccgaagcatgggccaaaaatccgtctctggatcacctgccggtggtgctcgactggtttaacggtcgccgcacgccaaacgctaaccaacgcctgaaaggagtgattaccgatctgaacctcgccaccgacgctccgctgctgttcggcggtttaattgccgccaccacctttggcgcacgcgcaatcatggagtgctttaccgatcaggggatcgccgtcaataacgtgatggcgctgggcggcatcgcgcggaaaaaccaggtcattatgcaggcctgctgcgacgtgctgaatcgcccgctgcaaattgttgcctctgaccagtgctgtgcgctcggtgcggcgatttttgctgctgtcgccgcgaaagtgcacgcagacatcccatcagcccagcaaaaaatggccagtgcggtagagaaaaccctgcaaccgcgcagcgaacaggcacaacgctttgaacagctttatcgccgctatcagcaatgggcgatgagcgccgaacaacactatcctccaacttccgccccggcacaggctgcccaggccgttccgactctataaggacacgacaatgacgatttttgataattatgaagtgtggtttgtaattggcagccaacatctttacggcccggagactctgcgccaggtgacgcaacatgcggaacacgttgttaatgcactgaatacagaagcgaagttgccctgcaaactggtgctgaaaccgctgggcaccacgccggatgaaatcaccgctatttgccgcgacgcgaattacgacgatcgttgcgctggtctggtggtgtggctgcacaccttctccccggccaaaatgtggatcaacggcctgaccatgctcaacaaaccgttgctgcaattccacacccagttcaacgcggcgctgccgtgggacagcatcgacatggactttatgaacctgaaccagaccgcgcatggcggtcgcgagttcggcttcatcggcgcgcgtatgcgtcagcaacatgccgttgttaccggtcactggcaggataaacaagcacatgagcgtattggctcctggatgcgtcaggcggtctctaaacaggatacccgtcatctgaaagtctgccgttttggcgataacatgcgtgaagtagcggtcaccgatggcgataaagttgccgcacagatcaagtttggtttctccgtcaatacctgggcggttggcgatctggtgcaggtggtgaactccataagcgacggcgatgttaacgcgctggtcgatgagtacgaaagctgctacaccatgacacctgccacacaaatccacggcgaaaaacgacagaacgtgctggaagcggcgcgtattgagctggggatgaagcgtttcctggaacaaggtggcttccacgctttcactactacctttgaagatttgcacggcctgaaacagcttccgggtctggccgtacagcgtctgatgcagcagggctacggctttgcgggcgaaggcgactggaaaactgccgccctgcttcgcatcatgaaggtgatgtcaaccggtctgcagggcggcacctcctttatggaggactacacctatcacttcgagaaaggtaatgacctggtactcggctcccatatgctggaagtctgtccgtcgatcgctgtggaagagaaaccgatcctcgacgttcagcatctcggtattggcggtaaagacgatcctgcccgcctgatcttcaacactcaaaccggtccagccattgtcgccagcctgattgatctcggcgatcgttaccgtctgctggttaactgcatcgacacggtgaaaacaccgcactccctgccgaaactgccggtggcgaatgcgctgtggaaagcgcaaccggatctgccgaccgcttccgaagcgtggatccttgccggtggcgcgcaccataccgtcttcagccatgcgctgaacctcaacgatatgcgccagttcgccgagatgcacgacattgaaatcacagtgattgataacgatacccgccttccagcgtttaaagacgcgctgcgctggaacgaagtgtattacggatttcgtcgctaagtagccgcatcaggtatgtaacgcctgatgcgacgctgacgcgtcttatcaggcctacgcgttccggatttgtaggccggataagcaaagcgcatccggcattcaccgcctgatgcgacgccgacgcgtcttatcaggcctacacgctgcgattttgtaggccggataagcaaagcgcatccggcacgaaggagtcaacatgttagaagatctcaaacgccaggtcttagaagccaacctggcgctgccaaaacacaacctggtcacgctcacctggggcaatgtcagcgccgttgatcgcgggcgcggcgtcctggtgatcaaaccttccggcgtcgactacagcaccatgaccgctgacgatatggtcgtggtcagcatcgaaaccggtgaagtggttgaaggtacgaaaaagccctcctccgacacgccaactcaccggctgctctatcaggcattcccgtctattggcggcattgtgcacacacactcgcgccacgccaccatctgggcgcaggcgggtcagtcgattccagcaaccggtaccacccacgccgactatttctacggcaccattccctgcacccgcaaaatgaccgacgcagaaatcaacggtgaatatgagtgggaaaccggtaacgtcatcgtagaaaccttcgaaaaacagggtatcgatgcagcgcaaatgcccggcgtgctggtccattctcacggcccgtttgcatggggcaaaaatgccgaagatgcggtgcataacgccatcgtgctggaagaagtcgcttatatgggtatattctgccgtcagttagcgccgcagttaccggatatgcagcaaacgctactggataaacactatctgcgtaagcatggcgcgaaggcatattacgggcagtaatgactgtataaaaccacagccaatcaaacgaaaccaggctataatcaagcctggttttttattggattttcagcgtggcgcaggcaggttttatcttaacccgacactggcgggacaccccgcaagggaccgaagtttccttcttgctggcaacggacaacgggccgttgcaggttacgcttgcgccgcaagagtccgtggcatttattcccgccgatcatgttccccgcgctcagcatattttgcagggtgaacaaggctttcgcctgacgccgctggcgttaaaagattttcaccgccagccggtgtatggcctttactgtcgcgcccatcgccagttgatgaattacgaaaagcgcctgcgtgaaggtggcgttaccgtctacgaggccgatgtgcgcccgccagaacgctatctgatggagcggtttatcacctcgccagtgtgggtcgagggtgatatgcgcaacggcgctatcgttaatgcccgtctgaaaccgcatcccgactatcgtccgccgctcaagtgggtttctattgatattgaaaccacccgccacggtgagctgtactgcatcggcctggaaggttgcgggcagcgtatcgtttatatgctggggccagagaatggcgacgcctccgcgctcgattttgaactggaatacgtcgccagccgcccgctgctactggaaaaacttaacgcctggtttgcgactcatgatcctgatgtgatcatcggttggaacgtggtgcagttcgatctgcgaatgctgcaaaaacatgccgagcgttaccgtattccgctgcgtctggggcgtgataacagcgagctggagtggcgcgagcacggctttaaaaacgacgtcttttttgctcaggccaaagggcgactgattatcgacggtatcgaggcgctgaaatccgcgttctggaatttctcttcattctcgctggaaaccgtcgctcaggagttattaggcgaaggaaaatctatcgataacccgtgggatcgaatggacgaaattgaccgccgtttcgccgaagataagcctgcgctggcaacttataacctgaaagattgcgagctggtgacgcagatcttccacaaaactgaaatcatgccgtttttgctcgaacgggcgacggtgaacggcctgccggtagatcgacacggcggttcggtggcagcgtttggtcatctctattttccccgtatgcatcgcgctggttatgtcgcgcctaatctcggcgaagtgccgccgcacgccagccctggcggctacgtgatggattcgcgacctgggctttatgattcggtgctggtgctggactacaaaagcctgtacccgtcgatcatccgcacctttctgattgatcccgtcgggctggtggaaggcatggcgcagcctgatccagagcacagtaccgaaggttttctcgatgcctggttctcacgggagaaacattgcctgccggagattgtgactaacatctggcacgggcgcgatgaagccaaacgtcagggtaataagccgctttcgcaggcgctgaagatcattatgaatgccttttatggtgtgctcggcaccaccgcctgccgtttcttcgatccacgcctggcatcgtcgatcaccatgcgtggtcatcagatcatgcggcaaaccaaaaccttgattgaagcgcagggctatgatgttatctacggcgataccgactcaacgtttgtctggctgaaaggtgcacattcggaagaagaagcagcgaaaatcggtcgtgcactggtgcagcacgttaacgcctggtgggcggaaacgctgcaaaaacaacggctgaccagcgcactggaactggagtatgaaacccatttctgccgttttctgatgccaaccattcgcggggccgataccggcagcaaaaagcgctacgccggactgattcaggagggcgacaaacagcggatggtgtttaaagggctggaaaccgtgcgcaccgactggacgccgctggcccagcagtttcagcaggagctttacctgcgcatcttccgcaacgagccatatcaggaatacgtgcgcgaaaccatcgacaagctgatggcgggcgaactggacacgcggctggtttaccgtaaacgccttcgccgtccgctgagcgaatatcagcgtaatgttccgcctcatgtacgcgccgctcgccttgccgatgaagaaaaccataagcgcggtcgccccttgcaatatcagaaccgcggcaccattaagtacgtatggaccaccaacggcccggagccgctggactaccaacgttcaccgctggattacgaacactatctgacccgccagttacaacccgtggcggagggaatactcccttttattgaggataattttgctacacttatgaccgggcaacttgggctattttgagcaaaaaaagagttcgccagataccattttgatgcgtgacgaatgctttgccatccagtaccatagcgccctttccattcctggacctgaataacaccactacctcataagcacggtagcgggtggttattgcctgcaattaaagatatagagccgaacacatatgccttttacacttggtcaacgctggatcagcgatacagaaagcgaattgggacttggaaccgttgtcgcggtggatgcgcgaactgtcactttacttttcccatctactggtgaaaaccgtctgtacgcacgcagtgattcccccgtgacccgcgtgatgttcaaccctggtgataccattaccagccatgacggctggcagatgcaagtcgaagaagtaaaagaagaaaatggcttgctgacctatatcggtactcgccttgatactgaagagtccggcgtggccctgcgtgaagttttccttgatagcaaactggtgttcagcaaaccgcaggaccgtctgtttgccgggcagattgaccgtatggaccgctttgcgctgcgttatcgcgcgcgtaagtattccagcgaacagttccgtatgccgtacagcggcctgcgcggtcagcgtaccagcctgatcccgcaccagctcaacatcgctcatgatgttggtcgccgccacgcgccgcgcgtcctgctggctgacgaagtgggtttagggaaaaccattgaagccgggatgatcctgcatcagcaactgctctctggcgctgctgaacgtgtgctgattatcgtcccggaaaccttacagcatcagtggctggtagaaatgctgcgccgtttcaacctgcgctttgcgctatttgatgatgagcgttatgccgaagctcagcacgatgcttacaacccgttcgacaccgaacagctggtgatttgctcgctggattttgcccgtcgtagcaaacagcgtctggaacatctctgtgaagccgagtgggacctgctggtggtcgatgaagcgcatcacctggtgtggagcgaagatgcgccgagccgtgaatatcaggccattgaacaactggcagagcacgtgcccggcgttctgctgctgaccgcaaccccggaacaactggggatggaaagccacttcgcccgtctgcgtctgctggacccgaaccgtttccacgattttgcgcaattcgttgaagagcagaaaaattatcgtccggttgcggacgccgttgccatgctgctggctggtaacaaactcagcaatgacgaactgaacatgctcggtgagatgatcggcgagcaggatatcgagccgctgttgcaagcagcaaacagcgacagcgaagatgcccagagcgcccgtcaggagctggtttcgatgctgatggatcgccacggcaccagccgcgtgctgttccgtaacacccgtaacggtgtgaaaggcttcccgaaacgcgagctgcacaccattaagctgccgctgccgacgcagtatcagacggctattaaagtctccggcattatgggcgcacgcaaaagtgcggaagatcgcgctcgcgatatgctctacccggagcgtatttatcaggaatttgaaggtgataacgccacctggtggaacttcgatccgcgcgttgagtggctgatgggctacctgaccagccatcgctctcagaaagtgctggtgatctgcgccaaagctgccactgcgctgcaactggagcaggtactgcgcgaacgtgaaggtattcgcgccgcggtattccacgaaggtatgtcgattatcgaacgtgaccgcgctgccgcctggtttgccgaagaagacaccggcgcgcaggtactgctgtgctcggaaatcggttctgaaggacgtaacttccagttcgccagccacatggtaatgtttgacctgccattcaacccggatctgctggagcagcgtattgggcgtctggatcgtatcggtcaggcgcacgatattcagatccatgtgccttatctggaaaaaactgctcagtcggtgctggtgcgctggtatcacgaaggtctggatgcattcgagcacacctgcccgaccggacgcactatttacgatagcgtatacaacgatctgattaactatctggcttcaccggatcaaaccgaaggctttgacgatctgatcaaaaactgccgcgagcaacatgaagcgctgaaagcacagctggaacaaggtcgtgaccgcctgctggaaatccattccaacggtggcgaaaaagcccaggcactggcagaaagcattgaagagcaggatgacgataccaacctgatcgccttcgccatgaacctgttcgatattatcggtatcaatcaggacgatcgcggcgacaacatgatcgtgctgacgccgtccgatcatatgctggtgccggacttccctggcctgtcggaagatggcatcaccatcaccttcgaccgtgaagtggcgctggcgcgtgaagatgcacagtttattacctgggagcatccgctgatccgcaacggtctggatctgatcctttctggcgataccggtagcagcacgatttcactgttgaaaaacaaagcgttgccggtaggtacgctgttggtggaactgatttatgtggttgaagcccaggctccgaagcagttgcagctcaaccgcttcctgccaccgacgccggtacgtatgctgctggataaaaacggcaacaacctggcggcgcaggtagagtttgaaacctttaaccgccagcttaacgcggttaaccgtcacaccggcagcaagctggttaacgccgtgcagcaggatgttcacgctatccttcagctgggggaagcgcagatcgagaaatctgcccgtgcattgattgatgcagcgcgtaacgaagccgacgaaaaactgtctgccgagctgtctcgtctggaagcgctgcgtgcagttaacccgaacattcgtgacgacgaactgaccgccattgagagcaaccgtcagcaggtaatggaaagcctggatcaggcaggctggcgtctggatgccctgcgtttgatcgttgtgacgcatcagtaacggagccgaagatggggatggaaaactacaatccgccgcaggacccctggctggttgtcctgtatcaggatgaccatattatggtggtcaacaagccgagcggtttgttgtctgtgccgggtcgtctggaagagcacaaagacagcgtgatgacgcgcattcagcgtgattatccgcaggcagaatcggtgcatcgtctggatatggctaccagcggcgtgattgtagtggcgctgaccaaagccgcggagcgggagttaaaacgccagttccgcgagcgcgagccgaaaaagcagtatgtggcccgcgtctgggggcatccatcccctgcggaaggtctggtggatctgccgctgatttgcgactggccaaaccgcccgaaacagaaagtctgttacgaaacaggtaaacctgcgcagacggaatatgaagtggtggaatatgcagcggataacacggcaagagtggtgttaaaaccgattaccgggcgttcgcatcagctgcgtgtgcatatgctggcgctgggtcatccgattctcggcgatcgtttttatgcatcaccagaagcgagagcaatggcaccgcgtttgttgctacatgcagagatgctgacgattacccatccggcgtatggcaatagtatgacgtttaaagcaccagcggatttttaatagtcacgctggcgaagttcggtaggccggagaaggcgttcacgccgcatccggcaattttgcgccgattgtctgatgctgctcgccggatgcgacgctggcgcgtcttatccggcctaccgcgtcttatcaggcctacacgttgaaacttatttaaaccctttctgctgctttatcagctcataggcctgctgaatttcctgcgctttctgcttcgccatctccatcatctctggcggcaaacctttcgccaccaacttatcgggatggtgttcactcatcagcttacggtaggcacgtttgatggtggtcgcatcatccgtcggcttcacgcccagcacattacaggcatcttccagcgtcgggccacgctgcgcttgctgccagttaccaccgccagattgctgctgataaccgccaccaaactgtgcaccgccctgcatcatgcgcaaaaactggtcaaactgggcgcgggagatgcctaactcttcggcaatgacatacagcaccgcccgttcattcgggtgcagtgaaccatcagcaaacgccgcctgaatctggatctccagaaacatacgaattaagtcaaaacgaccaaagcagacactgcgaaactggcgcatcttttcgcgcagcgggtaattgtctgattttcccacccggaatgcattttgcgccgcagtacgggaagcgccatgcagattcattcggtccatcaactgactggcgatatgaatatcagcctccgtgacgcgacctttggatttggttaaatgccccatcacttcaaaagtggtggcaaaaaacagcgcctgacgctcacgctggttggcgaaccacgccattttacggctacgggctttatcaaacatatggccaattaacaggcccaatactacgccccaaaagccgccgcccattattaaggccacggccacaccaatgatttttccccaatactgcatatattccccaaatcgacacacggatatcagggctatctcccacaatataaaggcgcttttacccatttctggctgcggtctattgtgagacatcgcctataatttgcattatcatacctgtcattcaatgccgtgcctaacaccacagacgctattcggacaggattaacactagcgtagagatgacgagtacgttagtctctgaccgtttgtcacgcgcaacgttaccgatgatggaacaataaaatcaacgtatgaaaaaacgtatccccactctcctggccaccatgattgccaccgccctttatagtcaacagggactggcagccgacctcgcctcacagtgcatgttgggcgtgccaagctatgaccgtcctctggtacagggcgataccaatgacttacccgtgactatcaatgctgaccacgcgaaaggggactacccggatgacgccgtgtttactggcagcgtggatatcatgcagggtaacagccgtctgcaggccgacgaagtgcagctccatcaaaaagaggcaccaggacaaccggagccggtacgtaccgttgatgcgctcggtaatgtccattacgacgataaccaggtgatcctcaaagggccgaaaggctgggcgaatctgaacaccaaagataccaacgtctgggagggtgattaccagatggtgggtcgccagggccgcggtaaagcggacctgatgaaacaacgtggcgaaaaccgctataccattctggataacggtagctttacctcctgtctgccgggttctgacacctggagcgtggtaggtagcgaaattattcatgaccgcgaagaacaagttgcggagatctggaacgcccgctttaaggtgggtccggtaccgatcttttatagcccctatttgcagttgccggtgggtgacaaacgtcgctctggtttcttgatcccgaacgccaagtacaccaccaccaactactttgagttctacctgccatattactggaacatcgcgccaaatatggatgccaccatcacgccgcattatatgcatcgtcgtggcaatatcatgtgggagaacgaattccgctacctctcccaggcgggcgctggcttgatggaactggactatctgccttcagataaagtctataaagatgaacacccgaacgatgacagttcacgtcgttggttattctactggaaccactccggggtcatggatcaggtgtggcgtttcaacgtcgactacaccaaggtcagcgatcctagctacttcaatgatttcgataacaagtacggttccagtaccgacggctacgcaacgcaaaaattcagcgttggctatgcggtgcaaaacttcaatgccaccgtttcaa

SEQ ID NO: 10027 - DNA, 41964 bp, Escherichia coli
ttaagagattctgatttaaaagaagaagaaaatcagcccgacaatgagaacaatatcggcaagcaatgggcaaaaaatcccttgccagagaaccttctgcggacgaaagcccacgccgtgaatcacaccagcacagacggcccacataagcagtaagccatgccagatttccagttcactggtcttcgcggcgaaacgtgatgggtcccaaaacatacatcctgctaacagaagtgccatcacgaaggaaagcgcccgcagggggcgcttgtccattaccgcatacaaggttgcgataatcttactcatcagatgtcttcttgaccggctttgcctgattcgacgtgctcaagcgccagcgcggtgattaccccaaacgaacaggcaagaagcgttcccagaatccatgcgaaataccacatttttagctccttacttagtacagagagtgggtgttacgttcaatatcttctttggtgatacgaccgaacattttccagtaacaccaggcggtgtagagcagaatgatcggtaccagaaccaccgcaacccaggtcatgacgttaagcgtcagctggctggaagttgcatcccacattgtcagacttgcgttcatcatggtgctggacggcatcacaaacgggaacattgcgataccggcagtcaggatgatgcaggccagcgtcagggaggagaatacaaacgcccacgcggctttatccatacgtgcagtcaggatggtcagcagcggcagaaccacacccagtgccggaatagcccacagaattggcgtgttgttgaagttaaccagccatgcgccagcttcacgaaccacttctttattcagcgggttagaggctgcgtaatggtccattgtcgatttcacgacataaccatcgataccgtacatcacccatacgccagccagtgcgaagcagaccagcgtcaccagtgccgccacctgagccgttgcacgggtacgcaggtgcagttcgcccacggtacgcatttgcagataggttgcgccctgagtaatgatcatccctacgctcaccacacctgccagcaggccgaacgggttaagcagctggaagaagttaccggtgtagtacagacgcagatattcatcaacgttgaatggtacgccctgcaacaggttaccgaacgctacaccaatcaccagcggcggaacgaagctaccaatgaagatgccccagtcccacatgttacgccagcgggtttcttcaatcttggagcggtagtcaaaaccgaccggacggaagaacaaagacgccagcacgaggatcatcgccacatagaagccggagaacgcagcggcatagaccatcggccaggcagcaaacagtgcgccgcctgcggtgatcagccaaacctggttaccgtcccagtgtggtgcgatggagttaatcataattcgacgctcggtgtcgttacgaccgaggaaacgggtgagcatgcccacccccatgtcgaaaccgtcagtgactgcaaaaccaatcagcagaacgccaaccagcagccaccagataaaacgcaatacttcataatcgatcatttgacgactcctgtcttagcgtgccggctgagtagtcgtggaagactgctcaaagtgatagcgaccggttttcaggctgcttgggccgaggcgtgcaaacttgaacattaagaacaattctgccaccaggaacagggtatacaggccgcaaatcagcaccatcgagaagatgagatcgcctgcggtcagtgacgagttcgccacagctgtcggcagcacttcaccgatagcccacggttggcggccatattcagccacgaaccagcccgcttctacagcaatccacggcagcggaataccgtacagcgcggcgcgcagcagccattttttctcgccaatgcggttgcggatgacactccagaaagagagcgcgatgattgccagcagcaggaagccacacgccaccatgatacggaacgcaaagtacagcggcgctacacgcggaatggagtctttggttgcctgttgaatctgagcttcagtcgcatcagccacgtttggcgtatagcgtttcagcagcagaccgtaaccgagatctttcttcatgctattgaactggtcacgaacggcctggtcagtagaaccagaacgcagttgttcgagcagagagtacgccttcatcccgttacgaatgcgttcttcatgctgcaccatcagttctttcagaccgataactggagtatccacggaacgcgttgcaatgatgcccagcgcgtaagggatctggatcgcaaatttgttcgtttcctcttcctgatcaggaatgccgaacagagtaaaggcagcaggtgcaggttgcgtttcccactcggcttcgatagcagccagtttggttttctgcacgtcgcccatttcgtagccggattcatcacccagaacaataacagacagaacggcagccataccgaagctggcagcgatagcaaaggagcgtttagcgaaggcgaagtcacgacctttcagcatataccatgcgctgataccgaggatgaacattgcgccagtcacataaccagaagctacggtgtgaacgaatttcacctgagcaaccgggttaagcaccagctcggagaagctcaccatctccatacgcatagtttcaaagttgaaatcggacgcgattgggttttgcatccagccgtttgcaaccagaatccacagtgcggacaggtttgaaccgagcgccaccagccaggtgacacacatatgctgaactttacccagacgatcccaaccgaagaagaacagacctacaaaggtggattcgaggaagaaggccatcagaccttcgattgccagcggcgcaccgaagatatcccctacatagtgggaatagtaagaccagttagtcccgaactggaactccatggtcagaccggtagccacacccagagcaaagttgataccaaacaacttgccccagaacttggtcatatctttataaatctgtttgccggaaaggacgtagaccgtttccataatggccagcaggaacgccataccgagcgtcagtggcacaaaaaggaagtggtacatcgcggtcaaggcaaactgtaagcgcgacagttcgactatatctaacatcatgactccttgctcatcgcatgaagactccgagagtgaaccccgttagaaagggtcacacgcatgccccaatacaaaattatttgctcgcctctatcgttgccatttcatcaaaagaggaaaagacaatgataaaaaagttacaaatgtgttaatgaataaaccaaattgatcccgtaattatattacgccgcaaaatccttacaataaaacaggtttttattgagcaaaatttgcatttttcgacagtgatcaatttatagcgaaattgtcacgatctcaccaatttgatctacaacaatttatcgtgttttgcagatttttttcaagaattaaaaattgatttatatcaaaatcaaccacatatgttaattatgtgtgaatcatgagccactggtaactttattgttaatttattgtaacaaaatagcacagtaaaattacccacatggaaatatatagataaaaaaccagtattttatttaacagagccgctttatcgactttttataatactaattagttagagtagctactttattgccattttacataacatatttttatcaacgttaattgattgttgtctttatgagcaacgtactgtaaatccgtcacttattgtttcattggtaataatcacaagaagaaatagataccttaggtatagtcagatggaacaaggattttcaaaataaaatatatatggtattaatatttcccgatctgtattcaatgattcgctcaaagattgaaattcaagagaaattgttatagcagtgatacgaaacaacaaaacggaatgattgccagccgttagaaaacaccggacactctcgtgtaaaaagctaccctgtctatggatatagcgatatcaactcatcaagcgtggactgaatgatattcagctccatatgggcggcaacctggaggataaacatgatttcgccgttggaatcaaggttgttctgcaatatctaccagactgcttcaatttatctgttttggcagtgccataatcttaatttaactatttgaagatgatgatattgtaagatgccagaaatttagtaatctggagaaccatgtttacgatcactaaatattaaagtaatagtcgataattcagtagcacatcgggtaatataacgtattgatacataatcatattaaaaaattcgtgattaaataacataagaatatgttttattatcattaaaaaaccttttatttccatcatccttaagataataaaacagtgaatgatggataacttgaccagaaaaacaagcaagcatataaaattaaaaaatatgattccactttcatttttataaaatggcatcgtgaagagcgagttgataatgctgcaatgcatcagcgtcctgtccagcagtttcataaattttggcaatgttataataggagttagcgcgcgttgtcgccgcatttgctccactggctaacgagatcgctttacgatttgcccaaattgcttccgcgatgttgccatttttctgatacgccagccccaggttactaaatgcctgtccgtaattgccgtctaattctgttgcctgttggaagagttgaatggcttgctcaagttgaccggttttgtaaacagcttcgccttcacgattatattttcttgccagttgagtatctccactgttttgcatcgcaggtgaagccggagttgaagaacccgtcgcaggcattatcacagtggctaaatccctgacgcctaatgtggtgtcgttaaaattggcgctggtaacagagttgatatcttcaaactcgccgtttggattgagtttaaacacggtccagatgttccctcgttttccagcagggacactataactacgcaccagggagctccctacataaacaaacacttttgccttactggcagagagataattactgttgggcaaccctttgttgctatagtcctgcacggcatagatgtaactttcgccaaaatgctttttgctgatagtgacagtttctgatccatagctatccgtatcatcaacatccagattagcatcagtcccctctttactatcaaaatagatatgtccgccagggaagatcaaatgtgaatcaagatcaaaaggcttttcgccccagctcaaaactacacgcatgccatccagactagtcattgccggactaatcgcataagtcatgccagcacacgaacatttgaccaccagattagaatagccctcttttttgacgatcaataaagcatcttgatcatcagcaaatgtagaacccagattaacgctgcccgatgcatttgtggttccagaaacagattgtgcgccattgcgttgcagcgtcaccgatactccctcaatgcgtttatctttcactgtcgcacttaaaatatcgatatttacatcggccgcataaacgtccgaatttacacccatcagggccagagcaaccggcagaacaattttcttcttgtataaatgcttttacagaacggagaggggatattttgccgggcattattgcgcagaggatgggagaaaagcagtgggcaaacttttcagattagtgcccgaataaaaaaggccatcataagatggccaaccatgtcgaaaccgacagcccttcgcccttcctgtagggggaagcggcgagggctatttcttattacagatatttatttcagaacagttttcagtgcttcaccgatatccgccaggctgcgaacggttttcacgcctgcggcttccagagcagcgaatttctcatccgcagtccctttaccaccggcaatgatcgcacctgcgtgacccatacgtttgcctttcggcgcagtcacaccagcgatgtaacccacaactggcttggtaacgtgttccttgatgtacgccgctgcttcttcttcagcgctaccgccgatctcaccgatcatcacgatcgcttcggtctgcggatctttttcgaacatttcgaggatatcgataaagttagagccagggatcgggtcgccgccgataccaacacaggtcgactgaccgaaaccgtaatccgtggtctgtttaaccgcttcataggtcagcgtaccggaacgggaaacgatacccactttacctggtttgtgaatgtgacccggctggataccgattttgcattcccccggggtgataacgcctgggcagttcgggccgatcatacgaacgcctgcttcatccagtttcactttcacggtcagcatatccagcgtcgggatgccttcagtgatggtgataatcagtttgatgcctgcatcgatggcttccagaatggagtctttgcagaacggtgctggtacgtagataacagaagcggtagcgccagtagcagcaacagcttcacgcacggtgttgaacaccggcaggccgaggtgggtggtgccgcctttacctggggttacgccgccaaccattttagtgccgtatgcaatagcctgttctgagtggaaagtcccctggctaccggtaaagccctggcagataaccttggtgtttttatcaattaaaatggacattatttcccctccactgcggcaacaacctgctgagctgcatccgtcagaccttttgctgcaataatattcaggccgctgtcagccagtttcttcgcaccgagttcggcgttgttaccttccagacgtaccacgaccggtacgttaacacccacttccgctaccgcgccgatgataccgtcagcgatcaggtcgcaacgaacgataccgccgaagatgttaaccagaacagctttcactttgtcgtcagagaggatgattttgaacgcttcggttacacgttctttggttgcgccgccgccaacgtccaggaagttagccggttcgccgccgtgcagtttaacgatgtccatcgtacccattgccagacctgcgccgttaaccatacaaccgatgttaccgtccagcgcaacgtagttcagttcccactgtgcagcctgtgcttcacgcggatcttcctgcgactggtcacgcatttcacgcagatcaggctggcggaacagtgcgttgccatcagcgcccagtttgccgtcgaggcaaatcagatcgccctgtttggtaataaccagcgggttgatttcgatcagcgccaggtcgcgctccaggaaaatggtcgccagacccatgaagattttggtgaactgctgaaccagtttaccttccagacccagtttaaacgccagttcgcgtccctgatacggcatcgggccagtcagcggatcaagcgcaactttgtggatcaggtgcggagtttcttccgccactttttcaatttccacgccgccttcggtggaggccataaagaccacgcgacgggaactacggtcaacaacggcaccgagatacagctctttagcgatatcggtcgctgcttcaaccagaatctggttaaccggttggccattggcatctgtttgatacgttaccagacgcttgcccagccagttttctgcaaaagcacggatgtcttctttgctgtttacaactttcacaccgcccgctttaccgcggccaccagcgtgaacctgacatttcactacccacggaccggcaccgatttttgaagcggcttcttctgcttcgcgcggagtagtacaggcataacccaccggtgctggtaagccatagcgggcaaaaagttgttttgcctgatattcatgtaagttcatgtattctgtccatccttcagtaatcgttatcttttaaaccgtagaccgacaccctatccacgtcggtctacagtgcaggtgaagcttaaactactacacgtccagcagcagacgcgtcggatcttccagcaactctttgatcgttacaaggaagcccacggattcgcgaccatcgatcaaacggtgatcgtaggacagcgccaggtacatcatcggcaggatctcaacctgaccattcactgccatcggacgatctttgatagcgtgcatacccagaattgcgctctgcggtgggttgatgataggcgttgacatcagggaaccgaacacaccaccgttggtgatggtgaagttaccaccgggtcagatcttcaaccgtcagcttgccgtcacggcctttaacagccagctctttgattttcttctcgatgtctgccatgccgagggtatcgacatcacgcagaaccggcgtcaccagaccgcgcggcgtagaaaccgccatactgacgtcgaaatagttgtggtagaccacatcatcaccgtcgatagacgcattcacttccgggtaacgtttcagggcttcaaccaccgctttcacgtagaaggacataaagcccagacggatgccgtggcgtttttcaaacgcttcaccgtactgcttacgcagatccataatcggcttcatgttgacttcgttgaacgtggtcagcatggcggtggagtttttcgcttccagcagacgctctgccacacgcttacgcaggcgagtcatcggcacacgtttttcgctacgtgcagccagggccggttgcgccgccggagcaggcgctgccggagcagactctttcgccggggctttcgccagatgtttttccacatcttcacgggtcagacgaccacccacacccgtgcctttaatagcgctggcgtcgaggttatgttcagccagcaggcgacggatcgccgggcttaacgcatcgttgttttgctcttccagagacgcctgctggcgttgcgccggagtggacgctttctcttcagatttggcgctggtttctttacccgcgctgttgccttcacgcaggcgaccaaggatctgacgagacgttaccgttgtaccttcatcttccagaaccgcatccagaatgccgtctgctgatgccggtacttccagtaccactttgtcagtttcgatttctaccagcacttcatcacgtacgactgcgtcgccgggttttttatgccaggttgcgacggtggcatcggctacggattcaggcaggtcagggaccagaatatctacgctactcattgtgtatcctttatttattcgacgttcagcgcgtcattaaccagatcttgttgctgtttctggtgaacggacatataccctaccgccggagaggcggaggctgggcggcctgcataacgcagagaagccccaaacggaatcacttcacggaaatgatgctggctgcagtaccatgcgccctggttgagcggctcttcctggcaccagacaaaatccttgacgtgagcaaactgctgcaacacttcctgcatcgctttatgcgggaacgggtagagttgctcgatacgcacaatggcgacatcgtgttgattgttcttacgacgttgttccagcaggtcgtaataaaccttaccagaacacatcactacgcgcttcacgcccttcagatcaagctcgtcgatttcaccgatggctggcaggaaggtgccgttcgccagttcttcgaggctggataccgccagcggatgacgcagcagggatttcggcgacatcacgaccagtggacgacgcatcccgcgcaacgcctgacgacgcagcatgtggtaaacctgtgccggggtagaaggtacgcaaacctgcatgttttgctcagcgcaaagttgcagataacgttccagacgcgcggaggagtgctccggcccctgcccttcgtaaccgtgcggcagcaacatcaccaggccacacatccggccccatttctgttcgccagaggagatgaactggtcgataaccacctgtgcaccgttggcgaagtcaccgaactgtgcttcccagatggtcagggtgcgtggttctgcggtggcataaccgtattcaaacgccagtacggcttcttcagacagtacagagtcccagacgcggaacgcgccctggccgttatggatatgttgcagcggcgtgtaagtggaaccgttagactggttgtggatcaccgcgtggcggtggaagaaggtaccgcgaccggagtcttcacccgacaggcgaaccggaatgccttcgtcaaccaacgtggcgtaagcgaggttttccgcgccgccccagtcgaacagtttctcaccggctgccatcgcctggcgatcgccataaatcttggcaacgcgagactgcatttcaaccgcttccggcaccgtgctgatgcgtttagccagttcctgcaggcgcttcatctcaactttgttcgggtactcttcgtcccattcatggttgaggtacggcgaccaggtgaaagagtgcatgttcatcggacgccactctgctacaacgcaatcgccagcatccagcgcatcgcggtacaggttaaccatctcggtggcatcttccagcgtcgcgactttttcctgctccagcttgtcagcgtagattttgcgcggcgtcggatgttttttgattttctgatacatcagcggctgggttgcgctcggctcgtcggcttcgttgtggccgtgacggcggtagcataccaggtcgatgaagacatcacgtttaaaggtgttacggaaatcgagcgccagacgggtaacaaaggcaacggcttccggatcatccgcgttaacgtggaaaatcggtgcctgaaccatcttaccgatatcagtacagtacggcgtcgaacgggcatccagcgggttagaggtggtgaagccaacctggttgttgataacgatacgtaccgtaccgccaacttcataaccacgcgctttcgacatgttcagggtttcctgaaccacgccctgcccggtcactgcggcgtcaccatgaatggtgattggcagcactttgttgctgctcggctcatcaagtctgtccagacgggcacgaacagaaccgataacgaccgggcttacaatctcaaggtgagacgggttaaacgccagcgccaggtgaaccaggccgccatcggtctggaagtcagacgagaagcccatgtggtatttcacgtcgcccgtgccgaggtgttctttatgtttaccggcaaactcgtcgaacaagtcttgcggttttttacccagcacgttcaccagcacgttcagacgaccacggtgcgccattccgagaaccacttcgcgggtgccgctgttgccagcgtggcggatcatctctttaagcatcgggattaacgcgtcaccgccttccagcgagaagcgttttgcgccagggaattttgcgccgaggtaacgttcaaggccttcagcggcggtcagttcgcttaagaagcgttttttctcttcgctattgaaagtcgcgcgaccagactcaatacgctgttggatccagcgtttttcttcagtgctggtaatgtgcatatactcggcaccaatcgggccgcagtaggtttgcttgagtgcttccagcagttcgccgagtttcatggtttctttgccgctggcaaatgaaccgacgttgaaggtctcctggaagtctgcttcggtcagatcgtggaaagacggatccagatcggccactttatcttgctgccacagtcccagcggatcgagattcgcatgctggtgaccacggaagcggtatgcgttaatgagctgcaggactttaacctgcttcacattggtgtcagggtcggagatcgttgaagagtaacgtgaagcgtctttcgccaggcggcggaaatattcacgcgtttgagagtggaattgatccggtttgactcccgtaccaggtaactgctggaacgtcgaacgccagttagcgtcaaccgagtcaggatcggttaagaagtcttcatagagctgttctatccagctctggtttgcgccagagaggtaagaagagtccaaccaggctttcaaagcgctgttctgcatcgtgatcccttaagcatcttttttatgcttacttcgccgtggatactaccacgcacatttcatatctgatgtgcgtgccggggttcacttgttgcggacttgtcgtgttttctgcgtccgctaaggaacctttaaaaactgtcttagtgtcaggggcagtttttaaagatttcctgcatttcttttgtaggccggataaggcattcacgccgcatccggcgctgtttgcctgatgcgacgcttgcgcgtcttatcaggcctacggtttctgcatttcttttgtaggccggataaggcgttcacgccgcatccggcactggttgcctgatgcgacgcttgcgcgtcttatcaggcctgggtttacgcattacgttgcaacaacatcgacttgatatggccgatggcgcgcgtcgggttcagccccttcggacatacactgacgcagttcatgatgctgtgacagcggaatacactgaatgcatcgctcaaaccgtcgaggcggctgtcagtctcggtatcacggctatcgatcaggaaacgatatgccgctaacaagcctgccgggccgataaacttatcgggattccaccagaaagacggacaagaggttgaacaacatgcgcagagaatacattcatacaacccgtcgagtttttcgcgctgctctggcatctgtaaatgctcgcgagctggcggattttgtccattattcaacaggtaaggcttaattttctcatattgcgcatagaattgtcccatgtctaccaccaaatcgcggatcaccggtaaacctggcagcgggcgaatcacaatcttcttgcccggctggttgagtgccgaaatcggggtaatacaggccagaccattcttaccgttcatgttcagaccgtcggaaccgcacacaccttcacggcaggagcggcggaacgacaggctgggatctttctctttcagctggataagcgcatccagcagcatcatgtcacgaccttcttccgcttccagggtgtaatcctgcatacgcggagcatcatcaacatccgggttatagcgataaattgaaaactcgagtctcattttcctgtctccgcattagtaagtacgaatcttcggcgggaatgccgggcgcagtttcggttccatgttgacgcttcggcgcgtcatggattccgactctggcagatacagggagtggcacagccagttttcatcatcgcgatccgggaagtcgaagcggctatgcgcgccacggctttcggtacggaagttggcagaaacagccgttgcatacgccgtttccatcaggttatccagttccaggcactcaacgcgctgggtgttgaactcgctggaagtgtcatccagacgggcatttttcagacgctcgcggataactttcaactgctcaagccctttcgccatcgcatcaccttcacggaagaccgagaagttatgctgcatacattcttgcagtgctttacggatcgccaccggatcttcaccgttacggttattgttccagcggttcaggcgatccagagacgcttctacatcagactcgctggcatcgcgcagtgcgccctgctcggcgatagactcttgcagatgcagacctgccgcacgaccaaatacgaccaggtccagcagcgagttgccgcccagacggttagcgccatgtaccgatacacaagcgatttcaccaacggcaaatagccccggaacaaccacatcttcgcctttctcattcacagtcagcgcctgaccggtcactttggtcggaataccgcccatcatgtagtgacaggttgggataaccggaatcggctctttcaccggatcgacgtgagcgaaggtgcgggagagttcaaggatacccggcagacgggattcaagaacttctttacccagatggtcaagtttcagttttgcgtgtggcccccacggaccatcacagccgcggccttcacggatttcgatcatgatggaacgcgccaccacgtcacggcccgccaggtctttggcgttcggcgcataacgttccataaagcgttcgccatgtttgttcagcagataaccgccttcaccacggcaaccttcggtgaccagtacgcccgcaccggcaatacctgtcgggtggaactgccacatttccatatcctgtaccggtacgcctgcacggatagccatgccgacaccgtcgccagtgttaatgtgggcgttggtggtggactgataaatacgccctgccccgccagtcgccagcactgtcgcgcgagctttaaagtaaaccacttcaccagtttcgatgcacagtgcggtacaaccgaccactgcgccatcctggtttttcaccagatccagcgcataccactcggagaaaatggtggtgtggtttttcaggttctgctgataaagcgtgtgcaacagtgcgtgaccggtacggtcggcagccgccgcagtacgtgccgcctgctcgccgccgaagtttttcgactgaccgccaaacggacgttgatagatacgaccatcatcaagacgcgagaacggcaggcccatatgttccagttccagaatcgcttccggcccggttttacacatatattcaatcgcgtcctggtcaccgatatagtccgacccttttacggtgtcgtacatatgccattcccagttatcttcatgggtattacccagcgcaacggtaataccaccttgcgcagaaacggtatgggaacgggtcgggaagactttagagagcagcgcacaggtctggccactctgggaaatttgcagcgccgcgcgcatacctgcgccgccagcaccaatcacaactgcatcaaattctctgactggcaatttcatcacacaccccacaccacaacgaatccataaatcacgtaaaccaccagtgcaacgacaatcaccagttgcagcatcaggcgcaaggccagcggtttaacgtagtcggtcaacacctgccacatgccgatccaggcatggatcaagatagaaaacagcgccagcagggtgaacactttggtgaacgcagaggcgaagaaaccgatccagacttcatatgtcagctcgccactggtagcgaaaaaaccgaccatataaatgatgtagagcgtcaggacgatagcggtagcacgaacgaggatgaaatcatgtacgccattgcgtcctaatgcggaggcgttgcttaccatacgaggactcctgcgagaagtgaaaacacgacagtaataacaaaggagattttggcggagcgtttacccgcttcgaatgtttcttccagatagccaaaatccatcatcatgtggcgaatacctacgacgacgtgatatgccagagcggtaaggatgccccacatgataaatttgacgaagaagctgcccataatcgcggaagcttgctcgaaaccttcaggggaagagaggctggtacccagaagccacagcaggatgcccactgcaacaaaggtgatcacaccggaaacgcgatggagaatggacgctatcgccgtgacggggaaccggatggtctgtaggtccagattaacaggtctttgttttttcacatttcttatcatgaataacgcccacatgctgttcttattattccctggggactacgggcacagaggttaactttctgttaccaggagacgtcgggatttccttcctccggtctgcttgcgggtcagacagcgtcctttctataactgcgcgtcatgcaaaacactgcttccagatgcgaaaacgacacgttacaacgctgggtggctcgggattgcagggtgttccggagacctggcggcagtataggctgttcacaaaatcattacaattaacctacatatagtttgtcgggttttatcccgaacagtgatctgcgtcacgataacaacatttatttaatttttaatcatctaatttgacaatcattcaacaaagttgttacaaacattaccaggaaaagcatataatgcgtaaaagttatgaagtcggtatttcacctaagattaacttatgtaacagtgtggaagtattgaccaattcattcgggacagttattagtggtagacaagtttaataattcggattgctaagtacttgattcgccatttattcgtcatcaatagatcctttacctgcaagcgcccagagctctgtacccaggttttcccctctttcacagagcggcgagccaaataacaaacgggtaaagccaggttgatgtgcgaaggcaaatttaagttccggcagtcttacgcaataaggcgctaaggagaccttaaatggctgatacaaaagcaaaactcaccctcaacggggacacagctgttgaactggatgtgctgaaaggcacgctgggtcaagatgttattgatatccgtactctcggttcaaaaggtgtgttcacctttgacccaggcttcacttcaaccgcatcctgcgaatctaaaattacttttattgatggtgatgaaggtattttgctgcaccgcggtttcccgatcgatcagctggcgaccgattctaactacctggaagtttgttacatcctgctgaatggtgaaaaaccgactcaggaacagtatgacgaatttaaaactacggtgacccgtcataccatgatccacgagcagattacccgtctgttccatgctttccgtcgcgactcgcatccaatggcagtcatgtgtggtattaccggcgcgctggcagcgttctatcacgactcgctggatgttaacaatcctcgtcatcgtgaaattgccgcgttccgcctgctgtcaaaaatgccgaccatggccgcgatgtgttacaagtattccattggtcagccatttgtttacccgcgcaacgatctctcctacgccggtaacttcctgaatatgatgttctccacgccgtgcgaaccgtatgaagttaatccgattctggaacgtgctatggaccgtattctgatcctgcacgctgaccatgaacagaacgcctccacctccaccgtgcgtaccgctggctcttcgggtgcgaacccgtttgcctgtatcgcagcaggtattgcttcactgtggggacctgcgcacggtggtgctaacgaagcggcgctgaaaatgctggaagaaatcagctccgttaaacacattccagaatttgttcgtcgagcgaaagacaaaaatgattctttccgcctgatgggcttcggtcaccgcgtgtacaaaaattacgacccgcgcgccaccgtaatgcgtgaaacctgccatgaagttctgaaagagctgggtaccaaagatgacctgctggaagtggctatggagctggaaaacatcgcgctgaacgacccgtactttatcgagaaaaaactgtacccgaacgtcgatttctactctggtatcatcctgaaagcgatgggtattccgtcttctatgttcaccgtgatcttcgctatggcacgtacggttggctggatcgcccactggagcgaaatgcacagtgacggtatgaagattgcccgtccgcgtcagctgtatacaggatatgaaaaacgcgactttaaaagcgatatcaagcgttaatggttgattgctaagccgttcactttccggacccgcctttaatagagcgggttctttttatatggctgaacataaaaaattgtaaaaattaaaccagatgcaaatacccattaataatggtgaaaaaatatttcaccggaaacactggtgattgatttgggtaaatttaacttactggatattcgccgccacacaatgtcgaaaacattcagtatcaagacaacaaaatcgcaaaatgaccagtgtaccgacggatttaaggtcagctcctcgttttataccgaaaaaacgttggttgaagaagataaagcattgttgattggtaatggtctgaagctacgtatactggatgaaaacgcctcgccttatacattcaataaatatgctgaatacgccgatttcaccagtgatatgctgatctacgaaaaaacctatacggctgaattatcgtccacacctggcactcccatcgcggcgggtcccttcgatacagtggtactttttaagattaactataactgatttaacacgacgcccttttcagccggaaagggcaacgtattcagattattgctgattttccccttttccttgattaccgttattttttccagacccagctttctttatgctgtatcgatacaccaaagataaaataatgaggaagcgaagaatgcctgtattgcagtggggaatgttatgtgttctgtcacttctcctttctattggcttcctcgctttacatctcccggcggcactcctgcttggcccgatgatcgccgggatcatcttcagtatgcgcggagtcactctgcaacttccccgctccgcttttctcgctgcccaagccattcttggctgcatgattgcacaaaacctcactggttcgattctcaccacgctggccgtcaactggccgatcgtgcttgcgattttactggtgacgctgctttccagcgccatcgtgggttggttattggtgcgctatagctcactgcctggaaataccggggcctggggttcttctcctggcggcgcggcggcaatggtcgcaatggcgcaagattacggcgcagatattcgcctggtggcgtttatgcaatatctgcgagtgctgttcgtcgcgggggccgctgttctggttacccgcatgatgctgggcgataacgctgaagcggttaaccagcagatcgtctggttcccgccagtgagcattaatctcctgcttacgattttgctcgcggtcgttgccggtacggcgggatgcttgctacgtcttccttccggcacgatgctcatcccgatgctggcgggcgcagtgctccagtctggtcagctcatcacgattgaactcccggaatggctgctggcgatggcatatatggcaattggctggcggattggtcttggtttcgataagcaaatattactgcgggcattgcgcccactgccacaaatcctgctgtcgatttttgctctgctggctatttgtgcgggtatggcgtgggggctgacccggtttatgcatattgattttatgaccgcctacctcgccaccagccccggcgggcttgataccgtggcggtcatcgccgcagggagcaatgccgatatggcgctcatcatggcgatgcaaaccctgcgcctgttcagtattttgctgacggggcctgccatcgcacggtttatttcaacctatgcgccgaagcgttcggcctagtgctggcagcctgggcaccagtaaaacgggcgcgatgacagcgtggttttctcaatgatgccgccacagcgttcgcaaggttcgccatcacgatgaaaaaccttaaagcgaaacagcgccccatgatatttgttttcatccacctggccccgcgtagcgtaagaaagtcgcggagtatccagtaacgcgtgtgcgagtgcatccagttgcgccgcattgagatctttcgctttatgatttccggtcaacccaacctgccagaggatctccacccgcaaataattgccaagtcctgccagaaacgcctgatcgagcagtaatccagcaaactggcggttacgaaagcgcggcgacaataatcgttcctttaccacctccggcgtcagattcggatccagcacatcgggaccaacgcgttgtaaaaacggatgcgtggtcagttgttccggggtcaacatctcaatatccgaggcgctataaagcagaatggttttgtcagccgtttgcagttttacccgcagtactcgcgtggtctgcggctcttcgcctgtatcaaccacgcgccagacaccgtaaagctgattatggctgtagagcgttaagtcgttggaaaaatgagttaacaacgccttaccacgcgtttccacatgggtaacgtgttgaccgataagtcgtgattgataagattttaactgcgggaaggcaaaccagacatcagttagtggtttgcctttgatcgccgcctccaggttatccgctgcacggcggatctccgggccttcaggcatggtgatatccttttttcattctttattaagcggggttatgctgcgacaacaatccccttttcagcaaatgtagctcgtaatcggcgggcgaacgccagtgcgtgctcgccatcgccatgtaggcagaccgtttgcgccgtgaccattgcccattcgccggtgatacttttgactctgccgtattgcaccatctccaacgtttgcgccagcgcctgttcttcgttttcaatcaacgcgcctggctggcttcgcggcaccagcgaaccgtctgcctgataaccgcgatcggcaaacacttcctcgcgcgttaccaggccatatcgttcgcctgcacgaatcagctcgcttcctgccagcccgacgagaatcaatgccggatcgcaagcgtataccgctctggcgatggcgtctgccagttgtgcctctttcgccgcctggttgtataacatgccgtgcggtttgacatgacacattacgccgccttgcgcacgggtaatcgctgccagcgcgccaatttgatacagcgtctgggcgaaaacggtttctggcggcagctgcatggcgctgcgaccaaaattttccctgtcgggaaaactcgggtgcgcgccaatcgcaacaccgttttttattgcttcacgcacgcaagcctgcatggtttgcgcatcgcctgcatgaaatccacaggcaatattggcagaggaaaccagcgttaatagttctgcgtcgctggcgcagccttcgcccagatcggcgttcaggtcaattttcattgtgcagccgccacgctaattgttcgaaataacgttgttgatcttgccgtgctttcagtgcctcttccagtgaacactggacaaaatgaatcggctgaccgagcggaatttgcgccagatggtacatatcagcctcaatgatacaggcaatacgcgggtaaccaccggtggtttgcgcatcgttcatcaacacaatgggctgcccgttatgcggcacctgcaccacacctggtaacaaaccgtgagataacagttcgcgatcggtggtgcgttttaaaatttgcccctgtaagcgatagcccatgcggttactttgcgagctaagctgccagggcgaacgccagaatgcatcctgcgaggcgcgatcgaactcatgatattccggccccggcaaggcgcgaatgcggttgccccacagcagctgtttaacgccctgcgcttccataaaatcacgcttcgctttgccaatcgggagtcggtcaccatccctcagtaaacggccttccaacccgccaatccccactttgagatcggtgctgcatgatcccattaccggcggaacatcaataccacccgcgaccgccagataactgcgcatcccgtgctgcgggcgtttaagcgttaaacgctggcctgctctcattggcaatcgccagccggtccagacggcgttatcatccagccgcgcttcgcaaccggcacccgtcagggcaaaccacccatcagtttcgaactcaaccgttaactgaccgagcgtgatctccagcgcgggggcgttggcgtcattacccaccagcaggttagcaatgcgcagcgcaggcatatccagtgcgccgcagtggctgatacccgactggcgaaaaccgtgacgaccgccatcctgcacagtggtatacatgcccgcacgaataatcttcagcatactccctccttctggggtacaaagcgcacgctgtctcccggacgtaataagatgggttcgtcacgctccggatcaaacaggctgagtgaggtatgaccaatcaactgccagccacccggcgttgccagcggataaacaccggtctgcggcccgccgatcccgacagaacctgctggaacgtgcaagcgcggttcagcgcgccgtggcgtgtgtagttgttccggcaaactcccgagatacgggaagcccggttgaaaacctaaaaaccagaccacgtattccacggaggagtgtaattcaacaacctgtttttcgctcaatccacaatgcgccgcgaccaccgccaaatccggtccggctgcgccaccgtaaaccaccggaatttcaataaagcgagactccggctccagcgcctcactctcctcccaccagcgttgcaaacgctctatggcatccagcgccagcgactcaggattacgcaaaatcactgtgatattgttcatgccaggaatggcttcaaccacattcggcatatccaccagacgctgtgccagtcgccagatccgtttctggctagccagcgtcaccggcggttccagttccagtactaccgccgtttcacctatcagataacaacgcgctcgttgcactttcgatccctctgattattcgttatgcaggattaggaatatcaataaaggtcacatcaagatcggtattttcattcagccactcgctcaatgcgcgaataccaccacgttcagtggcatggtgacctgcagcataaaaatgcaatccctgctcgcgggctgaatgaatggtctgttcagaaacttcgccagtaataaaagcatccacgccaaaacgcgcggcgctatcgataaaactttgcccgccgcccgtgcaccaggcgacgcgctggaccacctcaggtccggtatcgccacaccataacggcttacgtcccagacgcgcttcaatccaggaggccagttccagtcccggcacaggcatggtcagttcgccccacggcaccaacggctcaatttcgcccatgaccgtgatccccagtaacgccgccagctgtgcgttattgcccagctcaggatgtgcgtcaagcggcaaatgccagccatacaggttgatatcattcgccagcaatgtttttaagcggttacgcttcattccgcgaatgaccggagattcgcctttccagaagtagccatgatgcacaatgaccgcatccgcgcccagacgcactgcctcatcgagcaaagcctggctggcagtgacaccggtaacaattttttgcaccgtctctttgccttccacctgcaaaccattcggcgcgtaatcactaatcgccgcgctgttcagtttttcgttaatcagttgttccagttcggtgtttttcatcttcgcgccttccgtattctgatagctacaccgttaacatagcgttacctcgcctgttcgtcgatagccaatcttttgacatattaagaaacaaacacgacgccaaaagacgcaaattgtttatatcatcacgcttcagctaatgtatatttatgcaatcagacagcatattgcataaataatcagatctgtatcaaagttttaactttaaggaaacacaagcacgccgcgcaactattacgtgacgttgcagtcaattgtggaattattatgaataaacacgcatcacaaccgcgcgctatttactatgtcgttgcgctgcaaatctgggaatattttagcttttacggcatgcgtgccctgctgatcctctatctcaccaatcaactaaaatatagcgataatcacgcctacgagttatttagcgcctactgttcgctggtatatgtcacgccaatcctcggtggctttttggcggataaagttctcggcaatcgcatggcggtgatgctgggggcgttgttgatggcgatcggtcatgtggtgctgggtgccagtgagatccatccgtcattcctctatctgtccctggcgattatcgtctgcggctatggtctgtttaaatccaacgtcagttgcctgctcggcgagctgtatgagccaaccgatccacgtcgtgatggcggtttctcgctgatgtatgcggcgggtaacgtggggtctattatcgcacctatcgcctgtggtttcgcccaggaagagtacagttgggcgatgggctttggcctggcggcggtgggtatgatcgcgggtctggtcattttcttatgtggcaatcgtcatttcacacacacccgcggcgttaacaaaaaggtactgcgtgcgacaaactttctcctgcccaactggggatggctactggttctgctggtggcaacgcctgcgctgattaccgtgttgttctggaaagagtggtcggtatacgccttgattgtcgcgacgatcattggccttggggttctggcaaaaatttatcgcaaagcagaaaaccaaaaacagcgtaaggagctggggctgattgttaccctcaccttcttcagcatgttgttctgggcattcgcacaacaggggggtagctcgattagcctttatatcgaccgcttcgttaaccgcgatatgtttggttataccgttccgactgctatgttccagtcgattaatgccttcgcagttatgctgtgcggtgtgttcctggcgtgggtggttaaagaaagcgtcgcaggtaatcgtaccgtgcgcatctggggaaaatttgctcttggccttggcctgatgagcgccggattctgcattctgaccttaagcgcccgctggtccgcaatgtatggtcactcttctctgccactgatggtgttaggcctggcggtgatgggctttgcggaactgtttatcgatccggttgctatgtcgcagattacgcgcattgaaatccccggcgtgaccggcgtattaaccggcatttatatgctgctttccggcgcgattgcgaactatctggcgggcgtgattgccgatcagacatcgcaggcttcgtttgatgcttccggggcgatcaactactccatcaatgcatatattgaagtatttgatcaaattacctggggcgcactggcgtgtgtaggactggtactgatgatttggctgtatcaggcgcttaagttcagaaaccgcgcgctggcgctggagtcttaataagccagcaccatgcctgataaaacgctcgctgcgttttatcaggctcctttcctcgcttcttcgtacgctgccagcgttcgcagccttgcctctttgtgatcgactatcggttgcggataatccaacgtcacacctgttttctctgcccacttccacggctcatgcaccgctttccccggtacatcgcgcagctccggtagccactggcggataaattcgccttcgcggtcaaatttctcgccctgagttgtcgggttgaaaatacgaaaatacggcgctgcatcagtacccgtagaagcagcccactgccagccaccgttattagctgccaaatcaccatcaatcaactgcgacatgaaatatcgctcgccttcgcgccagtcgatcaacaaatctttcaccagaaaactggctgtaatcatccgtagccggttatgcatccagccagtgctgttaagctgacgcatggcagcatcgacaatcgggtatcccgttttgccctcctgccaggcctttaaatgggcgggattgctttgccactgtacacgatccgtccaggcaataaacggacgatgtttacacagcgaaggataatacgtcatcaaatggcggtagaactcgcgccatatcagctcattaagccagacgctccccggtccgccttccagcacctgcggttgttccgccaacaggcgatgtaaacattggcgaggcgataacccgcccgttgccaggctggcggacaaacgactggtgccttccactgccggaaaatctcgttgttgctcatactctccggcaccgttctggcaaaactggcgtaattgcgcaatcgccgctttttcttccaccgggaaatgcgcagtatcgaaagactgacgaggataattcagcgtaatggatggcgcgggctctatcgatccgctactacgaaattttggtgcagcgacgcactccggcatcccttcccgcagccgtttcaaccatgcgtttttaaaaggcgtaaagactttgtacatctcatgattgccagtcatcaccgcccccggcggcaggatcacgctgtcatcaaatccttcacacaccacgttacgcagcgtcctctcagcctgcacatcccgcgcccgctcattcacctcatactgatagttataaaacagatgggtaatgcgattttccgcgcacacctgtttaactgtttcgacactggcagcaaagtcatccacttcgcggaacaataaaggaatgcctttttccgccagcgcgttttgcagcgcattaagttgtgtattgataagttcagcctgacgcggcgacacattatgcgccgcccactggcgtggtgtagcgatatacaacgccagcacgcgcgcagacgaattgcggcaggcggcagccagcgcgagattatcgtgctgacgtaaatcctggcgaaaccagaccagatgggtagtcataaaactcctgcatggcgcaagttaatcacacgcggccaaagttcgaaataacgctgccctgaaagccaggcgtcaggataaagcgccatatagtgtttgatacgcatcagcggcgcaagaagcggttgctcgccacggcgataactgtcgataagcgccgccagctgctggcgttctgtggaatcaatatgtgggcgaaaatatccctgaacgtgcatcaaaacgttagtatgatcacgccggttggcagggtgagaaagcaaaacaattacgcgttggcggtactggttgtaatagtcatccagactttgccaccggtgaatatcagccacaaacgggccaagtttgcggtactccggctgagaatgtgccagaaagacgagtttatagcggctgtgataatcgagaagcgccccgcgcgttagtcctcgatctttgagattgtgtaactcatgcaaagcaaaaatgcggataagggtgctgtcatcaaaaagttgttgattcattactgctcctgaacggtttacaggagtaagtgtagacgccgaaaaaagaaaaccgccagcgtttccaccggcggttttctttaaacgtcatgtttggcaatcagtaaaaatcaccagttgccttttcggcctgatccatccacaccggtttatcgctggttttcgaccagacgcggtgcaggtagctgtaaaagcgggcgcggtctttccagaaaagcatgaaaggcagcgccagaacgcccgctgcaaccgcacaagtacggcgtaaaaagataagccatgcaggatattctttgtagagttccatacttttctcccccttttgtatctacccggtgaatagcaccggaaaaatgaattcgtttatctgatgaaaatagtaccgctgtttgtgtaattttactactcatccgaccacttatttttgcttattgatggtttatttacattcaccgtgtaattaagttacataaaagttaaattaatactaaacattagttaaatcatggcttttgccatttttatactttttttacaccacgcccgcagatttttgcgaaatctttgcagccagaactctacccttccggtatcacttttaggccactggaggtgcactgtgagtgcaggcgtgataaccggcgtgttgctggtgtttttattactgggttatctggtttatgccctgatcaatgcggaggcgttctgatggctgcgcaagggttcttactgattgccacgtttttactggtatttatggtgctggcgcgtcccttaggtagcgggctggcgcggctgattaatgatatacctcttcctggtacgacgggcgttgaacgcgtactctttagcgcgcttggcgtctctgaccgcgagatgaactggaagcagtatctctcagccattcttggcctgaatatactggggctggcggtgctgttttttatgttgctcggtcagcactatctgccgcttaatccacagcagttgccggggctgtcgtgggatctggcgctcaataccgccgtcagctttgtcacgaataccaactggcaatcttatagcggtgaaaccacgttgagctatttcagccagatggcgggcttaacggtgcaaaactttctttctgccgccagcgggattgcggtgatttttgcgcttattcgcgcgtttacccgccagagcatgaacacgctgggtaatgcgtgggtagacctgttgcggattacgttatgggtgttaacccccgtagcattgctgatcgcactgttttttattcaacaaggtgcgctgcaaaactttttgccttatcaggctgtgacgaccattgaaggagcgcaacagctgttaccaatggggccagtagcttctcaggaagcgatcaaaatgctcggaactaacggcggtggcttttttaatgccaactcgtcgcatccgtttgaaaacccaaccgcactgaccaacttcgtgcaaatgctggcgattttcttgatcccaacagcgctgtgctttgcctttggtgaagtggcgggcgatcgtcgccaggggcgcatgttgctgtgggcgatgtcggtgatttttgtcatctgcgtaggcgtagtgatgtgggcagaagttcagggtaatcctcatctgctggcgctcggcgcggacagcagcatcaatatggaaggtaaagagagccgtttcggcgtgctggtcagtagcctgtttgcggtcgtgactacggcggcttcctgcggcgcggtgattgcgatgcatgattcgtttaccgctcttggtggcatggtgccgatgtggttgatgcaaattggtgaagtggtattcggcggcgtcggttccggcctttacggcatgatgctgtttgtcctgctggcggtgtttattgccgggctgatgattggtcgtacaccggaatatctgggtaaaaaaatcgacgtacgcgagatgaaactgactgcactggcgattctggtcaccccgacgctggtgctgatgggcgcggcgctggcaatgatgaccgacgccggacgtagcgccatgctcaaccctggcccgcatggttttagcgaagtgctgtatgccgtgtcatccgccgctaacaacaacggcagcgcctttgccggattaagcgccaactctccattctggaactgtttactggcgttgtgcatgtttgtcgggcgcttcggggtgattatcccggtgatggcaattgccggttcgctggtgagtaaaaagagccaacccgccagctccggcacattgccaacgcacggcccgctgtttgttggcctgttaatcggcaccgtgttgctggttggcgcactgacctttatccctgccctggcgcttggtccggtggcggaatatctctcctgatgatattgagtgagcactgaatatgagtcgtaaacaactggcgctattcgaaccaacacttgtcgttcaggcgctgaaagaagcggtgaaaaaattaaacccgcaggcgcaatggcgcaatccggtgatgtttatcgtctggatcggcagtctgctgaccacctgtattagcatcgcgatggcaagcgatgtgatgcctggcaatgcgctgtttagcgcggcaattagcggctggctgtgggtcaccgtactgttcgctaatttcgccgaggcgttggcagaaggccgcagtaaagcgcaggccaacagtctgaaaggggtgaaaaaaaccgcttttgctcgcaagctgcgcgaaccgaaatatggcgctgcggcggacaaagttcctgctgatcaactgcgtaaaggtgacatcgtgctggtagaagctagcgatattatcccctgcgatggtgaagtcattgaaggcggcgcatcggtcgatgaaagcgccatcaccggggaatcggctccggtgatccgtgaatccggcggtgattttgcctccgtcactggcggcacgcgtattctttctgactggctggtgattgagtgcagcgttaaccccggcgagacatttctggatcggatgatcgcgatggtggaaggtgcgcagcgacgtaaaacgccgaacgagattgccctgaccattctcctgattgccctgactatcgtctttttactggcaaccgccacgctgtggccgttttccgcgtggggcggtaatgccgtcagcgtaacggtactggtggcactgctggtctgtctgatcccaaccactattggcggcctgttgtcagcgattggcgtcgccggaatgagtcggatgctgggcgcgaatgtgattgccaccagcggacgtgcagttgaagcggcaggtgacgttgacgttctgctactggataaaaccggcaccatcacactcggtaaccgtcaggcgtcagagtttatccccgcacaaggcgtggaggaaaaagcgctggccgacgccgcacaactggcttcgctggctgatgaaacgccggaaggccgcagtattgtgatcctcgccaagcagcgttttaacctgcgcgagcgcgatgtgcagtcgctccatgccacctttgtaccgtttactgcgcaaagccggatgagcgggatcaacatcgacaaccgcatgatccgtaaaggttctgtcgatgccattcgccgccatgttgaggctaacggcggtcacttccctgccgatgttgatcaaaaagtcgatcaggttgcgcgtcagggagccacgccgctggtggtggtggaaggttctcgtgtgctgggcgttattgcgctgaaagatatcgtcaaaggcggtattaaagagcgcttcgcccagctgcgtaaaatgggcattaaaacggtgatgattaccggcgataaccgcctgactgccgccgcgatagctgcggaagcgggtgtcgatgattttctcgccgaagcaacaccggaggccaagctggcactgattcgtcagtatcaggcggaaggccgtttagtggcgatgaccggcgatggcaccaacgatgctccggcgctggcacaggccgatgttgcggtggcgatgaactccggcacccaggcggcgaaagaagcgggcaatatggtggatctcgactccaacccgaccaagttgatcgaggtagtgcacattggcaaacagatgctgatgacccgtggctcgttgaccaccttcagcattgccaacgatgtggcgaaatacttcgccattattccagcggcgttcgcggcaacgtatccgcagttaaatgcgctgaacatcatgcgcctgcattcgcccgactccgccattctcagtgcggtcattttcaacgccttgattatcgtctttttgattcccctggcgttaaaaggcgtgagttataaaccgcttaccgcttctgccatgttgcgccgtaacttatggatttacggtctgggtgggctgctggtgccgtttattggtatcaaagtcattgatttactgctaaccgtttgcggtctggtgtgaggtttaccatgcgtggattacgtccggcattatcgacatttctctttctgttattgattactggcggcgtttacccgctgctgaccaccgcactggggcaatggtggtttccctggcaggccaacggttcattgattcgtgaaggtgatacggtgcgcggttcggcattaatcgggcaaaattttaccggcaacggctattttcatggtcgcccgtcggcaacagcagaaatgccctataatccacaggcttctggcgggagcaatctggcagtcagtaacccggagctggataaacagatagccgcacgcgttgccgcattacgggctgctaacccggatgccagcacgaacgttccggttgaactggtgacggcgtcagcaagcgggctggacaataacatcaccccgcaagcggcggcctggcagatcccacgcgtggcgaaagcgcgtaatctcagcgttgaacagctcacgcaactgatcgcaaaatacagccaacaaccgctggtgaaatatatcggccagccggtcgtcaacattgtcgaactcaatctggcactggataggcttgatgaataacgaacccttacgtcccgaccccgatcgtctgctggaacaagctgccgcgccgcatcgggggaagctgaaagtattcttcggtgcctgcgcaggcgtcgggaagacctgggcgatgctggcggaagcccagcgactgcgggcgcaagggctggatattgtggttggcgtggtagaaacccacggtcggaaagataccgccgccatgctgaaaggtctggctgttctgccgttaaaacgccaggcgtaccgtgggcggcacatcagcgagtttgatctcgatgccgccctcgcccgccgtccggcactgatcttaatggacgaactggcgcacagtaatgcgccaggttctcgtcatcctaaacgctggcaggacattgaggagctgctggaagcaggcattgatgttttcactaccgtcaacgttcagcatctggaaagcctgaacgatgtggtcagcggcgtcaccggaattcaggtgcgggaaaccgtgcccgatccttttttcgatgccgccgacgacgtggtgctggtggacttgcccccggacgatctgcgccagcgactgaaagaaggcaaagtctatattgccgggcaggcggagcgcgccattgaacattttttccgcaaaggtaatctgatcgccctgcgcgaactggcactacgccgtactgccgatcgcgtagatgagcaaatgcgcgcctggcgggggcatcctggcgaagagaaagtctggcacacacgcgacgcgatcctattatgcatcgggcataacaccggcagtgagaaactggtccgcgcggcggcgcggttggcctcgcgcctgggcagtgtctggcacgcggtgtatgttgaaacccctgccctgcatcgcttaccggagaaaaaacgtcgggcaattctcagcgccttacgtctggcgcaggagctgggcgcggagacggcaacactttctgatccagcggaagagaaagcggtagtgcgttatgcccgtgaacataatctcggcaagattattctcggtcgcccggcttcgcgccgctggtggcgtcgggaaacatttgctgaccggctggcacgcatcgcccccgatctcgatcaggtgctggtcgcgcttgatgaaccacccgcccgcacgattaacaacgcgccggatagccgctcttttaaagacaagtggcgggtacagattcagggatgcgtggttgccgccgcgttatgcgccgttatcaccttaattgccatgcagtggctgatagcgtttgatgccgccaacctggtgatgctgtatctgcctggcgtcgtggtggtggcactattttacggacgctggccttcggtggttgccaccgtcattaatgtggtgagtttcgatctcttttttatcgccccacgcggcacgctcgccgtctctgatgtgcaatatctgctgaccttcgcggtgatgttaaccgtcgggctggtgatcgggaaccttactgctggcgtgcgttatcaggcgcgggtagcccgttaccgcgaacaacgcacacggcacttatatgaaatgtccaaagctctggctgtgggccgtagttcgcaggatatcgccgccaccagcgaacagtttattgcctccacgtttcatgcccgtagccaggtgttgctgcctgatgacaacggtaaattgcagcctttaacacatccgcaaggaatgacgccgtgggacgatgccatcgcgcagtggagttttgataaaggcctgcctgcgggcgcaggcaccgacacgttacccggtgtaccgtaccagattttgccgctaaaaagcggcgagaaaacctacgggctggtggtggtggaaccggggaatctgcgccagttgatgatcccggaacagcagcgcctgctggagacgtttacgctgttagtcgccaatgcccttgagcgactgacactgaccgccagcgaagaacaggcgcggatggcaagcgaacgtgaacagatccgcaacgccctgctggcggcgctttcgcatgatttacgcacgccgcttacggtgctgttcggtcaggcagaaatcttaacgctcgatctggcaagcgaaggatcgccccacgcccgccaggccagcgagattcgtcagcatgtgctgaacaccacccgactggtgaataatctactggatatggcgcgaattcagtccggcggctttaatttgaagaaagagtggttaacgctggaagaagtggtcggcagcgcgctgcaaatgctggaaccgggtttatcgtcgcccatcaatctttctctgccagagccgctgaccttaatccacgttgacgggccactctttgaacgggtgctgattaacctgctagagaacgcggtgaaatatgcgggggcgcaggccgaaattggtatcaatgcccacgttgagggcgaaaatctacaactggatgtctgggataacggccccggtcttccaccaggccaggagcagacgatatttgataagtttgctcgcgggaataaagagtcggcggtaccgggtgtagggcttgggttggcaatttgtcgggcgatagtggatgtacacggcggcaccattaccgcattcaaccgaccggaaggtggtgcctgttttcgtgttacacttccccagcaaacagcccctgaacttgaagaatttcatgaggatatgtgacaaacgttctgattgttgaagatgaacaggctattcgtcgctttctgcgcacggcgctggagggcgacggtatgcgcgtctttgaggccgaaacgctgcaacgcggcttgctggaagcggcaacccgtaagccagatttgattattctcgatctcggcctgcccgacggtgatgggattgagtttatccgcgacctgcgccagtggagcgcggtgccggtgattgtgctttccgcacgcagcgaagagagcgataaaatcgccgcgctggatgccggagcggatgattatctgagtaagccgtttggcattggcgaattgcaggcccgtctgcgcgtcgcattacgccgccactccgccaccaccacgcccgatccgctggtgaaattttccgatgttaccgtcgatttagcagctcgtgtgatccatcggggcgaggaagaggtgcatctcaccccgattgagttccgcctgctggcagtgttgcttaataatgcgggaaaagtgctcacccagcgccagctcctcaaccaggtgtgggggccaaacgcggtcgaacacagtcattatttgcgtatttatatggggcatctgcgacaaaaactggagcaggatcccacccgcccccgccattttattactgaaaccggtattgggtatcggtttatgccatgaattattattcaataaatacgcttaaataattattaatttattattaaacctgccccgaaaattattatttggcaggtttaatttcttaatgaaaatacaacccacaaaattgcaacatttaaacaacaaaacagcatctaatatggcgctattcatcattaatgatttattatttgggatatgatcgttttttgttgatcttcttcacagattatagccatttcatggatagaataaccctaccttcaactgacacagaaaaaggtaaaggtaaatggaaaataataaccgcttaatgcctcatataaggcggacaacccatatcatgaagtttgcccatcgtaatagttttgactttcatttctttaatgcccgctagtcttctgactaaagggcaccccagcgtacaggtctccctgactttaagcattacaggttaatacctgtatccctcggtgctcatatactgctaacccttttaacctcttaataattcgagtcgcagcataggcaacttgaagtatgacgagtatagccagttaccgggctggtctgggttattgcatctgcaaaaagcaaactactgatttatttatcagcggtggggttttgcttttttccggcgtgatcaatttctcctttgagaaattgaggacctgctattacctgaaataaagagatgaacaaaatgtcagaattaaaaattgccgttagccgttcttgcccggattgtttttccactcatcgtgaatgcgtgaatattgacaaaagtaattatattgacgttgccgccattattttatcagtcaatgatgttgaacgtggaaaactcgatgaaatagacgctactggctatggcattcctgtttttattgcaacggaaaatgaagaacgtgtaccagcagaatatctgccacgtatttctggtgtcttcgagcattgcgaatcacggaaagagttttatggacgtcagttagaaaccgctgccagccattatgaaacgcaactgcgcccgcccttcttccgcgcactggtcgattatgtcaatcagggcaatagcgcttttgactgcccgggtcatcagggaggtgagtttttccgtcgccatccggcaggcaatcagttcgtggaatattttggcgaaatgctcttccgctccgacttgtgtaatgccgacgttgcaatgggcgatctactgattcatgaaggtgcgccatgcattgcacagcaacatgcggctaaagtgtttaatgctgataaaacgtactttgttttaaacggcacctcctcttccaacaaagtggttttaaacgccctgctgacaccgggtgatctggtgctgtttgaccgcaataaccataagtctaaccaccacggggccttgctacaggctggtgcaacaccggtttatctggaaacagcacgtaacccgtatggttttatcggtggcattgatgcgcactgcttcgaagaaagttatctgcgtgaactgattacagaagttgcaccgcaacgggcaaaagaggcgcgtccgttccgcctcgctgtgattcagttaggcacctacgacggtactatttataacgcccgccaggtggtggataaaatcggtcatctgtgtgactacatcctgtttgactcagcatgggtcggctatgaacagtttattccgatgatggcggactgttcgccactgctgctggagcttaatgagaacgatccgggtattctggttacgcaatctgtgcataaacaacaggctggtttttctcagacttcacaaattcataaaaaagacagccatatcaaagggcaacagcgttatgtaccgcacaaacgcatgaacaacgcatttatgatgcacgcctccaccagcccgttctatccgctgtttgccgcactggatatcaacgccaaaatgcatgaaggtgtcagcggtcgtaatatgtggatggattgtgtggttaacggtattaatgcccgcaaattgatcctcgataactgccagcacattcgcccgttcgttcctgaactggtggatggtaaaccctggcagtcgtatgaaacagcgcaaattgcggttgatctgcgcttctttaaatttgtacccggtgagcactggcattcttttgaaggctacgcagagaaccaatactttgtcgatccgtgcaaactgttgctgacaactccaggtattgatgcacgtaacggcgaatatgaagcgttcggtgtacccgcaacgattcttgctaacttcctgcgcgaaaatggcgtagtgccggaaaaatgcgatcttaactccatcctcttcctgctgactccggcagaagatatggccaaactgcagcaacttgttgccctgctggtacgcttcgaaaaactactggaagctgatgcgcctctggcggaagtactgccttccatctacaaacagcatgaagagcgctacgccggttataccctgcgtcagttgtgccaggaaatgcatgatttgtatgcccgccacaacgtgaaacaactgcaaaaagagatgttccgtaaggaacacttcccacgcgtcagcatgaatccgcaagaagccaactacgcctacttacgcggtgaagtggagctggttcgtctgccggatgcagaaggccgtatcgctgccgaaggtgcgcttccttatcctccgggtgtgctgtgtgttgttcctggtgaaatctggggtggtgctgttctgcgttacttcagcgctctggaagaaggcatcaacctgctgccaggttttgcaccggagctgcagggtgtctatatcgaagaacatgatggtcgtaagcaagtttggtgctatgtcatcaagcctcgtgatgcgcaaagcgccctgttgaaaggggaaaaattatgagtcaggcgaaatcgaacaaaatgggtgtcgttcagttaaccatactgacgatggtcaacatgatgggctccggtatcatcatgctgccgacaaagcttgccgaagtcgggacaatctcaattatctcctggctggtgacagccgtaggctcaatggcactggcatgggcattcgcaaaatgcggtatgttcagccgtaaatcaggaggtatgggcggttatgccgagtatgctttcggtaaatccggtaactttatggcgaactatacctacggcgtctcgctgctgattgctaacgtcgcgattgctatttcggcggttggttacggcaccgaactgctcggcgcgagtttgtcgccagtgcagattggtcttgcgaccatcggggtgctgtggatttgtaccgtggctaactttggtggtgcgcgcattaccgggcaaatcagtagcattaccgtgtggggggtcattattccggtggtaggcctgtgcattatcggctggttctggtttagcccgacgctttacgttgattcctggaatccgcatcatgcaccgttcttcagtgcggtaggttcttccatcgctatgacgctgtgggcttttcttggtctggagtctgcgtgtgcgaatactgatgtagtggaaaacccggaacgtaatgtgccaatcgcggtactcggcggtacgttaggtgcggcggtgatttatatcgtctccaccaacgtgattgccgggattgtgccaaatatggagctggcaaattcaacggcaccatttggtctggccttcgcgcagatgttcacgccggaagtgggtaaagtcattatggcgctgatggtgatgtcctgctgcggttcgctgcttggctggcagttcaccattgcccaggtgtttaaatcttctgccgatgaagggtacttcccgaaaattttctcccgtgtgagcaaagtcgatgcaccagtacagggaatgctgaccattgtcatcatccagagcggattatcactgatgaccattagcccgtcgctgaacagtcagttcaacgtgctggttaacctggccgtggtgaccaatatcatcccgtatattctgtcaatggcggcattagtcattattcagaaggtcgctaatgtgcccccctcaaaagcgaaagttgcaaactttgttgcttttgttggcgcgatgtacagcttttatgcgctgtactcatccggggaagaagccatgctatacggttccatcgtgaccttcctcggttggacactgtatggtctggtctcaccacgctttgaactgaaaaataaacacggttaattaagcaaagcaaaaaagggcgatcttccgaccgccctttttcttatttgatatgtttacgcgtttttcagaacttcgctaacaatctcaaccgcttctttctcaatctgcttgcgatgttcttcaccaaggaagctttcgcagtagatcttatatgcgtcttccgtgcctgacggacgcgcggcgaaccagccgttgtcagtcatcactttcagaccgccgatagaagcgccattacccggtgccgccgtcagacgcgcggtgatcgggtcacctgccagggtgctggcgctcaccatttccggagacagcttagacaacgccgctttttgtgcggaagtcgctgctgcctgcaaacggttatagctcggcgcaccaaagcgttttgccagttcgttatagtgttcctgcgggttcttaccggtgacagcggtgatttccgccgccagcagacacataatgatgccgtctttatcggtggaccacggcgtgccgtcgaaacgcaggaaggaagcgcctgcactctcttcgccgccaaagccgaagctgccatcgaacaaaccatcaacaaaccatttgaaacctaccggtacttctaccagcttacggcccaaatcattgaccacacggtcgatcatcgcagatgaaaccagcgttttaccgacagcaacatctttgccccactgcggacgatgctggaacaggtagttgatcgccaccgccaggtagtggttcggattcatcaaacctgccggagtgacgataccgtgacggtcataatccgggtcgttagcaaacgccagatcgaacttatcacgcagtgccagcaggcccgccatcgcacactcggaggagcagtccatacggatcgcaccgtctttatcgaggtgcataaagcggaaggtttgatcgacctgatcgttaacgatggtcaggttgaggttgtaatactcgccaatgcgcttccagtattcgataccggaaccacccagcggatcaacgcccagcgtcaggcccgctttctgaatcgccgccatatcaacgatatcggccagcccttccacaaacggctgcaccagatcctgctctttcacatgaccggatgccatcgcttcgtcgagggagatacgcttcacgcctttcaggccatcagccagcagtgcgttggctctgtcttccaccactttagtgacgttggtatcagccgggccaccatttggcggattgtacttgataccaccatcttccggcgggttatgggacggtgtaatcacgataccgtctgccagtgggccaccttttttattgtgaaccagaatggcattggaaatggcaggtgtcggagtgaagccattgttttcctgcacaatgacatcaacgccgttcgctgccagcacttccagtacggaaatgaacgcaggctcggacagggcgtgagtatctttacccacatagcaagggccagtgatgccgtttttcgcacgttcttcagcaattgcctgagcgatcgccagaatgtgcggctcgttaaagctgtggcgcgctgcactgccacggtgaccggaagtaccgaatttcaccgcgtgctccgcattccctgcttctggtttcagtacataatattgcgccgtcagttgggcgacgttaatcaaatcactctgttgtgcaggttggcctgcacgattgtggattgccattgctttgtcctttgtctgcaacgttttagatagttccgcaaaccttctcaatcaattccgccgggaattgcatcgactgcatgatgtgttcgatcatgctgcatttacggccggtgttggtgttggtgatcacccaatacggcgtaccaggcacatgttttggcttggtctgattaccatttttcagcagcgtttgttcatctgccgcaaagtaaacgcgtgtacgaccgtgcaacgattccgttgcttcggcaaacgcctgggcgtcaagagaatatagtgtagacaacagcagcataaagcgattgaccgctcgcttttgctctgcgtattcgtccgaaagcagaagttcacgcattgcgcgaaccttgtctttaatcgttttgaccggcttcgcttcgacgatagcaggtgacgcaacgcgaacctctttcgtcaccggagcagcaggctgtgatgcggcggtaaatttcaacatacgccgtaaaatgtcggatgcgctctcgccgatatgcttagtgtggctggcaatatagctgtagagttcatcatcaacttcaatcgttttcatcttaatccagtgcagtgtcttagctgaatacaagtcgccaggagtatatgaataaatcccggcagcggatagcgtcaagcctggcttgcagaaaaactcggaataaaccttatttgttgcagccctgtggcacaatggtcaacataataccctaacccgacaacgcgaaaaaaagaactttgc

SEQ ID NO: 10028 - DNA, 39335 bp, Escherichia coli
cttggcgacaatacttcatagccgccgcgcatgttcagctttggcgatacggtaacccaggtattcggtgtgcagcgtacctcatgagtaccactggtttcgatctggcagctaaaaccgttcttttcgagcaggtcagtcagtggcagcaaatcatgaatgcaaggctcaccacccgtaatcaccacgtgacgcgcggtgtatccctgacggccaatgacagccagcaaatcttcactgctcgccgccccccacttatcactctctttggtcttcgccagaatgctgaaaagggagacttcccgatcctcaagcttttcccaggtgtgtttggtgtcgcaccaggcacagccaaccggacatccctgtaaacgaataaaaatggcggggacgccggtaaagtaaccctcaccttgcagggtctggaacatctcgttaatcgggtactgcatagcattctctgtgaagtggataattgttaattattgcagatcctgccacaacaatcatgtcttattaacattctgttacaggcaggtttgatgcaaaaattggctcagatcattaagaataaaatgaagcggcgtattatgttttcaaggattaaatgaaagggatttaaacatgtttagaatattcatcgcgtttatatttattttcaatttatcaggttgcggttataacgatattcaaacctatgatgaacaggttaatgcctcctggtcagaagtattaaatcaatatcaacgtcgcaccgatcttattcctaatcttgtcgctagtattaaaggttactccagccatgaacaagaggtactagaagccgtaacattggcacgtagtcaggctaatcgcgccagtagcgatcttcagaaaactccgggagatgaacaaaaattacaagcctggcaacaggcgcaggcgcaggcgcaggtgactcgcactctcgggcagttaacgattattagtgagcgttaccctcagttaaaggctcaagagctctatcaaaacttaatggtacagctcgaaggaagtgaaaatagaattgccgttgcgcgaggaagatatattaaagccattgaacaatataatgtcactatccgcaaattccccgctgtattaaccgcaaaggtcatggattacacaccaaagaaaaattatttgccggatgatgtcaccgcagtaagtaaagccccaacaatagattttagccagaatgctaatgctcattaagcggggacgttctatgcgaaattttatcttccttatggctttcttctgttcatctgtgtttgctacacaaattccagtacctgaatcacccaggtatgtgaatgacttaaccggcacattaacaaacagcgaagtaaacaccctgaccaaccagattaaagccctgacgcaaaaaaaccacgcacagttggtcgtgttagtggttgatacaacaggcgatgaaaccattgagcagtacgcaacgcgggtattcgatagctggaaaccgggtgataaagaccgtgatgatggcgttctactgttagtcgcctggcaggatcataccgtgcgtattgaaatcggttacgggctggaaggtattattacggatgcacagtccgggaaaattattcgcaacagtattattccggcatttaaaaaaggcgacctggctggtggtttacaaaaggggatcaacgatattgaaagtcgcctgacggggaataattcagcaacgataacaccgaccgatcaccctttgtcctttagcggttggtgggctttattagtctgggcgataatactgacgtttatttctgccagaggatatatcaaaacgttgggagtaatttgcttcgcagccattgtactggcctttgttttacctatagcaggtttcagcggaagctggggagtactcacaacattactctgcttcgccacaccgtttctggcagttgccatcgcttttacccccttcggcaaaaaggttcgggattcgatgcgtgatgccaaccagccatcacgccatacaagaagcaattcttcctcccactattcatcatcgtcatcctcttcattcgacaatgacaattttagcggtggtggcggttcatctggtggcggtggcgcttccgggcgctggtaacaaaaggaattgatatgcgtatttttctcttacttctgatgctatgcggttttcaggtattcgctgaacgattgccttcagtgactgacttaaccgggacattaacgacagaagaacaaagtgctttaaatcaacaattacagactctcgagcagcaaaaccacttccaggtggccgtgttggttacgccgacaacagggggcaaaaacattaaacttgcagcctcgcagagatacggggtatatcactggaaacccgttggagagaagcgatatggcgaaggtatcttaattctcgtcgtttggccggaagggctggcgtcaatgaagattggacatggactggaacagatgttgccgccggaacaagctgcgcaaattgttcgttaccatatgcagccagaattcgaaaaaaacaatctctttgctggattaacgggcggaattgaaagcatcgcacagtttacccatatcaaagcgaaccttagccctttggatgctttagccaatcatctgtttgctaatccgcaactttcgctgccatgccttgcctggacagtgctgatgatcgttgccatcattgtcctctggcgatttaccagccgtccaggacctggcatatggatgatatcaatgattacacctacggtctggtttttctgctttcaggacgatgtcatcattcggcgggtgtcggtcgtttgttttagtttatttttcgcagcaatctgctggcagcgtctcgcagtagtttttaatatgtgccgcgtatttcctatgatgctggccccaaaaaataaaaacgcgaaagtgaaaaaacaaaagaagactccgcaagttcgtgaatcaggacgaaattcattgtttgtcgtgatgctgataattattgtgggatggtgcctggtgttcgccagtaataaagatattgcattcatctcaacaattattgggttaattgatcattttatcggcccaataaccattgctggcatcgttctgctgatcattgtggccaaatttactggcaatcttaagctggggtcaggagaaaaaagcaacaggaaaacggggaatcgtaatgctcattctcgctcttcgtcgagaaattctttccgcggtggtggcggttcttcaggaggcggcggttcatccggccgttggtgatcgtaatgcgcttaatctttattctattcactttgtggtgccttcctgggcttgcccagcaaattgctgtgccggaactgcgccaacaggtgaccgatattactggtacgttaagcacttctgaacaacaatcactgacacagcaactgcaggatattacacataaaacacgggcgcaggtcgctgtattagtagtgccgtccaccggagacgattccattgaacaatatgctacaagggtttttgatagctggaaactgggagataagcagagaaacgatggtattttacttctggttgcctgggaggatcatgctgttcgtattgaggttggctacgggctggaaggggtggttaccgacctgcaagcggcgaagattatcagggatatattgatccctgccttcaaaagtgatgacctgatgggtggattaacactggcaagcgaaaatatcggcgcgcttctgttgaatggtgaattaccggaagacaggggggattattacagtatcaatccccctattccattatcgcttgctgtaattatattgctggcggtactttcatattttattgtttttaccgatccgtcgaatttaccctggatcactctcactggcgccatttacgggatggtattcctctatgttgccgagccaggaccatggaccaatttaatcgttgcctgcggtatgttaacgccttttgcgatcgtaccactggttgttttttggcttatcgtcaataaaaagctacgcgccaaatacaaaaaactcagtaaagaaagagcttcaagaaaaggttcttcttcatcctcttccggtggaggctcaagtggcggcggatttagcggcgggggcggttcttctggcggtggcggcgcgtccggtcgctggtaactcaaccataaaaaacgccagcccgaaggctggcatttttaaatcagataaagtcagacttatgcctggcctttgatctctttacgaccgttgtacggtgctttttcgcccagagcttcttcgatacgaatcagctggttgtatttagcaacacggtcagaacggctcatagaaccagttttgatctggcctgcagcagtaccaacagccaggtcagcgatggtagcgtcttcagtttcgcctgaacggtgagagataactgcagtgtagccagcgtctttcgccatcttgattgcagccagagtttcggtcagagaaccgatctggttgaatttgatcaggatggagttagcgatacctttttcgataccttctttcaggatcttggtgttggttacgaacaggtcgtcaccaaccagctggattttgtcgcccagaactttggtctggtatgcgaaaccatcccagtcagattcgtccagaccgtcttcgatggaaacgatcggatactgtttggtcagttcttccaggaagtgagtgaattcttcagaggtgaacgctttgttgccttcgccagccagaacgtatttaccgtctttgtagaattcagaagctgcgcagtccatcgccagagtgatgtctttgcccagctcataaccagcagctttaacagcttcagcgataacagccagagcttcagcgttggaacccaggttcggcgcatagccaccttcgtcaccaacagcagtgttcatgcctttcgctttcagaacttttgccaggtgatggaaaacttcagaacccatacggatggcttctttcacagttttcgcgccaaccggctgaatcatgaattcctggatatcaacgttgttgtcagcgtgctcaccaccgttgatgatgttcatcatcggaaccggcatagagtatttgcccggagtgccgttcagttcagcgatgtgctcgtacagcggcatacctttagcagctgcagcagctttggcgttagccagagatacagccaggattgcgttcgcgccgaatttggatttgttttcggtgccgtccaggtcgatcatgatcttgtcaatgccagcctgatctttagcatctttgccaatcagcgcctgagcgatcgggccgtttaccgcagcaacagctttggttacgcctttacccaggaaacgggatttgtcgccatcgcgcagttccagagcttcacgggaaccagtagaagcacctgacggagcagctgccataccgacgaaaccaccctccagatgtacttcggcttcaacagtcgggttaccacgggagtcgatgatttcacgaccgatgatttttacgattttggacattaggttttcctcaagtcactagttaaactgaaactccagacaaacaacgcgtacccagggtacgcgttgccgttctaacttttttacttacttcgcctgacgtttctggaactcgctggcggctttcacaaagcctgcaaacagcgggtgaccatcacgtggagtagaagtaaactccggatggaactggcaagccacgaaccacggatgattcggaacttcgatgatctcgaccaactgatcatccccggaacggcccgcaacgcgcagacctgcatcttcaatctgtttcaacagcatgttgttgacttcgtaacggtgacgatgacgctcaacaattgtcggcgcattgtacagctggcgaaccaggctatcgtcaaccaactggcactgctgtgcgccgagacgcatggtaccgccgagatcgctcttctcgctacgaacttcaacgttgccgttttcatcgcgccactcggtaatcagcgccacaaccgggtacttacagtctggcacaaattccgttgagttggcgttctccatgttggcaacatggcgagcgtaatcaattaacgccacctgcatacccaggcaaatgcccagataaggaatattgttctcacgcgcaaaacgcgcggtcgtaatcatgccttctacgccacgatagccgaaaccgccaggtacgaggattgcgtccagacctttaaggatttcaacgccgcgcgtttcaacatcttgtgaatcgatcagtttgatgttgacgctgacacgattcttcagcccaccgtgtttcagtgcttcgatcacggatttgtatgcatccggcagctcaatgtatttgccgaccataccaatggtgacttcacttaccggattcgcttcttcgaagataacctgttcccattcggacagattcgcttccgggcagtttaagctgaatcgtttacaaatataatcgtccagcccctgagatttcaacaggcccggaattttatagatggaatcgacgtctttcagagaaataaccgctttttccggaacattacagaacaatgcaatcttcgcacgttcgttcgccggaacggcgcgatctgaacgacaaatcaggatatcaggctggataccgattgaaagcagctcttttacagagtgctgagtcggtttggttttgacttcaccagacgctgccatgtacggcaccagcgtcaggtgcataaacagggtgtgctcacggccaatttcaacagccatctggcgaatcgcttcgaggaacggcagggattcgatatcacctacagtaccgccgatttcgaccagtactacgtcatgaccttcgccgccttccagcacgcgctctttgatagcgttagtgatgtgcggaataacctgtacggttgcgccgagatagtcaccgcggcgttctttacgcagaacgtcagagtagatacgacccgtggtgaagttgttgcggcggctcattttggtacgaatgaaacgctcgtagtgccccaggtccaggtcggtttcagcgccgtcttcagtaacgaacacttccccgtgttggattgggctcatagtacctggatcgacgttgatgtacggatccagtttcatgatggtcacattgaggccacgggcttcaagaatggctgcgagggaggctgcggcaatgcctttacccagagaggatacgaccccgccggtcacaaaaatatagttcgttgtcatgctgaacctgagaagttaggttgaaaagacgatggaataaccaggacgggaaagcagtatacccgaacatgacctgtgccacaaactttcattatccctcctcttcgccagcgcactattgaaatcaggagtgagaaaatagcccctttggggtaaatgtttttgacgcaaatcaagcgcttgtcatttaaaaaatgacacaaatcgcgcttgaccgcgtaattcccttagagatcaatttcctgccgttttacctgttgccagacttcttccattgtttcgaggtcaacacctgtcatttccagtccacgcgcggcaacaatacgctccacttcgcgaaaacgacgctcgaatttttcgttcgctttttgcaatgcgatttccgcttttgtccctaaatgacgagccagattgaccgtggcaaacagcaggtcacccatttcctcctccagtttagcctggtcgacaacagcctgccgcgcctcgtacatcacctcgtcgatctcttcgtagactttatctactaccggaccaagcgtcgtccagtcgaaaccaacgttggcgcaacgtttctggattttttgcgcacgcattaaagccggtaaactacgaggaatatcgtccagcgccgaatgctgcgctttctgcgcgcgctcttcggttttgatttgctcccaacgggcaagcacttcactactattttcggcagaactgtcagcaaaaacatgcggatggcgacgctctaatttatcgctaatagcagcgcaaatatcattaaagtcaaagcgcccttcttcctgagccatttgtgcgtaaaacaccacctggaacagcagatcgcccagttcaccgcgcagatcgtcaaaatcttcacgggcgatggcgtccagcacctcgtaggtttcttcaagggtgtaaggcgcaatggtggcaaatgtctgctctttatcccacgggcagccgttttccgggtcgcgcaggcgctgcatgatggtgagcaaacggtcgatttgattcattgaattgtcctgaaaattgcgggtccgtcaggtgtaaacctgtgaccagaatagaagtgagttagtaacacctacccaatcagcacgttaattttggctttaatgagttgtaattcctctggggcaactgttcctttcttcgttgctcctcttgcccgccaggcgatactttttacctgatcagctaacgctacgccatcacgttcctgaccggatagaacaacttcgaacggatatccttttgattgcgttgtacaaggaacacacagacacatacctgttttgttgttgtacatgaacggactcaggacaacagccggacgatgtccggcttgctcgctaccttttgtcgggtcaaaatcaacccaaatcagatcgcccgtatcgggtacgtatcggcttaccattaccagacttccttatctttcggctccccccagtcgatattctcgtggaggttttccggcgtgatgtcgttgaccagttcagcaagcgtaaatacgggctctttacgcactggctcaataattaatttgccatccaccaggtcaatcttcacttcatcatcaatattcagattgagcgcctgcattaacgtagccgggatccgcaccgccggtgaatttccccaacgctttacgctactgtggatcataaccctttcctcaaaccgcgatcatatgtagatacagtatatatcaatctacattgtagatacgagcaagtttcggcctaactcccgtgcaaccgacgcgcgtcgataacatccggtacctggttgagtttacccagcacgcgccccagcacttgcaggttgtaaatctcaatggtcatgtcgatggtcgccagttgctgtttggtgtcgctacggctggcaacgccaagtacgttcaccttctcgttggcgagaatggtcgtgatatcacgtaacaacccactacgatcattagccaccacgcggaccaccagcgaatatccggcggagtagctctcgccccataccgcgtcaacaatgcgttctggcgcatgggagcgcagttccgccaattgttcgcaatcggcgcggtgtactgaaataccgcgcccctgggtaatgaagccgacaatctcatctccaggaatcggctggcagcagcgcgcgatgtggtgcatcaggttaccgaccccttctaccaccacacgaccgttatctttactgcggttttgcggcgtgtagcttttttgctgaagctgtttcagcgcggcggcgtcctgctcttcggcactcggcttattaaattgcgattgcaggaagttcaccatctgattgagacggatatccccgccaccaatcgccgccagcaactcgtcgacatcattgaagttgtaacgcggcagcagatgtttttctgcttctttcaggctgatccccagatgttccagctcgtcgtcaagaatttgccgcccagccagaatgtttttgtcacggtcctgtttacggaaccaggcgtgaattttcgaacgcccacggctggttgtgacgtaaccgaggtttgggtttaaccagtcacggctggggttcggctgtttctgggtgataatttcaatctggtcgcccatctgcagctggtaggtgaacggcacaatgcgcccgccaatttttgccccgatgcagcggtgtccgacatcactgtggatgtggtaagcgaagtccagcggcgttgatcccgcaggcaaatcaacgacatcacctttcggcgtaaagacgtacactcggtcgtcaaagacctgactacgtacttcgtcgagcatttcgccggaatcagccatctcttcctgccacgcaatcagtttacgcagccaggcaatccggtcttcatgtcccgaacgtgcgccgccagcagccgcgccctctttatatttccagtgcgcagcaacacccaactctgcatcttcatgcatctgtttggtgcggatttggatctcaacggttttgccacccggccccagaaccacggtatgaatggactgataaccgtttggtttcgggttagcgacgtaatcgtcaaactcatccggcaggtggcgatagtgagtgtgcactatccccagtgcggcataacaatcctgtaaacgctcggcgacaatacgtaccgcacgcacatcaaacagctcatcgaaggcgaggttctttttctgcattttgcgccagatactgtagatgtgtttcggacggccatacacttcagctttaacgccttcagctttcatctcagcgcgcagatggccgacaaactcttcgatatagtgttcgcggtcgagacggcgttcatgcagcagttttgcgatgcgtttgtattcggtcgggtggagataacggaagcagtaatcttccagctcccatttcagttgcccaatcccaagacggttcgccaacggcgcgtagatattggtgcactcttttgccgccagtacgcgttcatcttccggcgcatcttttacttcgcgcaggtgagcaatacgctccgccagtttgatgaccacgcagcgaaaatcatcgaccatcgccaataacatccggcgaacgttatcgacctgttcggaggaaacagaatcagtgtgcgtcgctttcagctggcggatcgccgccatatcacgcacgccgtgaataaggttaacgaccgacttaccgacgctctcacgcagcacatcttcgctgactacgttggcatcagccagagggaacagcagcgccgcccgcagcgtgtcaatgtccatacttaatgtcgagaggatctccaccatctcaacaccacgccacaataacagactggcatccggatgcccctgcgtctgttgcagacaatacgcccaggtttcggctaagcactcacacgacttctggctggtaatacccagacttgcgatccatttttccggatcaaattcaccagccttattgatatgtgcacttcttaccgcaaccatcgtcctctcctttagggaccagacctgccgaaatcggcaaatcgtaactatttaacgcgcgagaaaagtaccatcgattccagatgtcccgtgtgtgggaacatatccagcatcgccagtcgcgcaatggtatatcctgcttttaataacgcttcgctatcccgagccagcgttgcagggttacaggatacataaactatacgaataggttccagttttataatttgctgcataacacctgcggcacctgctcgcgccgggtccagcaacactttatcgaagccgtttttcgcccacggctgctttgtgacatcttcttcaagattttcgtgataaaacgtcacattctgtaagccattaagacgcgcattctgctggcctttttccaccagcgccggaacaccttctacacccaccacactggcagcttgtgtcgccaatggcagtgtaaagttgcccataccgcagaacagatccagtacgcaatcttcaggttccacatccagccattccaacgcacgcgctaccattttctggttcacacccgcattgacctgaataaaatcgcgcgggctaaaagttaagcgcaacccatttgagtcataccagggcatctcaccagagacggtttcgagtatctcactatcgggggcgagatacagatccaggccttcagaatgcgaaaagcattccagtttttcgcgatctgccgaacttagcggtgcggtatggcgcaaaatcattagcgtgccgctggttgcctgtaccagttcaacatgaccaagatggcgcatagcttgtaagctgcccaggcatgccctgactttgggcagcaatgcttcaagttggggcactaaaatggggcattgtttaacgtcgacaatgtcactggagcccgctttgcgaaaccccatctgaagttgctgtgttttcggtaagtagttcagacttaaacgcgcgcgacggcgatagccccagggaacatcggcgatcacttcagagacttcgtgtttcattaatcgggcgagtgccgcacttttgcttcgctgctgtaaatccacactggcgtgttgttgctgacagccgccgcatacgccaaaatgaggacagcgtggcgtttcgcgttccgggctatcgcttaatcggcgtacgactttagcgcgggcatactgttttttatcttcagtaacagtaacttccgcgttttcctgcggcaataatccggggataaataatgttttgccgttatgtcgcgccacaccctgaccaaaagagtcgaggtcgttgactgaaacggttatgatctgacgcgtcgtcgtgcgtcgttttgcagagtagaattgcgccattggcgagactttctcaatttaacagtgtgaccttaattgtcccataacggaactccatgaccaactacagcctgcgcgcacgcatgatgattctgatcctggcaccgaccgtccttattggtttattgctgagtatctttttcgtcgtgcatcgctataacgacttgcagcgtcaactggaagatgccggtgccagcattattgagccgcttgcagtttctactgaatatggcatgagtctgcaaaatcgcgaatctatcggtcagttaataagcgtactgcatcgtcgccattctgatattgttcgcgcgatttcggtttatgatgaaaataaccgactctttgtcacctccaattttcatcttgatccctcatcaatgcagctcggcagcaacgtgccgtttcctcgccagctcactgtcactcgtgacggcgatataatgatcctccgcacgccgattatttctgaaagttactcccccgacgaatcgcccagtagcgatgccaaaaatagtcaaaatatgctgggatatattgcgctggagctggatcttaaatcggttcgcttgcagcaatataaagagatctttatttccagcgtgatgatgctgttttgtatcggtattgcgcttatttttggctggcgcttaatgcgcgatgtaaccggtccgattcgcaacatggtgaataccgtcgaccgcatccgtcgcgggcaactcgacagccgggtggaaggttttatgctcggcgaactggatatgctgaaaaacggtatcaactcgatggcaatgtcgctggcggcttatcacgaagagatgcaacacaatatcgaccaggcgacgtccgatctgcgtgagacgctggagcaaatggagattcagaacgttgagttggatctggcgaaaaagcgcgcccaggaagcggcgcgtattaaatccgagtttctggcaaatatgtcacacgagctgcgtacaccactgaatggtgttattggctttacccgcctgacgctgaaaacagaattaacaccaacgcagcgcgatcacctgaatacgattgaacgttcggcaaataatttgctggcaattattaatgatgttctcgacttctcgaaactggaagccggtaagctgattctggaaagtattccattcccactacgcagcacgctggatgaagtcgttaccctgctggcacattcttctcacgataaagggctggaactgacgctcaatattaaaagcgacgtgcctgataacgtgatcggcgacccactacgattacagcaaatcatcactaacctggtagggaatgcaattaaattcaccgagaatggcaacattgatattctggtagaaaaacgtgcgctgagtaataccaaagtgcaaattgaagtgcagattcgggataccggcattggtattcctgaacgcgatcaatcgcgcttattccaggccttcagacaggctgatgccagtatttcccgccgtcatggtggcaccgggctggggctggtgattacacaaaaactggttaatgaaatgggcggcgatatttcgttccatagcctgccgaatcgtggttcaactttctggttccacattaatctcgatctgaacccgaacattattatcgaagggccatccacccagtgcctcgctggtaagcgcctggcctatgtcgaaccaaactccgcagcagcacaatgcacgctggatattttaagtgaaacgccgctggaagtggtttatagcccaacgttctccgcgctgcctcccgcgcattacgacatgatgttattaggcatagcggtgaccttccgcgagccgctaacaatgcaacatgagcgattagcgaaagcagtatcgatgaccgatttcctgatgctggcacttccttgccatgcacaagtcaatgctgaaaaacttaagcaagatggtatcggcgcgtgtctgctgaaaccattaacacctacgcgcctgttgcctgccctgacggaattttgtcatcacaaacaaaacacgcttttgcctgtaaccgatgaaagtaagctggcaatgacagtcatggcggttgatgacaaccccgctaacctgaaacttatcggcgcattgctggaagatatggtgcaacatgtggaactttgcgatagcgggcatcaggcggttgaacgggcgaaacagatgccgttcgatttaatcttaatggatattcaaatgccggacatggacggcattcgggcatgtgagctcatccaccagctcccgcatcagcagcaaacgccggttatcgcggtaacggcgcatgcgatggccgggcaaaaagagaaactgcttggcgcggggatgagtgattatctggccaaaccgatcgaagaagagcgattgcataatttgctgttgcgctacaagcctggcagcggtatttcctctcgcgtcgtgacgcccgaagtcaacgaaattgtggtcaacccgaatgcgaccctcgactggcaactggcactacgccaggcagcaggaaaaaccgatttagcgcgcgatatgctgcaaatgttactcgatttcctgcctgaagttcgcaacaaagttgaggaacagctggttggagaaaacccggaaggcctggttgatttgattcataaactgcatggcagttgcggctatagcggtgtaccgcgtatgaagaatctctgccaactgatcgaacaacagctacgtagcggtactaaagaagaagatttagagccggagctgctggaactgttggacgagatggataatgtagcgcgcgaagccagcaaaattctcgggtaatggacgtcttgtcgagtagcaaccggatttttatgacgctggtttcagattggtgacaagtgcctgtgtttatgccggatgcggcgttaacgccttatccggcctgcaaaaccaattaaattcaatgaattaaaaaatgatgtagccctgatacgtagcgcaacaggcaattttgcgtttggcatcagtctcaaaccggctccagatagagccggttttggttttctgtcttaacgcaccatgcacggacgcttgttatcgaacgtccagccggggatcaggtactgcattcccatcgcatcgtcacgcgcgccaagcccgtgtttctgatacagctcgtgcgctttcatcacttgatccatatcgatttctacacccagccccggtttttctggcacctgaaccagaccgcctttgatctctaacggttctttggtcaggcgctgattaccttcctgccagatccagtgcgtatcaatcgcggtgattttacccggtgcggcagcggcaacatgggtaaacatcgccagggaaatatcgaagtggttgttggagtgtgaaccccaggtcaggccaaattcatgacacatttgcgccacacgtaccgaaccttgcatcgtccagaaatgcggatccgcaagcgggatatcaacggattgcaacgagagcgtatggcccatctgccgccagtcggtggcgatcatattggttgcggtcggcaggccagttgcgcgacggaactctgccatcacttcacgcccggagaaaccttgctccgcaccacacggatcttctgcataagccagcgaacctttcaggtatgtaccgattttaatcgcttctttcagcgaccaggcaccgttaggatcgagcgtaatacgcgcctgcgggaaacgttgcgccagtgccacaatagattcggcttcttcttccccggccagtacaccgcctttcagtttgaaatcgttgaagccatatttttcatacgccgcttccgccaggcgcaccaccgcatccggcgtcatcgcttcttcatgacgcaggcgataccagtcgcatgagtcatccggctggctttgatacggcagcggtgtagctttgcgattgccgacgaagaacagataaccgagcatttcgacttcgctacgctgttgaccatcgcccagcagcgatgccacgtttacccccagatgctgccccagcagatccagcattgccgcttctatcccggtaactacatgaatagtggtacgcaaatcaaatgtctgcaaaccgcgcccaccggcatcacgatcggcaaaagtattacgcaccagcgtcagaacgtttttgtattcacccagcgttttacccaccaccagcggaatcgcatcttccagcgttttacggattttctcgccgccgggaatttcccctacgccagtgtgaccggaattatctttgataatcacaatattacgcgtgaagaacggtgcatgtgcaccactcagattcatcagcatactgtcatgacccgccaccgggatgacctgcatttcagtaacaacaggcgtcgtaaattgagaactcatatttatgtcctttttcagaatcaatgacggccgaaaacgggacgtttacggtcaaaggtccagccggggatcaggtactgcatcgggcctgcgtcgttacgcgcaccgccaggcagacgtttataggcctcatgtgccttttgtacctgttcccagtccagttccacgcccagaccgggcgcatcaggaacggcaatttttccgtttttaatctccagcggatttttggtcagacgacaatcgccctcctgccaaatccagtgggtatcgatagcggtaggattacccggtgccgccgcgcccacatgggtaaacatcgccagagagatatcaaagtggttattagaatggcagccccaggtcagcccccagtcgtcgcaaagttgcgccacgcggactgcaccggaaagcgtccagaagtgcggatcggcaagtggaatatctaccgcattgagcatcaccgcatgacccatttcgcgccagttggtggcgatcatgttggtcgcgacgggcaagccggtcgcccgtcgaaactccgccatcacttcacgaccggagaaaccctgctcagcgccgcacgggtcttccgcataggtaaggacatcattcagccctttgcacagagaaatggcttcatcaagcagccaggcaccattgggatcaacggtaatccgcgcatcagggaagcgtttcttcaatgcacgaacagtgtcgatttcttgctcgccaggtaacacgccacccttaagtttgaaatctttaaagccatagcgatcctgtgaggcttccgccagacgcacaacggcttcgctgttcatcgctttctgatgccgcaactgataccactcatggttgcccggcgtattttccagataaggaagatcggttttggtccgatcaccgatataaaacagataaccgagaacggtaatagcatcacgttgcttgcctggccctaacagttcgcagaccggaacattcagcgcctgacctaacaggtcaagcaaggcggcttccagcgccgccacggcattaacgcgcaattcaaaagtccaggcacctttgccgaaggtatcaaaatcggctgcctgattacctttatgcacctgctgaaccactttattcaggcgcgcaacttcctggcccagcaccatcggaatagccttgaccagtgtttgataaatcacctctccgcccggcgcttcaccaatgccggtatgcccggcattatcggtgagtaccacaatattgcgggtgaaatatgcgttatgtgcaccaccaatattaagcaacatgctgtcatgtccggcgaccggaatgactttcatatcagtaataacaggactggattgtgtcgtcatcttattgccccgcgacaggtttcagctcaatacgcttgatatcgcccaccagcaccaggtagctgagtaccgcgattaaggcatgaacaccaacataaatcagcgccccattaaaggagccagtcgtgccaacgatataaccaattgcgattggcgtgacgatgccagaaatgttaccaaacatgttaaacaggccaccggaaagaccgctgatctcttttggcgcagtatcagccattacagcccaatccagcgcaccgatccccttaccgaagaaggccagcgccataaagccgatgatcatccactcaacgttgacgtagttgcagaacaccatcaccatcgacaacaacatgcccatcacgatcggtgttttacgcgcaatgttcagtgaacccgtgcgacgcatcagccagtcggaaataatcccacccagcacaccgccgataaaaccgcaaaccgccggaacggaagccacaaagcccgctttcagaatcgacatcccgcgcgcctgcaccagataaaccgggaaccaggtaataaaaaagtaagtcagggcgttgatacagtactgaccgatataaacgccgatcatcatccgtgacccgagcagctgtttgatctgcccccacttcacgctaaacggcactttaactttggtgttttgctgatccatattgatcagcgcgccacccgcggcgatgtactccagctctttctgatttacgcccggatgttgatttggctcgtggatgactttcaaccagataaagctgatgacaatgcccagaccgcccataaagaaaaagacgtgtgaccagcccacttcatgcgtcagccagcccataatcggcgcgaagataaccgttgcgaagtattgagcggagttaaaaatcgacaccgccgttcccctttcctgcgccggaaaccaggccgcaacaatgcgactgttgccggggaaagagggcgcttcagcaagcccgaccaggaagcgcagcgtaaacagggcaacgataatgccgaatccactaaagatatcgacgaagccttgcagcaaggtaaacatcgaccagataaagatcgaccagaagtagacgcgttttgaaccaaaacgatccagcaaccagccaccagggatctgcccgataacatacgcccatgagaaggcagagaacacatagcccattcccacgggatcaaggccgatatctttggccatttccgaaccggcaatagaaagcgtagcgcggtcgccgtagttgaaggatgtgacgataaacaacatcaccactatccagtaacgagcattcgtgcgtttttccacactgctcgcagcctgacttaaagaactcattgttgcactcctgaaaattcgcgttagccacgctcactctggactgcgacatcgccaggaaatcagaggtgacgtagggtgtttttgccgtttttataggtcgttcgccgaatacggcgcgtgtttatatctggcaatagcagtataaaaagcgcgccatagcggctcaccgtgcaacaacacaacattaatgcgttcaatgaggcccgattttggcattagccctggacggtggaatccacttcacggaaatgaaaacaagaacaagaaaggaagggttaaaacgaagaaataaagaagagtatgaaatggatcgcttgactccaggcaaacgccagtaaaaatccgcgctatgaagcagtttttactggcatttgcctgaaaagattcgattcagcaccgctaaaacggcatttaccgctcgctgaacatatcaggacaacatcgtgccccaatgttcaacccacggatttgattccgtttccggttccgggttctcactggcgtcaatcaacagcatttcgccaacccgctgagcgctctgttcctgcaacaaggcatcgaactgtttgccgccattgcagaaattcacataactactgtcgccgagcgcaatcacgccataacgcagattcggctggaagcccagactatctttgattccctgaaagagtggcacaatgctatcaggaaggtcgccctgcccggtcgtggacgtaaccaccagaacatacttatcctgatagggcagccagtcgcttaattcaggatcttcaaataccgttgctttgtggccctgcgcggtcagaatcgcttccgcttcttcggccactaacagtgaattcccgtacatggtgccgacaaaaataccaatttccgccataccgttttctccctggattaggaacttatctctccatcctgacccgatggcgcactgaactcaaccctttcattttcaggaagcagaccccgccagccaaattgtgataacgcctgcatccaggtgtcgtccaggcccgcgtgaatagtcagcggctcgccagtaaaaggatgcgtcaatgacaactgactagcatgcagcattaaccgctgaaggccaaaatgttcagcaccgctgcgattctggcgtaaatcaccatgtttgctgtcgccaataatcgggtggcgcaaatgggcaagatggcgacggagctggtgcttacgtccggttttcggctccagttctaccaggccgtagcgcgtggtcgggtaacgtccggtcgctaccggcatttctacggtcgccagaccgcgataatgcgtcactgctggctgcgggcctttatcttcgcgggcaaatttatcagcgattttgtccagttcttccaccagtggataatccagcaccgcttcttccatcaaccagccgcgcacaatcgcatggtaacgtttctggatttggtgctgttcaaactgttgtgccagcagccgtccggcctcgctggataatcccatcaacaacacaccagaagtgggtcggtccagacgatgagcagtaaacacatgctggcctatcaggtcacgcacggtttgcatgaccactactttctcgtcgcgatccagccagctgcggtgaaccagccagccggagggtttatttaccgcaaccagccattcatcctgatagagtatttccagcattagctcgcatcatccgcaaaaagagcatccagtttttccagctcagccagaataagcgcgcgttgcggatgatcagtcgccagcgccatttcataatagggcgcaacagcaaaagcgcccggtaacggctggttgttatctaacaaatcgtgcatccgcggaatcagtacccattgcaaccactccagtggttccatggtgtccataaagaacggctgggtactcgcaaattgatgcggcaggggttcatcgtttcgccagtgctgatgttcacgcagtaacgcttcaagcgcctgcaactggagacgaacgcggtcatgagtggtcataaagcaacctcaataagaaaaactgccgcgaagaatagcaggaataaaaaaagggagcactgtattcacagtgctcccggttcgtttcgcagcattccggctacttttgttgctccctgctcatccttgacaacttttcctctggccttgcggccaatcgttcatcctgaactattgcttcctgctcacaccaccccgatgtgatacttcatcctgaagtgttcctggccttcctgacccaccgaatcatcctgaccggttctcattctccatcctggaggtgtcctttaacgcgtcctgcgtcatcctcttcgcttcatccagaagcctttccctgaaacaccatcctggtgtgtccttcagaagtgtcatcatcctgatgttcacttcgttgtctgactccctgtcgacgaagatagaatcgtctttttctcgaagtcttacaaggcgcttacagacaatgccttaaggataatttcatatgaaagttaagaattaacaagcaacattttgtttttaaatgaaaataacgattcttatctttttaagtattcgcttatttcctggcgatctcctacagagtctgtaagagatctctcacaaccagatggggtatttggattacagaagaggcttaagttgattaaggaattccgcaagatttgaggctaaatgcgtccgtttacgtgttcccagcgtctctttgcacacttcaccggagagattacacaccgagatgacctctaactcttcttccagcgtcgcgataaatagcgtgggcggcagttttagccttttctgagtcaccagatgaccaatcagattttcctgcacccgacggaagtcgtcttcactccaggtttgcagcaatgtcagtttgatatcgccaaactgcgcgtgcatatccccggcaaactgagtcgtataaaaggtatgaatcgtgggttgtatcacaatatcaaaagcgcgttcaaccgcgtttacattttgttccccggtaaacggctggggttgccagtatacggcatcttcggtagttgaaataatgcacggtgaaggaacgccgtacagttcctcacttaacggccagcttttatgctcttcatgccacgcatcgcagtagcgtgcagtaaaatctttcagggcttgtgcggtcaaatcgtccactaatttctctcttcacttaaaccagatacacttgtcgtttagtttatctggtttatgacggtgaaacatgtcttcttatgcaaaccatcaggcacttgcgggcctgacacttggaaaatcaaccgattaccgggatacctatgacgccagcctactgcaaggcgttccacgcagcctgaatcgcgacccgctgggtctgaaagcggataacctgccttttcacggtacggatatctggacgctgtatgaactttcctggctgaatgcgaaaggtttgccgcaggtcgctgtcggtcatgttgaacttgattacaccagcgtaaatctgattgagtcgaagagttttaagctctatctcaacagttttaaccagacgcgttttaataactgggatgaggtgcgccagacgctggagcgcgacttaagcacttgcgcccagggtaaggttagcgtggcgttatatcgtcttgatgaactggaaggccagccgataggtcatttcaatggcacctgcattgatgaccaggatatcactatcgataactatgaattcactactgactatctggagaatgccaccagcggtgaaaaagtagtggaagagacgcttgtcagccacctgctgaaatcaaattgcctgatcacccatcaaccagattggggatcgatccaaattcagtatcgtggacgccaaattgacagagaaaaactgctgcgttacctggtttctttccgtcatcacaacgagttccacgaacagtgcgtggaacgcatctttaatgacctgttacgcttctgccagccagagaaattgagcgtttacgcacgttatacccgtcgtggcggtctggacattaacccgtggcgcagtaatagcgattttgtcccatcgaccacaagactggttcggcaataaattttttctcaattttgcgtgctggattcacgcagaaggttgtgaaaggtcagcaggcagggctattgtaatcaaagggaatgacgatattcgtcccataaggagtttttcttgattacacatattagcccgcttggctccatggatatgttgtcgcagctggaagtggatatgcttaaacgcaccgccagcagcgacctctatcaactgtttcgcaactgttcacttgccgtactgaactccggtagtttgaccgataacagcaaagaattgctgtctcgttttgaaaatttcgatattaacgtcctgcgccgtgaacgcggcgtaaagctggaactgataaatcccccggaagaggcttttgtcgatgggcgaattattcgcgctttgcaggccaacttgttcgcggttctgcgtgacattctcttcgtttatgggcaaattcataacaccgttcgttttcccaacctgaatctcgacaactccgtccacatcactaacctggtcttttccatcttgcgtaacgctcgcgcgctgcatgtcggtgaagcgccaaatatggtggtctgctggggcggtcactcaattaacgaaaacgagtatttgtatgcccgtcgcgtcgggaatcagctgggcctgcgtgagctgaatatctgcaccggctgtggtccgggagcgatggaagcgccgatgaaaggtgctgcggtcggacacgcgcagcagcgttacaaagacagtcgctttattggtatgacagagccgtcgattatcgccgctgaaccgcctaacccgctggtcaacgaattgatcatcatgccagatatcgaaaaacgtctggaagcgtttgtccgtatcgctcacggtatcattatcttccctggcggtgtgggtacagcagaagagttgctgtatttgctgggaattttaatgaacccggccaacaaagatcaggttttaccattgatcctcaccggcccgaaagagagcgccgactacttccgcgtactggacgagtttgtcgtgcatacgctgggtgaaaacgcgcgccgccattaccgcatcatcattgatgacgccgctgaagtcgctcgtcagatgaaaaaatcgatgccgctggtgaaagaaaatcgccgcgacactggtgacgcttacagctttaactggtcaatgcgcattgcgccagatttgcaaatgccgtttgagccgtctcacgagaatatggctaatctgaagctttacccggatcaacccgttgaagtgctggctgccgacctgcgccgtgcgttctccggtattgtggcgggtaatgtaaaagaagtcggtattcgcgccattgaagagtttggtccttacaaaatcaacggcgataaagagattatgcgtcgtatggacgacctgctacagggttttgttgcccagcatcgtatgaagttgccaggctcagcctacatcccttgctacgaaatctgcacataatctcccctcccccggtgacgtttgttgccgggttttctcgtttttggtcacttactcatcaactcatttcatttgttatatgaatgtttcttaccaccctcacgcgacaaatatcaccacagttaatatgtcatacaatttatgttggaacgcaaacgtttccctattttcataaaccacattttatcgccatgaaaaagaaattatcgccatgattaactaaaagtattgattttttcagttcaacctacatatattgcgcgccccgtaagaagtcagatgtcgtttaatgggtaaatattgcccttaaattctcttttacttttgatttacagagtaaagcgttgtgattatctatcttccaagtagattattgtatttgggatcaagatcactgatagatacataacttgtgtgtatctttccgccctcaaattattacggtggaaaatgattaagccatcgccgatagacagatttcatttttacggtcaggcaccttcccgggctgaactggctaaaagctgaattatttgcattcctccaggagaaatagatggaaacgactcaaaccagcacgattgcgtcgaaagactctcgtagtgcctggcgcaagacagacaccatgtggatgctgggcctttacggcacggcaatcggcgcgggcgtgctgttcctgccaatcaacgctggtgttggcggtatgatcccgctgatcatcatggctatccttgcgttcccgatgacgttttttgctcaccgcggcctgactcgcttcgtactgtctggtaaaaacccgggcgaagacatcaccgaggttgtagaagaacactttggtattggcgcaggtaaactgattactctgctctacttcttcgctatctacccgatcctgctggtttatagcgtggcaatcaccaatacagttgaaagcttcatgtctcaccagctgggtatgacgccaccgccgcgtgcgattctgtcgctgatcctgatcgtgggtatgatgaccatcgttcgcttcggtgagcagatgatcgttaaagcgatgagtattctggtattcccgtttgttggcgtactgatgctgctggctctgtacctgatcccgcagtggaacggcgcagcactggaaacgctgtctctggacactgcatctgcaaccggaaacggtctgtggatgacactgtggctggcaattccggtaatggtgttctcgttcaaccactctccgatcatctcttctttcgccgttgcgaagcgtgaagagtacggcgatatggcagaacagaaatgctcgaagatcctggcattcgcacacatcatgatggtgctgaccgtaatgttcttcgtcttcagctgcgtactgagcctgactccggcagacctggctgcggctaaagagcagaacatctcgattctgtcttacctggctaaccactttaacgcgccgatcatcgcgtggatggctccgattatcgcgattatcgctatcaccaaatccttcctcggccactacctgggcgcacgtgaaggcttcaacggtatggtaattaaatctctgcgtggtaaaggtaagtctatcgaaatcaacaagctgaaccgtatcactgcgctgttcatgctggtaacgacctggattgttgccaccctgaacccgagcatcctgggtatgattgaaaccctgggcggcccaatcatcgcgatgatcctgttcctgatgccgatgtacgcaattcagaaagtaccggcaatgcgtaaatacagcggtcacatcagcaacgtattcgttgtcgtgatgggtctgattgcaatctccgcaatcttctactctctgttcagctaagtcctttcgcgccgctttcgggcggcgcttcctccgttttaacgcgatgtatttcctatgattagcgtattcgatattttcaaaatcggcattggcccttccagttctcataccgttggaccaatgaaagcgggtaaacaatttaccgacgatctgattgcccgtaacctgcttaaagacgtgacccgcgtggtggttgacgtgtacggctcgctctctctgaccggtaaaggccaccacacagatatcgccataattatgggtctggcgggtaacctgccggataccgtggatatcgattccatccctggttttattcaggatgtgaatactcatggtcgcctgatgctggcaaacggtcagcatgaagtggagttcccggttgatcagtgcatgaacttccatgccgacaacctttctctgcatgaaaacggtatgcgcattaccgcgctggcgggcgataaagtcgtttacagccagacttattactctatcggcggtggctttattgttgatgaagaacattttggtcagcaggatagcgcaccggttgaagttccttatccgtacagttcagcagccgatctgcaaaaacattgtcaggaaaccgggctgtcactctctggcctgatgatgaaaaacgagctggcgctgcacagcaaagaagagctggaacagcacctggcgaacgtctgggaagtcatgcgtggcggtattgagcgcggtatttctaccgaaggcgtgttacctggcaaactgcgcgttccacgccgtgctgcggcactacgccggatgctggtcagccaggataaaaccaccactgacccgatggcggttgttgactggatcaacatgtttgcactggcagtgaacgaagagaatgctgctggcggtcgcgtggtgactgcgccgactaacggtgcgtgcgggattattccggccgtgctggcgtactacgacaagtttatccgcgaagtgaacgctaactcactggctcgttacctgctggtagccagcgccattggttctctttataagatgaacgcctcgatttctggtgccgaagtcggctgccagggtgaagtcggcgtggcgtgctcaatggcggcagctggtctggcagaactgttaggcgcaagcccagcgcaggtatgcatcgcggcggaaatcgccatggagcacaacctcggtctgacgtgtgacccggtcgccgggcaggtacaggtgccgtgcatcgagcgtaacgccattgcggcagtgaaagcagtaaacgctgcacgtatggcgctgcgccgtaccagcgagccacgcgtctgcctcgacaaagttatcgaaaccatgtacgaaacaggtaaagatatgaacgccaagtaccgtgaaacgtctcgcggcggcctggcaatgaaaatcgttgcctgcgattaatcgctctccagaggcctctttttgcgaggcctcttcccgatttctcatccagccatagcctgttctggcatcgaatgttacccttatcgcctgatctttaagggggttatcgtggctgttcatttgcttattgtcgatgcactgaatcttattcgtcgcattcatgccgttcagggttcgccctgtgtcgaaacctgccagcacgcgctcgatcagctcattatgcacagccagccaacccacgcggtcgccgtttttgatgatgaaaaccgcagtagcggctggcgtcatcagcgtttaccagattacaaagcgggtcgaccgccaatgccggaagagttgcacaacgagatgcctgcattacgcgccgcctttgagcaacgcggcgtcccgtgctggtccgccagcggcaacgaagccgatgacttagccgccacgctggcggtcaaagtgacacaggccgggcatcaggcaacgattgtttcgacagataaaggctactgtcagttactttcaccgacattacgtattcgtgattacttccagaaacgttggctggatgcgccatttatcgataaagaatttggcgttcaaccgcagcagttgcccgattactgggggcttgcggggatcagcagttcaaaggtaccgggtgttgcagggatcggaccaaaaagcgccacacagctactggtcgagtttcagagtctggaagggatatatgagaatctggatgcggttgccgaaaagtggcgcaaaaaattagaaacccataaagagatggcgtttctgtgccgcgatattgcccgcttacaaaccgatttgcatatcgacggcaatttacagcaattgcggttggtaaggtaacggcgtgccggatgcaaacgattatcaacacattgaatttcatgcacttatatgccggataagacgcggctagcgtcgcatccggcattatcacatcagcgtatttaccaggcggtatggtaaagctctacaatatcctcaagcgttgcttcacgcgggttgccaccggtacaaacatcatccagtgccgcctgcgccagtgccggaatgtcttccttgcgtacaccaacatcacgtaaatgtggcggaataccgacatcacggttgagagcaaacaccgcttcaacagcggcattacgcgcctcttccaggctcataccttccactttcacgcccataacgcgcgcgatatcgcggtacttctcaccggtaaagtcagcgttatagcgcatgacatgcggtaacaggatggcatttgcaacaccgtgtggcgtgttgtaaaacgcgcccagtggatgcgccataccatgcaccaaccctaacccaacattcgagaatcccatacccgcaacatactgcccgagcgccatttcttctccggcatccttatcaccagcaaccgttcctcgcagcgccccagcaatgatttcaatcgctttaatgtgcagcgcatcggttagcgcccacgcgccacgggtaatatacccctcaatagcatgagtgagcgcatcgacacccgtcgcggctttcagcgctggaggcataccatccatcatgtcagcgtcaataaacgccacctgcgggatatcatgcggatcaacgcaaacaaacttgcgccgtttctcttcgtcagtgatcacgtagttaatggtcacttctgccgcagtgcctgctgtggtggggattgccagaatcggtacactgggtttattggtcggggaaagcccttccaggctacgcacatcggcaaactccgggttgttgctgataatgccaatcgctttacacgtatcctgtggagaaccaccaccaatagcgatcaggtaatccgcgccgctattctggaatacatcgagcccttctttgacgacagtaattgttgggttaggtactacgccgtcgtaaatcgcccatgccagtcctgccgcatccatcttatcgatcactttcgccaccacgccgcattgcaccagcgttttatcggtgacgatcagcgccttctgataaccacggcgtttcacttcatcggttaaagctccaacagcacctcgaccaaaccatgccgtttcgttcagaatcattctgttagccatcatccttctccttgttgctttacgaaattactcttcaatccgtaacccgtaggttttgaatttctccagcactacggcaatctcttcatcgctcagcactggcaccgggtccgtaatcgccagggtcgtcaggtaaagttgtgccagcacttcaacttcatgcgccagccataacgctttctccagattcgcctcacaagcgataagcccatgatgttgtaacaaagttgccttacgatttttgagagccagcgcaacatgttcagaaagttcgcgtgttccaaaggtcgcataaggcgcgcaaggaatagaattaccgccagccgccgcaatcatgtagtgaatcgcggggatcggtcggttaagaatggaaactgccgtacaatgaacggcatgattgtgaacaaccgcgttggcatccggtctgctttgataggccgccatatggaaacgccactcgcttgaggggagctttccttcctcatgtttgccgttgccatcaataaagacaatatgcgactccgtcagtttttcatatggaatacctgtaggcgtaatcagcatcccatcctgataacgtacactgacgttacccgctgtcccctggttcagccccaggcgagtcatttccaggcaagtgtcaataatctgacgagcaagtttatttcgttccattagctacctctctctgattcaaaacagggcaataatgttgttcctttcacactattgaattagccgtttaattactcaccatattcttcctgattaaccagaaagaaattcacaagcttatattttgtgacctggttcaactaatcacagtaaataactgcaatttctctttttataaccacattaaaaatgaccgctcttaagaatatttatcaaaacggtcatttttctactcctccctgccaggaatgcccgttttcggcacaaacaattaatacggtcatctggtttgtgttttttatgatttattttctgaaacgggcatgaaatttcgattattaaagtgatggtagtcacataaagtcaccttccagctaataagtgtgaccgccgtcatattacagaccgttttttatttgaaaatgaatccatgagttcatttcagacaggcaaatattcactgatatgaagcccgaactcgctggttttgcacttttgaaaacataaccgattacgtgcttaagcttctgaacctaagaggatgctatgggaaacacatcaatacaaacgcagagttaccgtgcggtagataaagatgcagggcaaagcagaagttacattattccattcgcgctgctgtgctcactgttttttctttgggcggtagccaataaccttaacgacattttattgcctcaattccagcaggcttttacgctgacaaatttccaggctggcctgatccaatcggccttttactttggttatttcattatcccaatccctgccgggatattgatgaaaaaactcagttataaagcagggattattaccggattgtttttatatgccttcggcgctgcattattctggcccgccgcagaaataatgaactacaccttgtttttagttggcctatttattattgcagccggattaggttgtctggaaactgccgcaaacccttttgttacggtattagggccggaaagcagtggtcacttccgcttaaatcttgcgcaaacatttaactcatttggcgcaattatcgcggttgtctttgggcaaagtcttattttgtctaacgtgccacatcaatcgcaagacgttctcgataaaatgtctccagagcaattgagtgcgtataaacacagcctggtattatcggtacagacaccttatatgatcatcgtggctatcgtgttactggtcgccctgctgatcatgctgacgaaattcccggcattgcagagtgataatcacagtgacgccaaacaaggatcgttctccgcatcgctttctcgcctggcgcgtattcgccactggcgctgggcagtattagcgcaattctgctacgtcggcgcacaaacagcctgctggagctatttgattcgctacgctgtagaagaaattccaggtatgacagcaggttttgccgctaactatttaaccggaaccatggtgtgcttctttattggtcgtttcaccggtacctggctcatcagtcgcttcgcaccacacaaagtcctggcagcctacgcattaatcgctatggcactgtgcctgatctcagccttcgctggcggtcatgtgggtttaatagccctgactttatgcagtgcctttatgtcgattcagtacccaacaatcttctcgctgggcattaagaatctcggccaggacaccaaatacggttcgtccttcatcgttatgaccattattggcggcggtattgtcactccggtcatggggtttgtcagtgacgcagcgggcaacatccccactgccgaactgctcccggcactctgcttcgcagtcatctttatctttgcccgtttccgttctcaaacggcaactaactgaacatattttccgaataaagtgaggaatcagtaatgaaaaaaatcagcttaccgaaaattggtatccgcccggttattgacggtcgtcgcatgggtgttcgtgagtcgcttgaagaacaaacaatgaatatggcgaaagccacggctgcactgctgaccgagaaactgcgccatgcctgcggagctgccgtcgagtgtgtcatttccgatacctgtatcgcgggtatggctgaagccgctgcttgcgaagaaaaattcagcagtcagaatgtaggcctcaccattacggtaaccccttgctggtgctatggcagtgaaaccatcgacatggatccaacccgcccgaaagccatttggggctttaacggcactgaacgtcccggcgctgtttacctggcagcggctctggcagctcacagccagaaaggcatcccggcattctccatttacggtcatgacgttcaggatgccgatgacacatcgattcctgccgatgttgaagaaaaactgctgcgctttgcccgcgccggtttagcagtcgccagcatgaaaggtaaaagctatctgtcgctgggcggcgtttcgatgggtatcgccggttccatcgttgatcataacttctttgaatcctggctgggaatgaaagtccaggcggtggatatgaccgaactgcgtcgccgtatcgatcagaagatttacgacgaagccgaactggaaatggcgctggcctgggctgataaaaacttccgctatggcgaagatgaaaataacaaacagtatcaacgcaatgccgagcaaagccgcgcagttctgcgcgaaagtttactgatggcgatgtgtatccgcgacatgatgcaaggcaacagcaaactggccgatattggtcgcgtggaagaatcacttggctacaacgccatcgctgcaggcttccaggggcaacgtcactggaccgatcaatatcccaatggcgataccgctgaagcgatcctcaacagttcatttgactggaatggcgtgcgcaaaccgtttgtcgtggcgaccgaaaacgacagtcttaacggcgtggcaatgttaatgggccaccagctcaccggcaccgctcaggtatttgccgatgtccgtacctactggtcaccagaagcaattgagcgtgtaacggggcataaactggacgggctggcagaacacggcatcatccatttgatcaactccggttctgctgcgctggacggttcctgtaaacaacgcgacagcgaaggtaaaccgacgatgaagccgcactgggaaatctctcagcaagaggctgacgcttgcctcgccgctaccgaatggtgcccggcgatccacgaatacttccgtggcggcggttactcttcccgctttcttaccgaaggcggcgtcccgttcaccatgactcgtgtcaacatcatcaaaggcctgggaccggtactgcaaatcgcggaaggctggagcgtggaattgccgaaggatgtgcatgacatcctcaacaaacgcaccaactcaacctggccaaccacctggtttgcaccgcgcctcaccggtaaagggccgtttacggatgtgtactcggtaatggcgaactggggcgctaaccacggggttctgaccatcggccacgttggcgcagactttatcactcttgcctccatgctgcgtatcccggtatgtatgcacaacgttgaagagaccaaagtgtatcgtccttctgcctgggccgcgcacggcatggatattgaaggccaggattaccgcgcttgccagaactacggcccgttgtacaagcgttaatacattactccctgatgtgatgcccggtcgctccggctaccgggcctgaacaagcaagagtggttagccggataagcaatgttatccggctatattgcaggagcgattatgaaacaagaagttatcctggtactcgactgtggcgcgaccaatgtcagggccatcgcggttaatcggcagggaaaaattgttgcccgcgcctcaacgcctaatgccagcgatatcgcgatggaaaacaacacctggcaccagtggtctttagacgccattttgcaacgctttgctgattgctgtcggcaaatcaatagtgaactgactgattgccacatccgcggtatcgccgtcaccacctttggtgtggatggcgctctggtagataagcaaggcaatctgctctatccgatcattagctggaaatgtccgcgaacagccgcggtaatggaccatattgaacggttgatctccgcacagcagttgcaggctatttctggagtcggagcctttagtttcaatacgttatataagttggtgtggttgaaagaaaatcatccacaactgctggaacgcgcgcacgcctggctctttatttcgtcgctgattaaccaccgtttaaccggcgaattcactactgatattacgatggccggaaccagccagatgctggatatccagcaacgcgatttcagtccgcaaattttacaagccaccggtattccacgccgactcttccctcgtctggtggaagcgggtgaacagattggtacgctacagaacagcgccgcagcaatgctcggcttacccgttggcataccggtgatttccgcaggtcacgatacccagttcgccctttttggcgctggtgccgaacaaaatgaacccgtgctctcttccggtacatgggaaattttaatggtccgcagcgcccaggttgatacttcgctgttaagtcagtacgccggttctacctgcgaactggatagccaggcagggttgtataacccaggtatgcaatggctggcatccggcgtgctggaatgggtgagaaaactgttctggacggctgaaactccctggcaaatattgattgaagaagctcgcctgatcgcgcctggcgcagatggagtgaaaatgcagtgtgatttattgtcgtgccagaacgctggctggcaaggcgtaacgcttaataccacgcgggggcatttctatcgcgcggcgctggaagggttaaccacgcaattacagcgcaatctacagatgctggaaaaaatcgggcactttaaagcctctgaattattgttagtcggcggaggaagtcgcaacacattgtggaatcagattaaagccaatatgcttgatattccggtaaaagttctcgacgatgccgaaacgaccgtcgcaggagctgcgctgtttggttggtatggcgtaggggaatttaacagcccggaagaagcccgtgcacagattcattatcagtaccgttatttctacccgcaaactgaacctgaatttatagaggaggtgtgaaatgctgaaaacaatttcgccgttaatttctcccgaactattgaaagtgctggcagagatggggcatggagatgaaattattttttccgatgctcactttcccgcccattcgatgggaccgcaggtgatccgcgctgatggcctgttggtgagcgacttgctccaggcgattatcccgttatttgagctggacagttatgcaccaccgctggtgatgatggcggcggtagaaggtgacactctcgatcctgaagtagaacgacgttatcgtaatgcgctttcactacaagccccctgtcctgacatcatccgcatcaatcgttttgcgttttatgaacgggcgcaaaaagcctttgcgatcgttatcacaggcgaacgagcgaagtacgggaatattcttttaaaaaaaggggtaacaccgtaatctcataccggtacgcccgcatgacgcgggcggttatcgaatgatggggtgaaaaatatgaaagcggcacgccagcaagcgatagtcgacctgctgctgaaccataccagcctgaccacggaagctctctctgaacagctaaaggtcagtaaagaaaccattcgtcgcgatctcaatgaattacagacgcagggtaaaattctgcgcaatcatgggcgcgctaaatatatccaccgtcaaaatcaagacagtggcgatccctttcacatccggctgaaaagccattatgcgcataaagcagatatcgcgcgcgaggcgctcgcgtggattgaagaagggatggtgatagccttagacgccagttcaacctgctggtatctggcacgccagttgcctgacatcaacatccaggtcttcaccaatagccatccgatttgccatgaactcggtaaacgcgaacgcattaaactgatcagttccggcggcacacttgagcgcaaatatggctgttacgtcaatccctcgctgatttcccaacttaaatcgctggaaatcgatctgtttattttttcttgtgaagggatcgatagcagcggcgcactgtgggactccaatgccatcaacgctgattacaaatcaatgttattaaaacgtgccgcgcaatcgttgttattgattgataaaagtaaatttaatcgttcaggggaagcccgcatcgggcatctggatgaggtaacgcacattatttctgatgagcgccaggttacaacttctttggtaacagcctgacggaaagggtagcaggccggagacgacgccccggccttacctgttatcgctcgtcgcgacgaccacccaccgcagcccagatacggcggacgtgcaccgtcacttcttcgcgatcgtgatacaactgccgcgcctgaatctgagcatttatgccatgttcatcaagctgtgcctgaatatacgccagattgtgtgacacttcttcgtagcgttttttcatcggcagtttgagattgaagatagtttcacggcaccagccattaaccagccactgcgccattaatgccgcaactttcgccggtttttcaaccatatcgcataccatccaggagatattgctgcatgtcggacggaatttgaaaccgtcttcccgcagccacgtcacctgcccggtatccatcagactttgcgccatcgggccgttgtcgacggaataaacccacatgttgcgcttcaccagttggtaggtccagccgcctgggcaagcacctaaatccaccgcccacatcccgttcgccaggcgttcatcccactcatccgcgggaataaacacatgaaatgcctcttccagtttgagcgtggaacgactcggcgcatctgccggaaatttcaggcgcggaatgcccatatagaacggcgaattattgctgctgtatgagtaaccagtatagcaacagcctggtgcaataaagaatacatgcacaaccggacgcttcggcgtttcatagttcgccagcacccccgcatcacgcaaggcagcgcgtagcggcacggtgaatttacggcagaatttcagcaactctttgctttcgttggtatcggcaacttcaacacgcagttcaccgcccttctctactacaccctgtaacatgccgacaatgggggtaatacgatcttctggcggcaaatgctgcaggagttcccccaccacaaaccactggcgggcaaaaattaatgaactgaacggcagctcacggattaacttatcgccatcatcaggttgataacattcataaatgacataacccgcattctctttcacgcgggcaaaaccgaaaatttcccgctgaccggctttatcggtaatttctgcggcgcactctttttcaaagcccggacggcacagcaatacaaccttattcatgacttacgcccttgcgctttaaacggatagcaccaattaacattaacgcccagcccgcaaggaagctcacgccgccaaccggtgtgacaaatgcccacaaacgcagatgggacagcgccaggcaataaaggctgccgctgaacagcaccgtgcctaacgcgaggaaaacgctactccagtaaaaccagatactgatgcgacgctgcattgccaccgccagacctaagatcgccagcgtatgaaacgcctggtattcgaggccggtctggatccagcccatctcaacggctcccatggttttacttaacacatgcgcgccaaaagcgcccagagctacaaaaatgaagccgctaatggcggcgaaaatcagcataaaacggctggtcatggtcgtaccctacgtaaattattgttcataacgaaa

SEQ ID NO: 10029 - DNA, 38774 bp, Escherichia coli
ccacgaagtagccgcctggggcatatgaagtccaggatgattcgttagcaacaaaaaagcgccctataggacgcttcgctctttaacaatctggatgacttattactcagatttgaactttggttctggcaaaagaggaggagttgagtcctcgaatcgtagccagtgctcccagatatcgtgggattgtaattccagaagaccaatttgacgtgatgcaactgcagtgccagctatagttcctcctgcataatcaacctggacggactttgacgctttctcaattaattctgtccaagcttcactttccgcgttaaaagaagcagttaattcctgcagacgctgtggatcatccttgttgtcttgtttcaaacgattcagggcggccaccgaatacttattcttaacccaactaacctgagctaactgaactctctgacaagcgtccatatcagtagttgtttcctgaggcatatcaaagcaggaaataaaaaaagtctcaacaccatcatttagactactgctcggctggttcaaagcatcagaagcattggatgctatcggtattatcagtgctaccgacagaatcaaacgtttaacataaatcgctcccatttaattatcccctctaagaacagagtcatccagattagccgaatccttgttgttggggaataaccaggcccacctcgcctgatgtggctaaaagcaggcacataacagctaagtattttcaaccagagagaatccttagcgttgtggtgaatgcggctcagcgcacgcgggttaaggttgaggctgacagtcgaccttctgtggatacccacccgcctggtgtgcaaccttcgccaggcaccgggaggcacccggcaccacaactttatgctgtgtgtagtcctggcggtaccagcttgtacccttgcttccggctggtaccgctctttttacaaaacagagaagagcatcaccggacgacgggctcataacccaatccacccgggcggctgccaccgcaggtgttcttctctgttttgtggagaaaccaaccgaccttgcagggtcgatatgatgaggagcagcaaaatggctagcgaacgcagtaccaacgtgcaggaatttatcggggagctggacggcggcgtatttgaaaccaaaatcggcgcagttctcagtgaagtcgcttccggtgtgatgaacacgaaaaccaaaggtaaggtctcgctcaacctggaaatcgaaccgtttgatgagaaccgtgtgaaaataaaacacaaactctcatatgttcgtccgactaaccgcgggaaaatttccgaagaagacaccaccgaaacgccgatgtatgtcaatcgcggtggtcgcctgactattctgcaggaagaccagggacaattactgactcttgccggtgaacctgacggaaaactccgcgcagcagtcattaatatcgttcttaattaactgattatttatctcatcactgaatatctttatatagtgaggacttattatgtctcagaacttagacgcaaccgcaattaatcaaatccatgcccttatttctgctcagggtgttaatgaaattatcagtaagattggtgccgacgcagtggcattacctgaaaatttccgcattcatgatctggaaaaatttaatttaaatcgcttccgtttccgtggtgcgctttccactgccagcatcgatgactttacccgttattctaaagatcttgcagatgaaggcacccgctgctttatcgatgccgataatatgcgtgccgtcagtgtgcttaacctgggtactattgatgaaccaggtcacgcagataacaccgccactctcaaactgaaaaagacagcaccgttctctgctctgttgtctgttaacggcgagcgtaactcccagaagtcactggcagaatggattgaagactgggccgactaccttgtgggctttgatgctaatggtgacgccattcaggcaacaaaagcggctgcggctgtccgtaaaatcacgattgaagcaaaccagaccgctgattttgaagacaatgacttcagcggcaaacgctccctgatggagtctgtcgaagcgaaaaccaaagatattatgccagtggcatttgaatttaaatgcgttccgtttgaaggcctgaaagaacgtccgtttaaattacgcctcagcattatcactggcgatcgtcctgtactggttctgcgcattattcagctggaagcagtgcaggaagaaatggctaacgaatttcgtgatctgcttgttgagaaattcaaggacagcaaagtagaaacctttattggtacttttaccgcctgatttcattactgcaaatgcccctgcgggggcatttatggaaacgtaattgactcaataatcgccggatggtgagggctttcttttaccagaattcagcgcggtgcagcgcatatacgtggagaacaaaatgtcatttattaaaactttttccgggaagcatttttattatgacaggataaataaagacgacatcgttattaacgatatcgcggtttctctttcaaatatctgtcgctttgcaggacatctttcacatttctacagcgtcgcccaacatgcggtgctttgcagccaactggtaccgcaggaatttgcttttgaagcgttaatgcatgatgcaacagaagcgtattgccaggacatcccggcgccactgaaacgccttcttcctgactataaacggatggaagaaaaaatagacgccgtaatccgtgagaaatacgggttacccccggttatgagtacgcccgtgaaatatgccgatctcatcatgctggcaaccgaacgccgcgatctcgggcttgatgatggctctttctggcccgtactggaaggtatcccggcaacagagatgttcaaagttattccactgtcgccaggccatacctatgggatgtttatggaacgctttaaagagttaactgagtcgtaaaaatcagcacgtacgaattcaaactctgccataaaagaacatataagtaatttattaacatatagatataggttatattacaaattgaaaaattattggagagcaacaatgaatcaaaatccattctcattctatgactttcttggatatttaataccaggtggtttttttatcctattaatgtatttctgtggtttgacattcgatctagatattgttattgacttaagtgaattgctcagaggtcaaagtcaaatctttggcattttgaactacgcttcaatagttattatatcttatatagctggacattttatttctatcacgtcagcattttttatcgaaaaatacatgaataaagaattaggatatccttccaaatatctatttaaaaaattgatagatacctcagaaagcatttgtagcccatcatgcgatgagagaagcgctgataaaaaaacaaaaataaagaatcgcataatcaaatgcgtattatgtccaataatactatgggattttataacacaaaaactatgttattctcaatctctaccatttcatttagctaatacaacatggttaatgatcaaagaaggttatgagaaaaagttcataacaaatcgccaattattacaagataaaaacggacttgatgatgatctcttcagattggcatatcattatgtttatgagttttcaaaacaacatcaaacaaaaattcaaaactatgttgcattatatggtttttgcagaaacatatgtttaatctttataatttcattttgggtatcagttccaacctttatttatcgattatgtactcatagtgattatctttatagtttactttcaataatgcttagctttttcttcgtctatgttttctatgttggttttgttaaattttatagaagatatactttagaagtattaatggcatttgctgtacttcaaagtaacgacactattcgttaataatgttgctcccgtgtgcagacgggataatggagaaacgtatgctgaacctcgattgtgttcctatctcaacttattgcaaagaaactggcgaaactcctgaagcaataaacaaacgtgtacagcgcggtgtttggcgtgaaggtgttcaggttttaaaggttgaaggcgttaaggagaggtggattgatcttagtgaggttgcaaaatgggccagacaaaactgctcaaactaccgcgcggcgtaacaatcaggaaacaccaccagggagaaacgatcaatataactttcacctacaaaggagttagatgtcgtgagccgctttccaatctggaagtaacaccaaagaacattaaatacgccgagcgtacactcggcgaaatccataataagatcgaaaggggaacattcatttatgcagaatattttccccgttctgctcgtttgaaaatttttggtaatgctgctgcaagcaaaacggtaaagatgtacctggacgaatatcttgaaatctgcgaaacaagaaaactttcaccctctacgattggtggctataaaaaatgccgtagtgcgttagcctcacttcacatttgccctgcaagtgaattaacaccagcaaccctgaaagcgtggattcaaagccagaaaacaaccttaaaaaccattcgcaaccagttatctttcctacggtcagcacttgatgaagccgtgaccgatggggtacttcaaattaaccccgtatcgttagtaacagcttcgcgctaccaaagtgataagtcagaagcagaaagcagctatgtggttgatccgctatcaccagcagaagttgatgcattactagcagcagccggaaacaaacaatgggaaaatctgttccggttcgccatacatacaggcctgcgtagttctgaattatgtgccctacgatggcatgatatcgactttgttggaaaaacagcccatgttcagagcgcaagtgttgtcggagttatcaaaggaacaaagacaaaagccggtacccgtaaagttgaactgactgaagaagcaatgttggcgttgataaaccagaagccatttacattcatgaaggatgctactgtctttgaagatccaaagaccaataaaccctgggcaagtgctgatgcaattaggaaaaaagcatgggtgccaacattgcgaaaagcaggtattcgttacagaaacccatatcaaaccaggcatacattcgccaccagccatatcagccggggagcaaacctgttttggcttgcggctcaaatgggccataaagggcctgaaatgttattcaggcactatggacaatacttgaaagagtatgatgggagggcaagtatcaaggataaaaaggctttattttaagtcattatgccaatcgtctactgtttgaaaccaaatttttaacctttgcataaaggtacgatcctttttgggagggtggtacctttgaaaagaagtatgtaacgcttcgataactcccatacaagcatcaattacttcttgtgctttaaccgggcgatcggcatctgaaagcttgtgagcgacctcacaatccagagttgctttctctagtacagatgagaacacctcgtcaggtatatacagtcctctgctttccaaaatgcaaatcagtttggaaacttgttgagctttagccaagatagttaacaagtatgaaacagaagcctttgttctatccttttgcaaccttaacaatcgatgctttgatgctctaattttaggttgagttgtctgactgagccaatagttagaagaaatatcagaaatttcaataactaactttgaaatagcatcaataattgatttcgattcagaacgtgtcgccagttttacagaattattgtacgcaactcgccatccaatgaaaactaagcagacgctaactactgtgatacaccacgaatactgtcctatttgtgctactaatgacattggttccgtactgatcaactatcgcctcttatactctttctggttgtgctaaatcaataaatttatcaatctgttctttgtagaacggaacatcactttttataatcaaacgtgctttaacgttggctttaggtatcccttccttacggatgagacctccaaacgcctcttctaagaaagaggaaccaacacccagtgctataccgcgaaaatcaaccacaatctcctgttcagtacccttcagcgcaggcaccaaaaactctctacgaaatctttccgcactgtgtgggctatccgttgtgtaacgtccgaaaggtgttctggagaactccttcgctatgacgatatttctcataaaatcatctcctgggaaccagcgaccattgtagtaaagtacccggtatgtactcagctagcttctcacatcgaggactactgtcattagaattatagctataacgagcccttcctgttagtatcagaagtgtctcattatcctcacaacctgccccaataggtctcttgatatcttcagagccatttccccgtccggaaccaacaaagcgggattcccctactaacatagctctttccacagaagatacttcgttttgaatgctatgaccatcaccattaggcacgaaacttctataaatccccaatccaaggtcacaaacgataaaaacgactttattttcatcacgattgaaccaagcgcactgccaccatcgtttacctttgagaagctgaatatctgactcgaacccctcatcttcatacgcatgatgagaaacattgagcaaagcttcactaatcgctgtcagcagtaagcctaactgttcattattaagcagagcacttttctgcagcatgagtactgtttcaacaatatgctcgtaaggttcgacagctgactgaaagtatcgttcctccctcgtaagtgcattcagtttctcttctgtgccagcaagcaaagcacgagcaagtccagtaccaacgatccatctatgcccagatgggttatcatcctttttaggccatttaaaacgtataaaattagggtcccgggttaaaaattgagctctatttactatggcaaagaacagtaccgatgccgcagctgaggcaaattttaccttggacaaatcaactataactcgacctttattttttactccaatcgattcaatcgagttgatgaagttcaatgtcccagccctagaatcatctgagtaaatgcaaaatttgcttgggggtaccagtatggtcatagcgatgtcattcttatacgatggatttatagattatctactattcatagttggttatgaagactgggatataacagtaaaagatacgtgtaagatccgcaagatagttaatgtcgaaaaaatcattaattacatcaagttagtgatatttggactcgggttcaactcccgccagccaatcatgattggacggtgtaaggactacaccaacaaaaacaggaagttataagtctcagcaggacaccgaccagacggtgaggagacaaaaaaggatacgcaacggagtcgcgactccctatgacattaaagcccgctgatgcgggcttttttattggtcctgacccgccctgaatagaattcatccaattacagtccagacatatacagtatccctcagctcagtatcagcttctcgacaaatggtcactgttatttacccgttgccagaaagagaataatttgcccccatagccagccttcccggaatctgtatattcattaatattgttatcgattccatcaagtaacataggttggatgcgattgatcttactcacattagtcgacacggaactcagtaagttgaactctgaaaaagcagtttaaatagcatttaaacaaatgccaccagttcgaaaaagagtataagcacacttaatatattgttttaattattcatttcctttcaacccaattcttatccctcacattatttgttattaatttgttgtttttgatcacaataagaaaacaatatgtaacttttatgcgcacttttcagaaatgtagatatttttagattatggctacgaaatgagcatcgccatgtcaccctacatctcataagaggatcgcttctgatgaatgcactgaccgccgtacaaaataacgctgtcgattcaggccaggactatagcggattcactctcatcccgtcggcgcaatccccgcgtctgctggaactcaccttcaccgaacagacgaccaatcggttcctcgaacaggttgccgagtggcccgtgcaggcgctggagtacaaatcgtttctgcgttttcgggtaggcaaaattctcgacgatctgtgtgcgaatcagctgcaaccgctgctgttgaagaccctgttaaaccgcgctgaaggtgcgctgttgatcaatgcggtgggtatcgatgatgtcgcgcaggcggatgagatggtgaagctggcgacggcggtggcgcatctgattggtcgctccaattttgacgccatgagcggtcagtattacgcgcgtttcgtggtgaaaaatgttgataactcagacagctatcttcgtcagccgcaccgcgtaatggagctgcacaacgacggcacttacgttgaagagatcactgattacgtgctgatgatgaaaatcgacgagcaaaacatgcagggcggtaactcgctgctgctgcatctcgatgactgggaacatctggaccactttttccgccatccgctggcgcgccgtccgatgcgctttgccgcgccgccgagcaaaaacgtcagcaaagatgtcttccatccggtgttcgatgtcgatcagcagggccgcccggtgatgcgctatatcgaccagtttatccagccgaaagacttcgaagaaggcgtgtggttgagcgagctttcggacgccattgaaaccagtaaaggcattctttctgtacccgttcccgttggcaaattcctgttgattaacaacctgttctggctgcacggtcgcgaccgctttactccgcacccggatctgcgccgtgaactgatgcgtcagcgtggctatttcgcttacgccactcaccactaccagacgcatcagtaagcgcaaaggaattgagcggatgtatgattttttgattattggcggcggcatcatcggcatgtcgaccgccatgcaactaattgatgtttatccggatgcccgcatagcgttgctggaaaaagagcccggcccggcctgtcaccagacgggccacaacagtggcgtaatccatgccggggtctattacacgcccggcagcctgaaggcgcagttttgcctggcaggaaaccgcgccaccaaagccttttgcgatcaaaacggtattcgctacgacaactgcggcaagatgctggtcgccacgtctgaactcgaaatggaacggatgcgcgccttatgggaacgcacggcggcgaacggaatcgatcgcgagtggttaaacgccgaagagctgcgcgagcgcgaaccaaatatcaccgggctgggcggtatttttgtgccgtccagcggcattgtcagctaccgcgaagtgacggcggcaatggcaaaaatttttcaggccagaggcggtgagattatctataacgccgaagtcagcgccctcagtgagcataaaaacggcgtggtgatatgtacccgtcagggcggtgaatatgaagcatcgacgctgattagctgttccgggctgatggctgaccggctggtgaaaatgctcggcctcgaaccgggctttattatctgcccgttccgcggcgagtatttccgccttgcgccggagcataaccagattgttaaccacctgatttaccccattcccgacccggcaatgccgtttttgggcgtgcatctcacccgcatgatcgacggcagtgtgaccgtcgggccaaacgcggtgctggctttcaaacgcgaaggctatcgtaagcgcgacttctcatttagcgacacgctggaaattttgggctcgtcggggattcgccgggtgctgcaaaaccatctacgctcaggactgggcgagatgaaaaactcgctgtgcaaaagcggctatctgcggctggtgcaaaagtattgtccccggctttcgttaagcgatctccagccctggcccgccggtgtgcgggcgcaggcggtatcgccggacggcaagctgattgacgattttctgtttgtcaccaccccgcgcacgatccacacctgtaatgcgccctccccggcagcgacatcagcaattcctattggtgcgcatattgtcagcaaggtacaaacgctgttggcaagccagagtaaccccggacgcacgctgcgagcggcacgtagtgtggatgccttacacgccgcatttaatcaataacctttgaaaacaggatgtagcgatgaaacttaacgacagtaacttattccgccagcaggcgttgattaacggggaatggctggacgccaacaatggcgaggtcatcgacgtcaccaatccggcgaacggcgacaagctgggtagcgtgccgaaaatgggcgctgatgaaacccgcgccgctatcgacgccgccaaccgcgccctgcccgtctggcgtgcgctcactgccaaagaacgcgccaacattctgcgcaactggttcaatttaatgatggagcatcaggacgatttagcgcgcctgatgaccctcgaacagggcaaaccactggctgaagcgaaaggcgaaatcagctacgccgcctcatttattgagtggtttgcagaagaaggcaaacgtatttatggcgacaccattcccggtcatcaggccgataaacgcctgattgttatcaagcagccgattggcgtcaccgcggctatcacgccgtggaacttcccggcggcgatgattacccgtaaagccggtccggcgctggcggcaggctgcacgatggtgctgaagcccgccagtcagacgccgttctctgcgctggcgctggcagaactggcgattcgcgcgggcgttccggctggcgtgtttaacgtagtcaccggttcggcgggcgcggtcggtaacgaactgaccagcaacccgctggtgcgcaagctgtcgtttaccggctcgaccgaaattggccgtcagttaatggaacagtgcgcgaaagacatcaaaaaagtgtcgctggagctgggcggcaacgcaccgtttattgtctttgacgatgccgatctcgataaagccgtggaaggcgcgctggcctcgaaattccgtaacgccgggcaaacctgcgtctgcgccaaccgcctgtatgtgcagaacggcgtgtatgaccgctttgccgaaaaattgcagcaggcggtgagcaaactgcacatcggcaacgggctggagaaaggcgtcaccatcgggccgctgatcgatgaaaaagcggtagcaaaagtggaagagcatattgccgatgcgctggagaaaggcgcgcgcgtggtttgcggcggtaaagcacatgaacgcggcggtaacttcttccagccgaccattctggtggacgttccggctaacgccaaagtgtcgaaagaagagacgtttggccccctcgccccgctgttccgttttaaagatgaagccgatgtgattgcgcaagccaatgacaccgaatttggccttgcagcctatttctacgcccgtgatttaagccgcgtcttccgcgtgggcgaagcactggagtacggcatcatcggcatcaacaccggcattatttccaatgaagtggccccgtttggcggcattaaagcctcgggtctgggtcgtgaaggttcgaagtatggcatcgaagattacttagaaatcaaatatatgtgcatcggtctttaactggagaatgcgaatgagcagcaataaagagttaatgcagcgccgcagtcaggcgattccccgtggcgttgggcaaattcacccgattttcgctgaccgcgcggaaaactgccgggtgtgggacgttgaaggccgtgagtatcttgatttcgcgggcgggattgcggtgctcaataccgggcacctgcatccgaaagtggttgcggcggtggaagcgcagttgaaaaaactgtcgcacacctgcttccaggtgctggcttacgagccgtatcttgaactgtgcgagattatgaatcagaaggtgccgggcgattttgccaagaaaactctgctggttacgaccggttccgaagcggtggaaaatgcggtgaaaatcgcccgcgccgccactaaacgtagcggtactatcgcctttagcggtgcgtatcacgggcgcacgcattacacactggcgctgaccggcaaggtgaatccatactctgcgggcatggggctgatgccgggtcatgtttatcgcgcgctttatccttgcccgctgcacggcataagcgaggatgacgctatcgccagcatccaccggatcttcaaaaatgacgccgcgccggaagatatcgccgccatcgtgattgagcccgttcagggcgaaggcggtttctacgccgcgacgccagcctttatgcagcgtttacgcgcgctgtgtgacgagcacgggatcatgctgattgccgatgaagtgcagagcggcgcagggcgtaccggcacgctgtttgcgatggagcaaatgggcgtggcaccagatctcaccacctttgcgaaatcgatcgcgggcggcttcccgctggcgggcgtcaccgggcgcgcggaagtgatggatgccgtcgctccaggcggtctgggcggcacctatgccggtaacccgattgcctgcgtagcggcgctggaagtgttaaaagtgtttgagcaggaaaatctgctgcaaaaagccaacgatctggggcagaaactgaaagacggattgctggcgatagccgaaaaacatactgagatcggcgacgtacgcgggctgggagcgatgattgccatcgagctgtttgaagatggcgatcacagcaaaccggacgccaaactcaccgccgagatcgtggcgcgtgcccgcgataaaggcctgattcttctctcctgcggcccgtataacaacgtgctgcgcatccttgtaccgctcaccattgaagacgctcagatccgtcagggtctggagatcatcagccagtgttttgctgaggcgaagcagtagatccgtacccatgccggaggcgacgctgcgcgtcttgtccggcctacgcgaatccaggtcggataaagcgtttacgctgcatccgacaatctgtatgtgaacaggaataaatctatgtcggccggataaggcggagccgctctccggtaaaaagaatcaataacaattacacgcgtgacccgacgcgggaaatgtcggggcgctctcccaagtgacacactttcgagaggattcaggatggggcaatcatcgcaaccacatgagttaggcggcgggctgaagtcacgccacgtcaccatgttgtctattgccggtgttatcggcgcaagtctgtttgtcggttccagcgtcgccatcgccgaagcgggcccggcggtattactggcctatctgttcgccggattactggtggttatgattatgcggatgttggcggaaatggcagttgccacgcccgataccggttcgttttccacctatgccgataaagccattggccgctgggcgggctataccatcggctggttgtactggtggttttgggtactggttatcccacttgaagccaacatcgccgccatgatcctgcactcgtgggttccaggcattcccatctggttattttccctcgtcattaccctcgccttaaccggcagtaatttattaagcgttaaaaactacggcgaatttgagttctggctggcgctgtgtaaagtcatcgctatcctggcctttattttccttggtgcagtcgcaattagcggtttttacccgtatgccgacgtgagcggtatttcaagattgtgggatagcggcggctttatgcccaacggcttcggtgcggtattaagcgcgatgttgatcaccatgttctcgtttatgggcgcagaaattgtcaccattgccgccgcggaatccgacacgccggaaaaacatattgtccgcgccaccaactcggttatctggcgtatctctattttctatttgtgttctatttttgtcgttgtggcattaatcccgtggaatatgccagggctgaaagccgttggttcttatcgctcggttctggaattgctcaatattcctcatgcgaaattaatcatggactgcgtgatattactttccgtaaccagttgcctgaactcggcgctgtataccgcttccaggatgctctactccttaagccgtcgcggtgatgctcccgcggtaatgggtaaaatcaaccgcagtaaaaccccgtacgtagcggtgttactctccaccggcgcggcattcttaacggtggtggtgaactattacgcgcctgcgaaggtgtttaaatttctgatcgacagctccggcgctatcgccctgctggtttatttagtcatcgccgtttcacaattgcggatgcgcaaaattctgcgagcagaaggaagcgaaattcgcctgcggatgtggctttatccgtggctcacctggctggtaatcggttttattacctttgtgttggtagtgatgctattccgcccggcgcaacagttagaagtgctctccaccggcttattagcgattgggattatctgtaccgtgccaattatggctcgctggaaaaagctgataatgtggcaaaaaacacccattcataatacgcgctgataatgatcaggagtcacaccatgaccattacctctctggatggctatcgctggctgaagaacgatattattcgcggcaattttcagccggatgaaaaattacggatgagtttgctgacatcgcgttatgcacttggcgtcggaccgttgcgggaggcgctttcgcaactggtggcagaacgactggtcacggtggtgaatcaaaaagggtatcgggtggcgtctatgtcagagcaggagctgctcgatattttcgacgcccgcgccaatatggaagcgatgctggtgagtctggcgattgcccgcggtggcgatgaatgggaggcagacgttcttgcgaaggcgcatctgctcagtaagcttgaggcctgtgacgccagtgagaaaatgcttgatgagtgggatctgcgtcatcaggcgtttcatactgcaattgtggcgggctgtggttcttactatttgctgcaaatgcgtgaacggttgtttgatctggcagcgcgttatcgatttatctggctgcggcgaacagtgctttcggtggaaatgctggaagataaacacgatcagcaccagaccctgactgcgacggtactggcgcgagataccgcgcgcgccagtgagttaatgcgccagcatttactgacgccaattcccattatccagcaggcgatggctggcaattaactactcttcaggaatacgcaacacttgccccgggtaaattttatccgggctttttagcatcggtttattcgcttcgaagattttattgtacagattagcgttaccgtagacctgtttggaaatggcactcagagtgtcgccagacttaacggtataaaactggctggcagtggctggtgtcgccgttttcacctgatcatcgacactggcaataccggaaatattccccaccgcaacaaggattttctccttcgcctcctgacttaagccgtcacccgtgaccgtcgctttgccgtcggcaatttgaatgttcactttatcggcatcaggtataccggttttgttcagatgctcctgcaccttcttcgcctgatcgtctttatcgtgctgacctgtaaccgcgtcccagagtttttctccggcatctttcacaaaattgaacagacccatagctacctcattcgttaacggaaacactcagaaagtgtagcagaggaacgcggcgcgttaacgccgcgggggtgaacacaggtttaatcgcgggtttgcacccagaacgcgtgaatcaaaccggggatatacccaagcagtgtcagcagaatattaataatgaacgcccaaccgaaccctttaccgagcagcacgccgagcggcggcagaatgatggtgatgacgattctccagaaacccatatgtactccctataagaaaattactcattgtttaaaaagagattttatctcttaagcgtagtaattttagcggagcctgccagtttcagcttacgcttttactctcatttacgctgctgaggctggtatatgttgcatttttagtttagagtttacttaatttagaaaatacttaaatatctatgactgaactcgcgcaattacaggctagtgccgaacaggcagcggccttattgaaagcaatgagccaccctaaacggttgctgattctgtgcatgcttagcggttcccccggcaccagtgcgggagagctgacgcgcattaccggactaagtgcctctgcaacatcacagcatctcgctcgtatgcgggacgaagggcttatcgacagccaacgggatgcccaacgcattctatattccattaaaaatgaggcggtaaatgccattatcgccaccctgaaaaatgtctattgtccgtaaggagtcactatggctttgacaaccatttcgccgcatgatgcacaagaattaatcgcacgcggcgcaaagttaatcgatattcgtgacgctgatgaatatcttcgtgaacatattcctgaagcagatctggctccattatccgtgctggaacagtcaggtcttccggctaaattacgtcgcgagcaaataatattccactgccaggcaggtaaacgcaccagtaataacgccgataaattagcagcgattgccgcccccgcagaaatctttttactcgaagatgggattgatggctggaaaaaagcaggattaccagtagcggtaaataaatctcaacccttgccgttaatgcgccaggtgcagatcgctgcgggtggtttaatattaatcggcgttatactaggttataccgtaaatagcggtttcttcttattaagcggctttgttggtgccgggttactgtttgcaggaattagcggtttttgtgggatggcaaggttgttagataagatgccgtggaaccaacgagcttgagaagcgacgccggacgcgccatagcagcaacatccggcctcagtaattagatcaggaaatcgtcgagagatttaccttctgccagcgcctgagcgattggcttcggtgtacggccctgaccggtccaggttttagtttcaccgttaacatcgatgaatttatatttcgccggacgcggctggcgttttttaccagcgcgtggtgccgcagcagagctatcacccaataactcttccgggttaattccgtcagctttcatcagctccagccaggtgctaattttttcctggcgctctgccagttcacgctgctgttgttcttcttcttcacgtctttctttagtgacaaccctgaatttttcgagcatttcttcaagaacgtcaatggagaattcgcgagccatcgcacggagggtgcgaatgttatttaaactttgtaacattacggacataataaagaaaaccttttaacgccaaaacaaaaaagtatttcgtcgcgtagtgtaagcgatcacttattatatttccacaaaatttaatctatttacagtcctgcacgagattatttcagctgttattttctgaaactctcagaataatttcaagattatatattagccattttgatgagtaatttaggttattggtgaacagagcggcgctctctgctcgctaattccgcaagcccgacaaaaccaaagtgaataaaaatgcaactcaacagaataaaagaaaacatctatcactggtgctttctgctgtcaatgtacattatctggcataaaaaatgctgaaaatgacccgatcactacatacaccgaattctctacgcttatagcgttacctcccccccaaaccttcatgagtgaaaataaaggtaaacacatatccaattgatttaattaaaaacaaatcatatcggcatgtaaaaatccacaatgtacaaaaaacgcgccgttacggaatattttatctacaaaaacagattaaataaaaatttttcactaattgattagtcatagccagcgatatacgctatgcgaaaatgcagatggcaatgagatccactgctttcatctccattcacatcccattacgcttttattaaggagcattagcatgttctcaccgcagtcacgcttgcgtcatgcagttgcagatacgttcgcgatggttgtttactgttctgtcgtgaacatgtgtattgaagttttcctctccggaatgagtttcgaacagtctttttattccagattggtagcgattccggtgaacatcttaattgcatggccatacggtatgtaccgcgatctgtttatgcgcgcagcacgcaaagttagcccgtcgggctggataaaaaatctggcggatatcatggcttatgtgacgttccagtcaccggtgtatgtggcgatcttgttagtggtgggcgcagactggcatcagattatggcggcggtcagttcaaacatcgttgtttcgatgttgatgggggcggtttatggctacttcctcgattattgccgccgactgtttaaagtcagccgcaggtaaaagcctgacccttcttttcgcgactggcatcgccagtcgcgtctttaactggcttcgccaaataaaccattcaaataacgttcaagcgcaacacgcgaactaaagccatgcgggataccgtaatgctcgtgtcgctcgcctgctaaatagagcggaaattgctggtaatgatcgcaagttttaatatcggaagcgggttcagccagtgttgaactacgttcttttaatgttggatgaatcaccagggcggtacgtcccattcgcgcttcgcgattaacatagacataattttccccacggcggtaaccatacgctttctgggttaccacatcgacagtaaaaccgactttttcaagtacgcgcgccacctcgtctggtcgtaaatacatatttgatcctcgttattatcaaccgcgggcctaccttacctgattgcgcattcacaacgctttcagaaaagtccataaagccgcgatgaacctcagttaagaaaattatggtctacactgaaaattacatcgaattctaatgggggatcatatgtttaaccgaccgaaccgcaacgacgttgatgatggcgtgcaggatatccagaatgatgtcaatcaattagctgatagtctcgaatctgtattgaagtcctggggcagcgacgccaaaggggaagccgaagccgctcgtagtaaagcgcaggctctactgaaagaaaccagggcgcgaatgcatggtcgtactcgcgtccagcaagccgcgcgtgatgccgttggctgcgcggattcttttgttcgtgaaagaccctggtgtagtgtgggtacagcggcagcggtgggtatttttatcggcgcactgttaagcatgcgcaaatcgtagtgcaaaaatgataataaatacgcgtctttgaccccgaagcctggcttcggggttttttagcttaaggctttacgtaattgttgtgctacctgtcgcgccataccttcgttaacgatattagtaaacgaaagcagtaatccaccttccccacttgaacggatacgccagtcgctaagtgcctgcaccgcaaggcctgcagcattggctttacgcgcatgggcaatatcatcgcctatcattctgatcaccatctggataccacctttctgcggcacaacctgaaatccttgctgcgtcaacgcttgctcaatccattgccgacgttgagcataatgctgacgcattttcttcagatgccgccagaaatgcccctcgcgaagaaagtctgccagtgtgttctgccatagaacaggtaccgcacatggagccagtgacgcctggtggcggaattgtgcaatttgcttcaccggcaccaccagccacgcacagcgcaatgcaggaaatagcgctttgctgaatgttccggcataaattacccgctgcggtgcgtcgagactttttaacgccggtaacggcttaccgtgatagcgaaactcactgtcataatcatcttcaataatccatgcctgactacgatctgcccattccagtatctgatgcctgcgcgctaaagagagcgccacacccagcggactttggtgtgctggtgttatcagggcaaaacgcgcatcaggataattttgtattccgcttgtgatatccagtccattgtcatcaaccggcacaggcaaaatttccacatcatggcgagtgacaatcgggcgaatcagtggaaagccgggatcttctatccacatcccgtttcccggtttcgccagcgcgtgcagaattaaagctattgaggccgcataaccgtgagtgataaagacctgctctggctgacaatcaatcccacgtgaaacgcgtaagtaatcaactattgcctcgcgcaacgccgcctcaccgcagacatcgcctaacgccaaatcaaagcgcgtctgggtacgaaggcgacgccccatcacccgcgcccacagctctcgcggaaagagatcgagtgcgggtaatcccatttgaaatggcaacggttgctgactttcaccggcaaaagctacaacttgtacagtagattgttgcggatatatccgctcactgacaaatgtgccagcctgtccccgcctgatcagccatccttgcgccaccagctcagcatacgcattttcgacagtggatcgagacacccccagctcctgcgaccaggtacgacttgaaggcagccttgcgccgggtttcagttccccttgctcaatagccgtttttaactgacgggcgatatcctgatagcgcggcatatggtctgcttttttaggtaatttatggctctctttagcagtccattatagtgctacattgcgggcgttaataagaggagaaactgtatgactacattacgtcagccttactacgaacttagcccggcagtgtataacgcactagtgcaggccaaaacggcactggaaaatagcacgctggataccacgttgatggagttagtttatttgcgcgtctcgcaaatcaacggctgcgcattttgtctggagatgcacagcaaagcattgcgcaaatccggcgtgccacagcacaaactggacgccctggcaggttggcgcgtaagccatcattttgatgaacgcgagcgggcggcgctggcatgggcggaatcggtaaccgaaattgccagaacccatgcggaagacgaggtttatcagcctttgcttgagcatttcagcgcagcagagatcagcgacttaacgtttgccatcgggctgatgaattgttttaaccgtctggccgtttccatgcggatgtaacttcttgatgccgggtatttgcccggcaaaaaaacacaaaatcccctaccccgttgagccattcatcggtggcgtaatcaatctaaaattcccatatcttgtgtggttgaatcttttttcaactacatctagtatctctgtatcaacagagagacaacccgacgcgtatcatcgcgccgtatcttcattttaaacggaaatacgaatcatgcgcattactatttacactcgtaacgattgcgtccagtgccacgccaccaaacgggcgatggaaaaccggggctttgattttgaaatgattaatgtcgatcgcgttcctgaagcggcagaagcgctgcgtgctcagggctttcgtcagttgccggttgtgattgcaggcgatcttagctggtctggtttccgcccggacatgatcaatcgtctgcatccagcgccacacgcggccagtgcatgagccagctcgtctacttttccagcagctccgaaaatacgcagcgttttatcgaacgtttagggctgcccgcggtgcgcatcccgctcaatgagcgggaacggattcaggtagacgagccttacatcctgatcgtgccctcttacggcggcggcggtacggctggcgcggtgccacgacaggtcattcgctttttaaacgacgagcataaccgggcgttgctgcgcggcgttattgcttcgggtaatcgcaactttggtgaggcatatggccgcgccggagatgtgattgcccggaaatgcagcgtgccgtggctgtaccgctttgaactcatgggtacgcaaagcgatatcgaaaacgttcgtaaaggagtaaccgaattttggcaacgacaaccgcagaacgcctgacgcaggaaacgatggattatcacgctctgaatgcgatgcttaacctttacgatagcgcaggtcgcattcagttcgataaagacagccaggccgtagacgcctttatgacgacgcatgtgcgtccgaacagtgtggccttcagtagccagcagcagcgcctgaactggctggttaacgaaggttactatgatgaaagcgtccttaatcgctactctcgcgattttgtcattacgctgtttgcccacgcgcacgccagcggttttcgtttccagacattcctcggagcatggaagttttacaccagctatacgttgaagacattcgacggtaagcgttatctggaagattttgccgatcgcgtcacgatggtggcgctgacgctggcacaaggcgatgaaacactggcgacgcagctcactgatgagatgctgtcaggacgctttcagccagccacgccaacattcctcaactgcggtaagcagcagcgcggcgaactggtttcctgttttctgctgcgtattgaagacaatatggagtcgattggccgggcagtaaattccgcactacaactgtcgaaacgcggcggcggcgtagcatttttgctgtcgaatctgcgggaagcgggcgcgccaattaaacgtattgaaaatcaatcttctggcgtgattccggtgatgaaaatgctggaagacgcattttcctatgccaaccaactcggcgcgcgtcagggggctggtgcagtctatttacatgctcatcatcccgatattctgcgttttctcgatacaaaacgggaaaatgccgacgaaaaaatccgcattaaaacactgtcgctgggcgtggtgatcccggatatcactttccatctggcaaaagagaatgcgcagatggcgctgttttcgccctatgacgtagagcgagtttatggcaagccgtttgccgatgtcgccatcagtgaacactatgacgaactggttgccgatgaacgcatccgcaaaaaatacctcaacgcccgtgatttcttccagcgactggcagaaatccagtttgagtctggctatccgtacatcatgtatgaagacacggttaaccgtgctaaccctatcgccgggcgcataaatatgagcaatctctgctcagaaattttgcaggttaacagcgcctcagaatatgacgagaatctcgactatgctcgtacaggacatgatatttcctgcaatctagggtcgttgaatattgcccacaccatggattcccccgactttgcccgcacggtagagactgccgtacgcggtttaacggcggtgtcagatatgagtcatatccgcagcgtgccgtccatcgaagccggaaatgccgcctcacacgccatcggtctggggcagatgaatttacacggttatctggcacgagaaggcatcgcttatgggtcgccggaagcactggatttcaccaatctctatttctataccatcacctggcacgcactgcgtacctcgatgttgctggcgcgcgaacgcggtgaaaccttcgccgggttcaaacagtcacgctatgccagtggtgaatatttcagccaatatctgcaaggtaactggcagccgaaaacggcgaaagttggcgaactgtttgcccgtagcggtattacgttacctacccgtgagatgtgggcacagctgcgcgacgacgtgatgcgctatggtatctacaaccagaatctccaggcggtgccgccaaccggttctatctcttatatcaaccatgccacgtcgagtattcatccgattgtggcgaaagtagagatacgcaaagagggcaaaacaggacgcgtttactaccctgccccgtttatgactaacgaaaatctggcgctgtatcaggacgcttacgaaatcggcgcagaaaagatcatcgacacctacgcggaagcgactcgccatgtcgatcaggggctgtcgctgacgctgtttttccccgataccgccaccactcgcgatatcaacaaagcgcagatttacgcctggcgcaagggtatcaaaacgctctattacattcgcctgcgtcagatggcgctggaaggcactgaaattgaaggctgcgtctcctgtgcactttaaggaatatctatgaaactctcacgtatcagcgccatcaactggaacaagatatctgacgataaagatctggaggtgtggaatcgcctgaccagcaatttctggctaccagaaaaggtgccactgtcgaacgatattcctgcatggcagacattaagtgtcgtagaacaacaactaacaatgcgcgtttttactggcctgacgctgctcgacacgctgcaaaatgttatcggcgcgccctcgctgatgcccgatgcactcaccccccatgaagaggcggtattatcaaatatcagctttatggaagcggttcatgcccgctcttacagttcaattttctcgacgctgtgccagaccaaagatgtcgatgccgcctacgcctggagcgaagaaaacgcgccgttgcagcgaaaagcacagattattcagcaacattatcgcggtgatgatccgctgaaaaagaaaatcgccagtgtgtttcttgaatcttttttgttctattccggtttctggctgccgatgtattttgccagccgcggaaagctaaccaataccgcagacctgatccgtctgattatccgggatgaagcagtccacggttactacatcggctataaatatcagaaaaaccaggaaaagatctcccaggcacagcgtgaagagttgaagagtttcgccttcgatttgttgctggaactctatgacaacgagttgcaatataccgatgagctgtacgccgaaaccccgtggtctgacgatgtaaaagcgtttctctgttacaacgccaataaggcgttgatgaatctgggctacgaaccgctatttcccgcagaaatggcggaagtgaatccggcaatcctcgccgcgctttcgccgaatgccgatgaaaatcacgatttcttttccggttcaggctcttcatatgtgatgggaaaagcggtcgaaacagaagatgaagactggaatttctgagggggttattttcaaaaatatcactacccgctgcagggaaataattcccgccaaatagctttatatcacgtaaataatttgtggtgatctacactgatactctgttgcattattcgcctgaaaccacaatattcaggcgtttttttgctatctttgacaaaaaatatcaacttttctcgatttgctctcagcccttatatcatgggaaattccggcgatttgctcacatcaatattcatgccacatttgccctcaggggttgcctcagattctcagtatgttagggtagaaaaaagtgactatttccattgggtaatgtatcgacataaacaaataacaggaatctttctattgcatggcaattaaattagaaattaaaaatctttataaaatatttggtgagcatccacagcgagctttcaaatatatcgaacaaggactttcaaaagaacaaattctggaaaaaactgggctatcgcttggcgtaaaagacgccagtctggccattgaagaaggcgagatatttgtcatcatgggattatccggttcgggtaaatccacaatggtacgccttctcaatcgcctgattgaacccacccgcgggcaagtgctgattgatggtgtggatattgccaaaatatccgacgccgaactccgtgaggtgcgcagaaaaaagattgcgatggtcttccagtcctttgccttaatgccgcatatgaccgtgctggacaatactgcgttcggtatggaactggccggaattaatgccgaagaacgccgggaaaaggcccttgatgcactgcgtcaggtcgggctggaaaattatgcccacagctacccggatgaactctctggcgggatgcgtcaacgagtgggattagcccgcgcgttagcgattaatccggatatattattaatggacgaagccttctcggcgctcgatccattaattcgcaccgagatgcaggatgagctggtaaaattacaggcgaaacatcagcgcaccattgtctttatttcccacgatctcgatgaagctatgcgtattggtgaccgaattgccattatgcaaaatggtgaagtggtgcaggttggtacaccggatgaaattcttaataatccggcgaatgattatgtccgaaccttcttccgtggcgtcgatattagccaggtgttcagtgcgaaagatattgcccgtcgtacaccgaacggcttaattcgtaaaacccccggcttcggcccgcgttcggcactgaaattattgcaggatgaagatcgcgaatatggctacgtcatcgaacgcggtaataagtttgtcggcgctgtgtctatcgattcgcttaaagccgcgttaacgcagcagcaaggtcttgatgcggcgctgattgatgcgccgttagcggtcgatgcacaaacgcctcttagcgaattgctctctcatgtcggacaggcaccctgtgcggtgcccgtggtcgacgaggaccaacagtatgtcggcatcatttcgaaaggaatgctgctgcgcgctttagatcgtgagggggtaaataatggctgatcaaaataatccgtgggataccacgccagcggcggacagtgctgcacaatccgcagacgcctggggtacaccggcgactgcaccgactgacggcggtggcgctgactggctgaccagtacgcctgcgccaaacgtcgagcattttaatattctcgatccgttccataaaacgctgatcccgctcgacagttgggtcactgaagggatcgactgggtcgttacccattttcgtcccgtctttcagggcgtgcgcgttccggttgattacatcctcaacggtttccagcaattgctgctgggtatgcccgcgccggtggcgattatcgttttcgctctcatcgcctggcagatttccggggtcggaatgggcgtggcgacgctggtttcgctgattgccatcggcgcaatcggtgcctggtcacaggcaatggttaccctggcgctggtgttaacagccctgctgttctgtatcgtcataggtttgccgttggggatctggctggcgagaagtccgagagcggcgaaaattattcgtccactgcttgatgccatgcagaccacgcccgcgtttgtttatctggtgccaatcgtcatgctgtttggtatcggcaacgtgccgggcgtggtggtgacgatcatctttgcgctgccgccgattatccgtctgacgattctgggaattaaccaggttccggcggatctgattgaagcctcgcgctcattcggtgccagcccgagccagatgctgttcaaagttcagttaccgctggcgatgccaaccattatggcgggcgttaaccagacgctgatgctggccctttctatggtggtcatcgcctcgatgattgccgtcggcgggctgggtcagatggtacttcgcggtatcggtcgtctggatatggggcttgccaccgttggcggcgtcgggattgtgatcctcgccattatcctcgaccgcctgacgcaggccgttgggcgcgactcacgcagtcgtggcaaccgtcgctggtacaccactggccctgtcggtctgctgacccgcccattcattaagtaactctgcacttgcccggtgacgccgggcgttatcaccctgccaaaaaaaggaataacaatgcgacatagcgtactttttgcgacagcgtttgccacgcttatctctacacaaacttttgctgccgacctgccgggcaaaggcattactgttaatccggttcagagcaccatcaccgaagaaactttccagacgctgctggtcagccgcgcgctggagaaattaggttataccgtcaataaacccagcgaagtggattacaacgttggctacacctcgcttgcttccggcgatgcaaccttcaccgcagtgaactggacgccactgcatgacaacatgtacgaagctgccggtggcgataagaaattttatcgtgaaggagtatttgttaacggcgcggcacagggttacctgatcgataagaaaaccgccgaccagtataaaattaccaacatcgcgcaacttaaagatccgaagatcgccaaactgttcgataccaacggcgacggtaaagcggatttaaccggctgtaacccaggctggggctgcgaaggtgcgatcaaccaccagcttgccgcgtatggactgaccaataccgtgacgcataatcaggggaactacgcagcgatgatggctgacaccatcagtcgttacaaagagggtaagccggtgttttactacacctggacgccgtactgggtgagtaacgaactgaaaccggggaaagatgtggtctggttgcaggtgccgttctccgcactgccgggcgataaaaatgccgataccaaactgccgaatggcgcgaattacggcttcccggtcagtaccatgcatatcgttgccaacaaagcctgggccgagaaaaacccggcagcagcgaaactgtttgccattatgcagttaccagtggctgatattaacgcccagaacgccatcatgcatgacggcaaagcctcagaagacgatattcagggccacgttgatggttggatcaaagcccaccagcagcagttcgatggctgggtgaatgaagcgctggcagcgcagaagtaatttttattcgggcggataaggcgtttttgcctcatccgccgctctgtacacaatgcctgatgcgacgctggcgcgtcttatcatacctacaaaccacaccgcacatttcaacaatctatctttcatcccatattcatcaacatccgctattattgatttccagcttaatcatcacctgatgaacaaaaataatgactaaacctaatcatgagcttagcccggcgctgatcgtgctgatgtctatcgccaccggtctggcggtagccagtaactattacgcccagccattgctcgacaccatcgcgcgtaacttttccctttccgccagttcggcaggctttattgttaccgccgcgcagttgggctatgccgcaggtctgctgtttcttgttcccctcggtgatatgtttgaacgccgccgcctgattgtctcgatgaccttactggcagcaggcggcatgttaatcactgccagcagtcagtcgctggcgatgatgatcctcggtacagcattaaccggtttattttcagtcgtggcacaaattctggttccactggcagcgacgctggcttcaccggacaaacgcggcaaagtggttggcaccattatgagcggtctgctattggggatcttactcgcacggaccgttgccggattgctggcgaatctcggcggctggcgcaccgtcttttgggttgcttcgatgttaatggcactgatggcgctggcattatggcgtggtctgccacaaatgaaatcagaaacccacctcaactacccacagttgttgggttccgttttcagcatgtttatcagcaataagatcctgcgcacccgcgcgttgctgggctgcctgacctttgccaacttcagcattctctggacctcaatggcctttttgcttgccgctccaccttttaactacagcgatggtgtaattggtctgtttgggcttgcgggagctgccggagcgttgggcgctcgtccggcgggcggttttgccgataagggcaaatcgcaccacaccacaactttcggtctgctgctgctgttactttcatggctggcaatctggtttggtcacacttccgtactggcgctgattatcggcatcctggtgctggacctcaccgtgcagggcgtgcatatcactaaccagacggtaatttatcgaatacaccctgatgcgcgtaatcgcctgaccgcaggttacatgaccagctactttattggcggtgccgctggttcgctaatttcagcctcagcctggcaacatggcggttgggctggcgtgtgtctggctggcgcgacgattgccctggttaacttactggtctggtggcgaggttttcatcgtcaggaagccgcaaattaagcaatcagcaaccgttttcgtggctttacacttataagggtgttaagaagcccatcagtctgataaggttaagatattcattcagtctatttataatattaacaatcgttaagcgtacactctatggaaagccctactccacagcctgctcctggttcggcgaccttcatggaaggatgcaaagacagtttaccgattgttattagttatattccggtggcctttgcgttcggtctgaatgcgacccgtctgggattctctcctctcgaaagcgtttttttctcctgcatcatttatgcaggcgcgagccagttcgtcattaccgcgatgctggcagccgggagtagtttgtggattgctgcactgaccgtcatggcaatggatgttcgccatgttttgtatggcccgtcactgcgtagccgtattattcagcgtctgcaaaaatcgaaaaccgccctgtgggcatttggcctgacggatgaggtttttgccgccgcaaccgcaaaactggtacgcaataatcgccgctggagcgagaactggatgatcggcattgccttcagttcatggtcatcgtgggtatttggtacggtaataggggcattctccggcagcggcttgctgcaaggatatcccgccgttgaagctgcattaggttttatgcttccggcactctttatgagtttcctgctcgcctctttccagcgcaaacaatctctttgcgttaccgcagcgttagttggtgcccttgcaggcgtaacgctattttctattcccgtcgccattctggcaggcattgtctgtggctgcctcactgcgttaatccaggcattctggcaaggagcgcccgatgagctatgaggttctgctgcttgggttactggttggcacggcgaattattgcttccgctatttgccgctgcgcctgcgtgtgggtaatgcccgcccaaccaaacgtggcgcgataggcatattgctcgacaccattggcatcgcctcgatatgcgctctgctggttgtctctaccgcaccagaagtgatgcacgatacacgccgtttcgtgcccacactggtcggcttcgcggtactgggtgccagtttctataaaacacgcagcattatcatcccaacactgcttagtgcgctggcctatgggctcgcctggaaagtgatggcgattatataacccacaagaatcatttttctaaaacaatacatttactttatttatcactgtcgttactatatcggctgaaattaatgaggtcatacccaaatggatagttcgtttacgcccattgaacaaatgctaaaatttcgcgccagccgccacgaagattttccttatcaggagatccttctgacccgtctttgcatgcatatgcaaagcaagctgctggaaaaccgcaataaaatgctgaaggctcaggggattaacgagacgttgtttatggcgttgattacgctggagtctcaggaaaaccacagtattcagccttctgaattgagttgtgctcttggatcatcccgtaccaacgcgacgcgtattgccgatgaactggaaaaacgcggttggatcgaacgtcgtgaaagcgataacgatcgccgctgcctgcatctgcaattaacggaaaaaggtcacgagtttttgcgcgaggttttaccgccgcagcataactgcctgcatcaactctggtccgcgctcagcacaacagaaaaagaccagctcgagcaaatcacccgcaaattgctctcccgtctcgaccagatggaacaagacggtgtggttctcgaagcgatgagctaacgcgtcatctcgctcaaaaatccagatttataaaagaaaaaatgactggccagcatcgcaacatgctggcctttttggcaagcaggtcggctcagccgatgagttaagaagatcgtggagaacaatatgagcgcaaatgcggagactcaaaccccgcagcaaccggtaaagaagagcggcaaacgtaagcgtctgctcctccttctcaccttgctctttataattattgccgtagcgatagggatttattggtttttagtactgcgtcatttcgaagaaaccgatgacgcatacgtggcagggaatcagattcaaattatgtctcaggtgtctggcagcgtgacgaaagtctgggctgataacaccgattttgtaaaagaaggcgacgtgctggtcactctcgacccgacagatgctcgccaggcatttgaaaaagccaaaactgcactggcttccagcgttcgccaaacccaccagctgatgattaacagcaaacagttgcaggcgaatattgaggtgcaaaaaatcgccctcgcgaaagcacaaagcgactacaaccgccgtgtgccgctgggcaatgccaacctgattggtcgcgaagagctgcaacacgcccgcgacgccgtcaccagtgcccaggcgcaactggacgtcgctattcaacaatacaatgccaatcaggcgatgattctggggacgaaactggaagatcagcctgccgtacaacaggctgccaccgaagtacgtaacgcctggctggcgctggagcgtacccgtattgtcagtccgatgaccggttatgtctcccgccgcgcggtacagcctggggcgcaaattagcccaacgacgccgctgatggcggtcgttccagccaccaatatgtgggtggatgccaactttaaagagacgcagattgccaatatgcgtatcggtcagccggtcaccatcaccaccgatatttacggcgatgatgtgaaatacaccggtaaagtggttggtctggatatgggcacaggtagcgcgttctcactgcttccggcgcaaaacgccaccggtaactggatcaaagtcgttcagcgtctgcctgtgcgtattgaactggaccagaaacagctggagcaatacccgctgcgtatcggtttatccacgctggtgagtgtcaataccactaaccgtgacggtcaggtactggcaaataaagtacgttccacaccggtcgcggtaagcaccgcgcgtgaaatcagcctggcacctgtcaataaactgatcgacgatatcgtaaaagctaacgctggctaatccagaggtgcgtgtgatgcaacagcaaaaaccgctggaaggcgcacaactggtcattatgacgattgcgctgtcactggcgacattcatgcaggtgctggactccaccattgctaacgtggcgatccccactatcgccgggaatctgggctcatcactcagtcagggaacgtgggtgatcacttctttcggggtggcgaatgccatctcgatcccgcttaccggctggctggcaaagcgcgtcggggaagtgaaattgttcctctggtcaaccatcgcctttgctattgcgtcgtgggcgtgtggtgtctccagcagcctgaatatgctgatcttcttccgcgtgattcaggggattgtcgccgggccgctgatcccgctttcacaaagtctattgctgaataactacccgccagccaaacgctcgatcgcgctggcgttgtggtcgatgacggtgattgttgcaccaatttgcggcccgatcctcggcggttatatcagtgataattaccactggggctggatattcttcatcaacgtgccgattggcgtggcggtggtgttgatgacactgcaaactctgcgcggacgtgaaacccgcaccgaacggcggcggattgatgccgtggggctggcactgctggttattggtatcggcagcctgcagattatgctcgaccgcggtaaagagctggactggttctcatcacaggaaattatcatcctcaccgtggtggcggtggtggctatctgcttcctgattgtctgggagctgaccgacgataacccgatagtcgatctgtcgttgtttaagtcgcgcaacttcaccatcggctgcttgtgtatcagcctcgcgtatatgctctacttcggcgcgattgttctgctgccgcagttgttgcaggaggtctacggttacacggcgacgtgggcagggctggcctctgcgccggtagggattattccggtgatcctgtcgccgattatcggccgctttgcgcataaactggatatgcgccgactggtaaccttcagctttattatgtatgccgtttgcttctactggcgtgcctatacctttgaaccgggtatggattttggcgcgtcggcctggccacagtttatccagggttttgcggtggcctgcttctttatgccgctgaccaccattacgctgtccggtttgccaccggaacgactggcggcggcatcgagcctctccaactttacgcgaacgctggcggggtctatcggcacgtcgataaccacgaccatgtggaccaaccgcgagtcactgcaccatgcacagttgactgagtcggtaaacccgttcaacccgaatgctcaggcgatgtacagtcaactggaagggcttggtatgacgcaacagcaggcatcaggctggattgcccagcagatcaccaatcaggggctgattatttccgccaatgagatcttctggatgtcagccgggatattcctcgtcttgctggggctggtgtggtttgctaaaccgccctttggcgcaggtggcggcggaggcggtgcgcactaaggttgtcaaagggagctgcggctccctttttatttgctcatactgtaaacggttgtttaatccactcattcggtgtatcttttcgccgccccaaactcttccattcaccattaaccggttctgagcattcgctcaggttgttaattctctttttccttcgccctcgctttcgcgggtgatactcacatttttcttttaaccccataactcgcaccctcgcgggcgtacatttattacacacaaaataatggattattatgaatacccaacggaaatacgggagaacctggcattatcctttctcccctggcaccaccagcgatgaccgcattaacgccgattactggcaggatttacaggccatcacgcaactggtgcacacagaaaaactcgacggcgaaaataactgccttaaccgctacggcgtgtttgcccgttcccatgctgcgcctacgcagtcggcatggacttataaaattcgccagcgttggcaactgctgaaaaacgatctcggcgatctggaactgtttggtgaaaatctctacgccgttcattccattgaataccgcgcgctggaacaggacttttacctgtttgccgttcgctgccaggatatgtggctgagctgggaagaggtgcagttttacgccgctctgtttgatttcccctgcgttcccgaaatctccggcccgcagccggggaatgatgaaaaaagctggcaacgtgattttctggcgctgaccaatgcgcgcggcacattcgatccctgggatacgcaaacctgtcaaccctgtacgctggaaggcattgtcagccgaaatcatgatgcgttttctgtcgctgacttttcgcataacgtcttcaagtatgtgcgcaaaaatcatgtcaaaaccactgtgcactggaaacgccactggcaacgggcgcggatggcccatgagttcgtttatggagaacagtcatgatttggcaacttaccgacgataaacgctggtcggcgctacgtcagcgttttagctgggttgaggagatgcatcacacgccacaagaccctgagcatcatggtgaaggcgacgtcggcgtacataccgaaatggtgcttaacgccctcattactctgccagaattccagcaactccccgctcaacagcaggaagttttatgggcggcggcgttattgcatgatgttgaaaagcgcagcactaccgtgcaggaaaacggacgtattcagtctcctggtcatgctcgtcggggcgaactgacggcccgacaaattttatggcgcgatatcccaacgccgttcgtgctgcgcgagcaaattgttgcactggtgcgtctgcatgggttaccgctatggttactggaacgcccggaaccggagcgtttgttgctcacggctgcaatgcgcatcgacacgcgtctgctcgctttgcttgctcgtgccgatctgcttggtcgccaaagcccggatcagcaatcaatgctggaacgcatcgatctgttcgagctgttttgccatgagcaacaatgctggggaaaaatgcgcccgttcgtttctgattccgcacgctggcattacctgacccatgagcaaagttctcctgattttgttccctgggaggctgaaccttttgaggtcattttgctgtgtggcttaccgggtatgggcaaagatcgctatatcaatgaacagtgccagggaatggacgttatcagccttgatgatatgcggcggcgaatcaatgccagtccggacgacaaaaccgctaccgggcgtattgtgcaacaggcaaaagaagaggcgcgcgtttttttacgccagaaaaagccgttcatctggaatgcaacgaacattacccgccagctacgcagccagctcatcagtctgtttacggcttacggcgcacgagtaaaaatcgtttatctggaagtgccatgggcgcaatggaagcagcaaaatgccagacgcgagtatgcagttcctgaagcggtcatgatgcggatggcctcaaggctggaagttcctcaacttgatgaagcacatagcgtggaatatcggatgactgacaggtaacaaaagccgggcggtgttttcaccagcccggcctcttctgcttaaactgactaaatgtgcagttcctgcaacttctctttcggcagcgccagttcttcgttgctgttgatgcgcacgtcacgttccagaatgctacgcgcaatatcctgcgcttcctgcaacgagtgcatctggtaagtgccacactggtagacgttcagttccgggatctgattctgatcctgcactttcagcacgtcttccattgccgctttccaggcatcagcgacacgctgctcatctggcgtaccaatcagactcatataaaaaccggtgcggcagcccattggcgagatatcgataatctctacgccattaccgttaagatggttacgcataaaaccagcaaacaggtgctccagggtatggatccctctttctggcatcacttctttgttcggcacgcagaagcgcagatcgaacacggtgattgcgtcgccatgcggggtgttcattgtttttgccacccgaactgcaggcgcttccatccgggtatgatcgactgtgaagctatctaacaacggcatttagccacctccggtaatttttttaaaaattttctgaactctttgttcccaggcgagtctgagtatatgaaagacgcgcatttgttatcatcatccctgaattcagagatgaaattttggccactcacgagtggcctttttctttatctgtcaggcgtgcttttccagccacaccgcaaacggttcggtatcagcggcttccatttcctgctgacggcgttcagacgcctcgcgctcggcgacaaaatcctcttcgcgcagaatttccagcggctcttcacgcagcagattacggtacgcttcagcaaacgctttgcctgttccgccaataccagtatcaatcatagaccttaagatacgggcagagaaagtcagatcgggattatcgaagcaggcgaccagttcatcacacactttctgatacgcttcgccgccgttaatgctatccagcgtttgcgcgacgcgtttcagatcgcggaacagatctttacccacctgcggtaacgggaactgcgcggtttcgcagccgatacccagcgtcaggcccggtttgcgaccttcgaggatcacccggttccagttaacgcgtgtacaggcaagttcgctactgctcatttccggtgcgtcagccagcgcacaccagaccataaacaggtcgaggaatcgcacctgttgttcatctacaccaatcggcgagaacgggttgatatccagcgagcggacttcaatatattcaatgccgccacgtaacagcgcatcagaaggcgactcaccactgcgggtaacgcgttttggacgaatcggcgcgtacagttcgttttcaatctgcagcacattgctgttgatttgcagccgcttaccgtctttctcaataccaatcttcgcgtactcttccgatggcgttttgattgcctgtttaaggcccgccacgtactcgtagagatcattgaaggtgataccaagattgctttgcgatttattggtatagccaagatcgctcaaacgaagagaggtcgcatacggcagg

SEQ ID NO: 10030 - DNA, 38746 bp, Escherichia coli
cgacaaacagcgacatacgcgtatcttcattaaagtacatgccgatcaaaacgcaaatcaggaatgccattgttacgtagttggcccaagggaacaggattgagcggaacggatggctggcaattgctgctttatgcgcacgacgaaaacgcagctggcttatcaatatcacaaaccatggcaccatccccggaagcacgctggcactgtagacgtaaacaaacacacgctgcggattgggaatgatgtagttcaggcatgagccaattagcagaatagcaatagatactgccacacccgcaaccggtacgccgtgacgggaaactttcgccattgccgccggtaactgacggtttttcgccagtgcgtagagcatacgtccgcaactgtacatgccgctgttacagccagagagcgcagccgtcagaaccacaaagttgataatgcccgccgctgcggtaatgccgattttggcgaaagtcagtacgaacgggctaccgttgctgcctatttcattccacgggaagatagtaacgataacgaaaatcgcgccaacgtagaaaatcaggattcgccacagcaccttgcctacggcactgcgcagcgtcacctgcggattcttcgcttcaccggcagtaatgccaatcagctccacgccctggtaggacgccaccacaatacacaatgcggtcaggaaccctttccagccaccagcaaagaaaccgccatgctctgtgagattgctaaaaccaatcgactgcccgccattgccaaagccaaagaaaatcacgcccaggccaatgacaatcatcacgataatcgtggtgactttgatcatcgcgaaccagaactcgatttcgccgtacaacctcaccgcagccagattcgccaacgccaccagcgccaccgcgatcaatgcgggtatccactgcgccatctccgggaaccagaactggacataaacgccaatggcggtgatttctgagatccccaccgccatccacataaaccagtaagaccaggcggtgagataaccaaagaacgggctcatataacgatgcgcgtaaacggcgaacgaaccggtaaccggttcgaggaacaacatttcgcccattgaacgcatgatgaaaaagacgaacagcccggcgatgatataggccaacaatacggatggcccggcccatttcagggtactggcggcccccataaacaggccgacgccaatggtgccccccagggcgatgagttcgatatgtcgagcttccagcccacgctgtagctctggtttgttatctgccataaatcctcgtgttgtgtttgcatgctttccggtgttaccgtttatcgttatgggtacatcgagtgttgcgaatgttttcgtaattcaggagaaatggcaaataaagcattaaaaatttgaatgctttgtgtaataaaaaagcagacaggcgacgaagtgaccactccgtcgctttacaaagagaggaaaatcagaggttgccggtgtaatgccagcgtaaataacgcagcaaacgaagctgacgcttaatgcggctcggctgcgaaagcaggcggtagagccactccagccccagcgtttgccagattttcggtgcgcgttttacgtgaccggtgaaaacatcgtaggtcccgccaacgcccatatacagcgcatctggatgcaccagacggcagtcgcgcatgaagatctcctgctttggcgctcccatcgcaacggtgacgatttgcgctccgctggcatgaatgcgttcaaacagcgcctgacgctgctcgggtttaaaataaccatcctgactgccaacgatattcacattccactggttgcgcagtttagcttcagtttgcgccagcacttcaggtttaccgcccacaagaaatacctgtgtcccttctttgcctgcgcgcgccatcagctcttcccagagatcggccccagcaacgcgggaaacctgcgcctgcgggtactttttacgtactgaacgtacaacgcttatgccatccgcatatttaaattcggcagcgttaattaactccctgacctcagcgttatcttcaatggtcagcattttttcggcattaatggcaaccagcgttccctgcttaagctgcccgtcagcgaacagataatcgagggcgtgctgcatatcacgccaaccaatcaactgtaagccacgcagcgtataggtcggtgccgtggtgttgttattcattgttatccttcaacctgcgtccggagcgatgattttgttcgtttatgaatgagtccggcgctttcaaaaagccagtacaacagttttgcgatcatcagacatgcgccgaagaccacgataaaaaagaccacgcgtgagacaaacgaatccagcccttcacgcgccagcacgatcatattgaagatcgccccgaagcagaaactgtgcaatatcgcagccttatagcgattagtctcgcggttgcccagctcatacagccagtcgaaccatttgataatcagtccaaccacaatcgccccgagcgggatgaacaacgcgccgcccataacaaccagtgagcctataagcgtaggcgagatcgccagtccggagtggttattcagcacttcccaggtaaagtagttggcggagttcagcaccatactcgggcgacccggccacagccaggaagggataaagacatagaaatcgcggacaattggagccaggccctggaagtcgatgttgtcgtagttctgcaacagcaacgccagattctcccacggcgagaaggtgtcgcgagtgagatagagaaacgtatagaacgcttcatcgccgctcacattcattccatagcgttttagcgccagccagaacatgcccacaatccccagcacgcccgccgccgccagcatccacaacgaaatccagccgcgaataatgccaataaacaggaagatagcgaatgcgatgatgatattggcgcgagtgccgccgacaatcatgtaagtcaacaagccaaaggcaaccgtgctgacgaggaaaaacagccacgctttgctatcctggcgcagaaaataaaccaccagcatcgccgggatgaaaaagtaaaagaagcgttttaatgccacgccggagacttcgctggaaaagatctgactgtaagaattaagccggaacagcaaaaagccgttgtgcatgaagaagatgccgacgctcaccagagcgatgcccatcaggatcacccacgtgagattggtctccacgcggttcatggtaaacagcggacggcgcggtgcatcagcaacgcgtttgcgtagacgggttttgtaggtgacatagtaaaccgcgtagaagcagcctgcagaaagcaacgcctgcaacaagatttctggcggcgcgacaccaacatcaaagcgaaataccagcacgctggtcagcggaaagccgaagaaaaaggtgagcaaaaacagcaatgaaaagaagacattgaagttaaagcgcacacggcgaaactcaaaccaggtcagcgtggcaataaacagcgtgcagagcagccagacaacaaacaggccactgaattgcagcagactcatgcgacctccccggcggcaatcgccaacgcccgctgccagccttgtagatagttagggctaaagaaggcaatggtgtttttatccaccgacgccaactggcgctgcgcttcacgcacaatatcctcgttgagatcatcggtagtaaacagtactggcaaatgctgttccgtcatatcctgccagaacggattttcccggttaagcacgcaaggaatgcccgcctgaatcagtaagcaaagcgtaccaatgccctgctggcgggcaaaaataaagtaaccgagatcgcactggcgaagtagcgtcagataggcgtcaaattccagtttttcgctcagaacttgtaggttttcttcgctgaataactccagtcccgcctgacgaacttcctcgatgtacgcttcgttattaggcggatatcccatcggcaccaccacttttaccgtatcgccaaattgctgatgaacggcgcgcaaggcagcaatatgctcattgctgcggtcaccggagttccccaccagaatggtcatttttccttcacgttgccgatcgttcgccatcgtattaagagaagggtccatccgcgtcgggaagtacagcagttctccccgcacctttggatgcgttttggcaaaaaagctcaaatcaccgcgggtggcaaatacacagccgactctcttttgcgccaggcgacgtagcgggtaaaaaagcttatatctcaagccactggaaagctcatacaggtctgctccccagatatgccagaaaaactggctgggcttaatgccaccactcagcagagccagccacagtttgggattgaactgaccgtggaaaaaaaatcgctgctgacggttagcttttgctttcgcgatgaccgcttccgccagcgattttttcccagggaaaaattgcacagaaagcgccggacagctatcacttaagccgtcgtccttgccagcaaccataaactcgcgcgcgtgcccgctcgtcgcggccagcgcgtcgttgaaaaaccgcagaacggttcggttatggtgagggatatccgatcccagtacgtgaatcagtacagtcatgcccacctacgccagagtaaaaacacgccacaacaaagagaaaaatagacgatataggttgccatataggcctgtgctgcgcccagtgcgccatgcgcagggattagccagtgggcaaataccatcaataaagtgaactggctgatttccgccagaatataaaaccgcagtgacgctttggcgatcaccagataaccaaagacataagcgcccacttttaacacatcacccaccaactgccaggcaaagagatcgcgcatagcggtaaatttattcgacaacagcagccagatagcaaaatcacgcagcaaccagacggtaaaactcgccgccgccactgccggtaagacgaatttcagcgatttaaccacttcccgggtgatatcgcgcttttccgttaaccgcgacaacgtgggcagcaaatatacgctgaacgatgccgtaataaattgcaggtaggcatcggaaatactgctcaccccttgccagatccccacttcatcccagctatactgcgccgccagcagtttacgcatcatgatgtaagcaacaggcaaggtcaccgacgtaatcaacgccatgagcgtaaatttgctcaactgccctgccagaccgttatcccagctgggtttcagatagcttaacgggatgacaccacgtttgatcaacatgataacagcaggaattaccaccagcgcgggaatcagcgccagacccagcaacgccccttcataaccgcccaaacgataactgacgtagtacgcgagaacgccaatcaagctaccgacaatcagagataacgcattacctgcggcatcgcgaaagcctttcatcaacgccagtaacaggttgccccaggcaatccccatttgcaccagcgccactaaacgcaccagcccctgatagtcggtattaccaaacaacccctggctgattagcgcagctgccagcacaaaaaccagcgccattagcgtagagaagccaagtaccatcgctgatgaagtgccgaccacgcggcgcagctgttggggattatcatgatactgggcaacgtatttggttacgccgttaaagatgcctgccccggcaagcacgccgagcacggtaatcaactggcggaaatttgccgccagcccaagccccgccggaccaaatgacactgccagcaacttaccgaccagtaacccggcaccaatcttgaccagtgtactggccgccgtccacaaggacgcttttgccaacgacatatcaggagaagtagttcaacaaggtcgcaattaccgtacgctgattgacgggcgacaggttgtagaacaacggcaggcgcagcaggcgctcgctctctttggtggtgtagcgatcttcaccgtggaactcaccaaagcgttcccccgcagggcaaccgtgcagcggaatgtaatggaacaccgccatgatttccgcttctttcagaaagttaatcaatgcgctccggtcatcaatatcccgcagtttaatgtagaacatatgcgcgttctgcacgcagccatcgggaatcgacggcagctcgatacgcccattttttgccagaggcgccagcgcatcgtagtagttttgccacagcgccagacgttgctggttgatacgatccgcagcttccagttgcgcccacaggtacgcagcttgcagatcggacatcaaatagctggagccaatatcgcgccaggtatatttatcgacctgaccacggaagaactggctgcggtttgtgcctttttcacggatgatctcggctcgttcgatcaacgctttatcgttaatcagcgtcgcgccgccttcaccacccgccgtgtagtttttggtttcatggaagctaaagcagccaatatgaccaatggttcccagcgcacgccctttgtaagtggacatcacgccctgagcggcatcttccaccacaaacagattatgcttcttcgccaacgccataatggtgtccatttcgcaggccacacccgcgtaatggaccggcacgataacgcgcgttttgtcggtgatcgccgcttcaatcagcgtttcgtcgatgttcatggtgtccgggcgaacatccacaaagacgattttcgcgccacgcagcacaaaggcattggcggtggagacaaaggtatagctcggcatgatcacttcatcgccaggctggatatcgagcagcagcgccgccatctccagcgaagcggtacaggatggcgtcagtaacactttggcgctgccaaaacgttgctccagccactgctggcagcgacgggtaaaaccaccatcgccgcacagtttgccgctacccattgccgactgcatatagtcgagttcggttcccaccaccggcggtgcgttaaatggaatcatgtgatcacctgtataaccagtacgcggtgctttctacattcgcaccactttgtatgtatcgtttaagcgcggcggtgttgcccatctgggtcgccacccgcaaagttgttttaccgcgagcatacgcccagtttagcgccgtttgcattagctcagcacctgcaccgcgtccagccagcaggccaattcgcgcatctgtcgcattgagttcccgtaaagagacataaccgcgaatatcgccggacgccgcacgtaaaatcagacattgatgatcaaaggtgccgcgcacggcattttcaatccactgtgcataaaagcgaccgctggcgtcaggcgcataccacggcgcacgaaaacggctttgcgcaaatgcggcgctggctaactgacgtaatgcgggaatatcggtctcttgtgccactactgcaccgctatcactgacattgttcacgggtagtgccaaatcaacttcaccttctaccagggagaatcccagctgttgcagagcatccagttcacccgtatttgatgccgcaattttggcctgcacccgtgaccacggcgctaacgcgtctggcgtcaggagcggtgcttcagacgtaatgcgcacgatggcgctgttaacaccaaagaaggcgttttcccaggttagtggctcaatactggcgcggacgggcacgaagtaactccagcagatattggccgtagccagttttcgctaatgaactggcagcacgcttcacaccctcgtcatcgagccagccgttacgccaggcaatctcttccaggcaggcaatcttaaagccctggcgtttttctactgtctgcacaaaagtgctggcctcaatcaggctgtcgtgagtgccggtatccagccaggcaaatccgcgcccgagcagttcaacggtcaggttgcccgcctcgaggtacatctggttgatggaggtaatctccagttcaccacgctccgacggcttcacctgctttgcgtactccacgactttactgtcgtagaaataaagcccggtcaccgcccagtttgatttcggctgttttggtttttcttccagcgagatagcgcggaaattgtcgtcaaactccaccacgccaaagcgttccgggtccatcacctgatagccaaataccgtcgccccttccgtgcgcgccgcaacatgacgcagcttcggactgaagccctgtccgaagaagatgttatcgcccagcaccagacaagaaggttcaccgttgaggaaggtttcaccgatgataaaggcctgcgccagaccgtccggactgggctgttcggcgtattccagctggataccgaactcactgccgtcacccagcaggcgctggaaataacctttatcttccggcgtagtaatgatgagaatttcgcggataccggctagcatcagcaccgacagcggatagtaaatcattggcttatcgtaaatcggcaacagttgcttcgatacgccgcgcgtaatcggatgcaatcgggtgccggaaccgcccgccaagataatacctttcatgtttgcctccgctgaaaattagcctttcagacctaaacgctcgccctgatagctgccgtcctgcacctgcttccaccagctttcattagccagataccactgcaccgttttacgcattccactttcaaaggtttcctgcggcagccagccaagttcacgggcaattttcgaagcatcaatggcataacgcagatcatgccccggacggtcagcgacaaaggtgatcaggtcacgatagtgcgccacgccgtgcggcttattcggagccagttcttccagcagctcgcaaatggtttccacaacatcgagattcttacgctcgttgtgaccaccaatattataggtttcaccgactttcccggtggtcgccgcgcaatacagcgcgcgggcgtgatcttcaacatacagccagtcacggatttgctgcccgttgccatataccggcagcggtttacccgccagcgcgttgaggatcatcagcgggatcagtttttccggaaagtggtaaggaccgtagttattcgagcagttggtgataagcgtcggcagaccataggtccgcagccaggcgcgcaccagatggtcgctgctggcttttgacgcggaataagggctactcggcgcatacggcgtggtttcggtgaagaaatcatccgtcgagtgcaggtcaccatatacttcgtcggtggagatatgatgaaaacggaacgctgattttttatcttccgtcagcgcagtccagtaagcccgcgccgcttcaagcagtgtataagtcccgacaatgttggtttcaataaacgctgccgggccgtcaatagaacggtcaacatggctttcggctgccagatgcatgacacagtctggctgatactcagtgaatacgcgcgccagttctgcccgatcgcagatatcaactttctcaaaggcaaagcgctcgctttgcgcgaccggtgccagcgacatcaggtttccggcgtaggtcagcttatcgaccaccaccaccgcgtcgctcgtttcgttgatgatataacgcaccagcgccgagccaataaacccggcaccacctgttatcagaatctttctcatcagcgccagactcctttggcatcgacgacatactgctgatggacgttgtcgccattgataactttgaactgactatgatcgaccagcatcaccagcacatctgccgttgccagcgcctcgtcaagctgcgccagagtacaaagcccggtcagtttcttcggcaactcgtggatgttaggctcaacaaccagcgtttcgccgctgtgccactgggcgatcagttcagcgatttccattgccggactttcgcgcaggtcatcaatattcggtttaaacgccagaccaaagcaggcgattttcagttcactgacgcgtttatcggtagcagccagacaatcagccaccgccgctttcacctgatcgataacccagaacggtttgtgatcgttcacttcgcgcgcggtacggataagccgcgcctgctgggggttctgtgccacgataaaccacggatcaacagcgatgcagtgaccgcccacgccagggcctggctgaagaatattgacgcgagggtgacgattcgccaggcgaatcagttcccagacgttaatcccctgatcggcacaaatcagcgacaattcattagcaaaagcgatattcacatcgcggaagctgttttcggtgagcttacacatttctgccgtccgcgagttagtgacgacacactcaccttcgaggaaaattttgtacagttcgctggcgcgggccgaacaaaccggcgtcataccaccaatcacgcgatcgtttttaatcagctcgaccataacctggcccggtaatacgcgttccgggcagtaagcaatgttgacgtccgccaactcgcccacctgctgtgggaaagtgagatctggacgcatctctgctaaccattctgccatcttctcggttgaccccaccggcgaggtggattcaaggatcaccaacgcgccttttttcagcactggcgcgatggagcgagcagccgattcaacgtaggtcatatctggctcatgatcgcctttaaacggcgtgggtacagcaatcaaccaggcatccgcttcaactggcgtcgtgctcgctcgtaaaaaaccgccttctacggcagtttttactacgctcgccaaatcaggctcgacgatatggatttcgccacgattgatggtatcaaccgcgtgttggttgatatcgacaccaatcacctgtttttgccttgaggcaaacgcagctgctgtaggcagcccgatgtaacccagtccgataacagaaatggtcgcaaaactcatagtgatatccgattattttttaacgcttccagaatgcgagagcatgcctgaccatcaccatacgggttatgggcgcggctcatagcttgatattcgttttcgtcttttaaaagacgcgtcacttcctcgacaattcgctgcttatccgtgccgaccagacgcaccgtccccgctgtcaccgcttccggacgctcagtggtatcgcgcatcaccagcaccggtttccccagcgaaggcgcttcttcctgaatgccgcctgagtcggtcaaaatcagccaagcgtggttcatcagccagacaaacggtaaatactcctggggatcgatcagaatgacatttttcacatgccccagaatgcgattgaccggctctctgacgttcgggttgagatgcaccggatagacaatctggatgtcctggtgcgtggtggcgatgtctgccagcgcctggcagatttcttcaaagccacgaccgaagctctcacgcctgtgaccggtcaccagaatcatctttttatcggggtcgataaacgggtaatttgccgccagttctgaacgcagcgtatcgctgctcatcacctggtcacgcacccataacagtgcatcgatgacagtattaccggtaatgaagattcggctgtcagcaacgttttcacgcagcaagttttgccgggaagtttcggttggagagaagtgatacatcgccagatgcccggtcaatgtacggttagcctcttccggccacggcgaatagagatcgcccgtgcgcagacctgcctcaacgtgaccaactggaatacgctgataaaacgccgccaggctggttgccagcgttgtagtagtatcgccgtgaaccagcacgacgtctggtttgaactcggcaagaataggttttagcccttccagaatccgacaggttatctctgtaaggccctgtcctggctgcattatgttgagatcgtagtcaggtacaatggaaaagagtttcagcacctgatcgagcatctcccgatgctgcgcagtgacgcaaactttagcctcaaaaaaaggatcttttgccaacgcatgcaccaacggtgccatcttgatggcttccgggcgcgtaccaaatacagtcagtactttcacatcgattctcttcgaataagcggcgagcgcctttgcgctcaccgcagcagtgttgctatttcgagcaacggcgggttaatgcgacaccagccccgatcagccccccgacaatgccccacataatcatcaggaaggcacgacgtgggctatcgcgttttaccggttcttccggcgtacgcaaatagcgataggtctgaaaacgcggatccagggttggaccaacattcagggtgtttaacatggcccgattttgatcatagtcgagatcaaaggccggaccgacggcctgtaaattttccagtcgagcctggagcattggacgcccaagcaggaacatttctgaatcaggtaattcctcggcaggcacatctgtcgcactgcgcgaaatattatgctgctcagcaattttcagcgcctgttcaatactgttcatccggcgatcgtagatggctttcgccacctcttcctgacgcttcacctgagctttcatctggatggtgcgtgccgcccatgcgcctttcagctcatcattcagatggctggctgcacgctggctggcaaaagcaacatactgacgtaacaggttattagcgtcaggcgcggtttcggcaataagcttcacgctgtcattgaccgcgcgggtaaagtcaccgggaataaacacgatgttgttaatcatttcatccagcaacgccgcatcggctttgctattgcccaccatccgctgtttgtaatagtcggtttgcagccagaactctctgcgggtatcccacgaggccagttgcataacaaactctttataggcttcgtccatgaccgatggttggtcggcagaagccatgtttgaacggacatccaggttacgcaaaaattgctgctgtgagtaatatccccccagcatattcaccgttggacgatcggtaatcgctgtcgagctccactcctggcgagcaaaaaaagtatacgccagcgcgattaacgcaaacgccagccccatgccaataatccacagcttcccagcccacaaggtacgaaacaacccacgaatatccagttcattttcagcgtcttcggccggtttcccaggcattggttgtgtcatcacatcctcatttatttggttaaattggggctgccaccacgatttctacgcagtctgcgttttacgcgcttaataaagcgagcaactttccaggcacgcttaatgcaatatccatagaggaagaatgctagcaaaaagagcaccagcatgacccactccgggacaaaatgagaatattctgccagcacgccaatggaagcgagcagtgctgcggcaagggtaatcagcacaaacgcctggcgggaagtaaacccggcacgcatgatcaaatggtgaatatgctgacggtctggagagaatgggctcatgcctttacgcaggcgacggtacataatcgccaccatatccattagcggaatggcgattatccacaaagcggtaaccgggctgatgggatgagttttgccctgggtcgtttcgagcaggatccagataacggtaaaaccaatcagcgtactgcccgcatcccccataaagactttgtagcggcgacccaggataccaaggttaagcatgatgtatggcaggatggcggcgatcatcgcaaagcaccagattgcgagactggtttgcccgtcgaaccacaaaatcataccgattgctgcaaacgagacgcaggacaacccgcccagcaagccatcaatgccatcaaccatgttgaacgcattaatggccgcccagacggcaaatagcgtcaggaagtaaccaaacggtccgagcaccatctcccaggagccaaagatataacccaggctactgagataaagtttgccgaacaccatcataacaatgccaacagcggcctgtatggtggcacggatttttacgctgatatcaaaacggtcatccagcgcgccaatgaaaacaagcacaccagcacaagcgagatagagagatgcatgcggaatatagtaatcgacaattccgaacgtgaagcaaatccctgcgtaaaccgaaatccccccaacgagaggtatcaatccctggtgacgtttgcggaagtttggtttatccactaaaccgactttttttgccaccttacgggcaaaaaacagaaacagtgtcgtgaataaaaaaatactgatgagatcagtactcactgtcagtaaattcacaatgcatgctctcagagaaaattattagcagaagtataaccacgaagacctttattcagaaaggaaagtccgttccgaacctaccagcactatgcgaaaattaactacttgatatgcaaattgcataacacaccagcaaaatccaggaattttcctaacatcgccagcgcggcattaagattacagatataaaagcaaaacgccacgtaaacacgtggcgtttttggcataagacaaatttatgagcgtttcatcatttcgaagaaatcgtcattggtcttggtcattgccagtttattaatgaggaattccattgcatcgatttcgcccatcgggtgaatgattttgcgcaggatccacattttctgcagttcttcctgagtcgtgagcagctcttctttacgggtaccggaacggttgtagtcgatagccgggaagacgcgtttttcagcgatcttacgagagaggtgcagttccatgttgcctgtacctttaaactcttcgtagataacttcgtccattttagaaccggtatcgataagcgccgtcgcgataatggtcaggctgccgccctcttccacgttacgcgccgcaccgaagaagcgtttcggacgatgcagggcgttggcgtccacaccaccggtcaacactttacctgacgccggaacaacggtgttgtaagcgcgcgccagacgagtgatggagtcgagcagaatgataacgtctttcttgtgctcaaccaggcgtttcgccttctcgatcaccatttccgcaacctgaacgtggcgagatgcgggttcgtcaaaggtagaagcaacaacttcaccttttaccagacgctgcatctcggttacttcttccggacgttcgtcgatcagcagaaccatcagcacacaatccgggtggttgtaagcaatgctctgagcaatgttctgcagcagcatggttttaccggctttcggcggtgccacaatcagaccacgctgaccacgaccgataggtgatgccagatccagtacgcgagcggttaaatcttccgtagaaccgttaccacgttccatacgcagacgagagtttgcgtgcagcggggttaagttctcaaagaggattttgttgcgggcgttttcaggtttgtcgaagttaacttcgttaactttcagcagcgcaaaatagcgttcaccttctttcggcgggcgaatcttaccagagatggtatcaccagtgcggaggttgaaacggcggatttggctaggggaaacgtagatgtcatcaggaccggcgaggtaggagctgtctgcggaacggaggaaaccaaatccatcctgcaatatctccagtacgccatcaccaaagatatcttcgccactctttgcgtgctgcttcaggatggcaaaaataatgtcctgcttacgcatacgagccaggttttccagccccatattttcgccgagagtgatcagctcagaaaccggcgtattctttaattcggtaagattcatagtggtgtgagttcttaaacttggggtaaatctcgaacttaatgttgtgaatggtatggcaggatcatccatgcctgtttacggtcatcgactcatgtcttttcgctgcctggtcacaggagagtacgcagaactgaaacgacaagacggattgagtgacgagccagaaatctgttcacttcgcatttaagataaaacgggaagcgttggaaattacaagattcaaacttaataaggtatgtttaatacgaagtcaacactaagttagcatgactcacgccgggcgtccagtttttagcgacggggcacccgaacatgaaattcccttacgccaggttagcgtcgaggaactctttcaactgacctttagacagtgcgcccactttggttgccgccacttcaccgtttttgaacagcagcagagtcgggataccacggatgccatatttcggcgcagtgccagggttttgatcgatgttcagttttgcaacggtcagtttgccctgatattcgtcagcgatttcatccagaatcggggcgatcattttgcacggaccgcaccactctgcccagaaatcgacgaggatcgccccgtccgctttgagtacatccgtgtcaaaactgtcgtcagtcaggtgaataattttatcgctcatatataactccacaggaataagcctggcgtgttggtttcgttgttggtgtaacattaaccaactaaaggttgactttatttcaccggatacgctttcgtaaagcaatagtaagctgatattctaccacactatgagcaaaacacatttaacagaacagaagttttccgacttcgccctgcatccgaaggttgtagaagcccttgaaaaaaaagggtttcataactgtacgcccattcaggcactggcccttccgctgacgctggcgggtcgtgacgtagccgggcaggcgcaaaccggtaccgggaaaacgatggcgtttcttacgtcaacgtttcattatcttctctctcatcccgcgattgccgatcgcaaggtgaatcaaccgcgtgccttaattatggcaccgacgcgtgaacttgccgtgcagatccatgccgacgcggaaccactggcggaagctactggcctgaagctgggtctggcttacggtggtgatggctacgacaaacagctgaaagtgctggaaagcggcgttgacattctgattggcaccacgggtcgtttaattgactacgccaagcagaaccacattaacctcggtgccattcaggtggtggtactggacgaagccgatcgcatgtacgatctgggctttattaaagatatccgctggctgttccgccgtatgccgcctgcaaaccagcgcctcaacatgctgttctccgccacgctttcgtaccgggtacgtgaactggcgttcgagcagatgaacaatgccgaatatattgaagtggaaccggaacagaaaacgggccatcgtattaaagaagagcttttctacccttctaacgaagaaaaaatgcgtttgctgcaaacgctgatcgaagaagagtggccagacagagcgattattttcgccaacaccaaacaccgttgtgaagagatctggggccacctggcggcagatggtcatcgtgtcggtttattgacaggcgatgtcgcgcagaaaaaacgtctgcgtattcttgatgaatttacccgtggggatctggatattctggttgccaccgacgttgccgcgcgtggtttgcatattcctgctgtgacacacgtctttaactacgatttacccgatgactgtgaagattacgttcaccgtattggtcgaacaggtcgcgcaggcgcaagcggtcactctattagcctggcgtgtgaagagtatgcattgaatttgcctgctattgagacctatattggtcactcaattccggtaagtaaatacaatccggacgcattgatgaccgatctgccaaaaccgctgcgcctcacgcgcccgcgcacaggcaatggtccgcgtcgtactggcgctccgcgtaatcgtcgtcgttcaggttaaagaaaaaatgtcatactccaaatcactcaagctgtatcaagatggcaagagaatgaatcccgatgcgcttactgtcgtaagtgattcaggtgaaggaatgcagccaacgcagagacagattgaaggatgaagagtatgggttccacctcgtcgctgtatgcagccattgatctcggttcgaatagttttcatatgctggttgtgcgcgaggtggctggaagcatccagacgctgacgcgaataaaacgcaaagtgcgtctggctgccggcctgaatagcgaaaatgccctgtctaatgaagcaatggagcgcggttggcaatgtctgcgcctgtttgctgaacgtctgcaagatatccctccctcgcaaattcgcgttgtcgctacggcgacattacgacttgccgtcaatgcgggtgattttattgccaaagcgcaggaaatcctcggttgtccggtacaggtgatcagcggtgaagaggaagcgcgtctgatttatcagggcgttgctcacaccactggcggtgccgatcagcgcctggtggtggatatcggcggagccagtactgaactggtaaccggcacgggtgcacaaaccacctctttgttcagcctgtcgatgggctgcgttacctggctggaacgctattttgccgatcgtaatctggggcaggaaaattttgatgctgcagaaaaagcggcacgcgaagtgttacgtccggttgccgatgaattacggtatcacggctggaaagtgtgcgttggcgcttccggcaccgtgcaggcgttacaggaaatcatgatggcacaggggatggatgaacgcattaccctggaaaagttgcagcaactgaaacaacgcgccattcattgcggtcggctggaagagctagagattgacgggctgacgctggaacgtgcgttagtgttcccgagtggtctggcgatcctgatagccatttttaccgaactgaatattcagtgtatgaccctggcgggcggtgcgctgcgtgaaggcctggtctacggtatgttgcatcttaccgtcgagcaggatattcgcagccgtacgctgcgtaatattcagcgccgctttatgatcgatattgatcaggcacagcgcgtagccaaggttgcggctaacttcttcgatcaggtggaaaatgaatggcatcttgaagcaataagccgcgatttgctcatcagcgcctgtcagcttcatgaaatcggcctgagcgttgacttcaaacaagcgccgcaacacgctgcttatctggtgcgtaacctagatcttcccggttttacccccgcacagaaaaaactgctggcgacgctactgctcaaccagactaatccggtcgatctctcatcgctgcatcagcaaaatgccgtaccaccgcgcgtcgcagaacaactctgccgtttactccgcctggctatcatttttgccagccgtcgccgtgacgatctcgtgccagagatgacattacaggctaaccatgaactgttgaccttgacgcttccgcaaggttggctaacccaacatccgctgggtaaagagattattgatcaggaaagccagtggcagagctatgtccactggccgctggaagtgcattaatgagtaagtgccggatgcgatgctgacacatcttttccggccttgattatttccctcgttttgccgccatcatcgctttcagattcgccagatggctttgccctttctgcatccgttcttcggcgctgaccactttgcgctcctgttcccaaatcaaatcatcctgcggcagctccagcaggaagcggctcggctccgggcgcaccagttcgccgtactgacggcgttctttacacagcgtaaaggtcaattccttctgggcgcgggtaatgccgacataggccagccgccgctcctcatcaatattgtcttcatcgatgctgctctggtggggcaaaaacccttcttccataccaaccatgtagacatagggaaactccagccctttcgacgcgtgcagagtcatcagttgcacctgatccagctcttcctcgctctcgccgcgctccatcatgtcgcgcaaagtaaagcgcgtcaccacctgggtgagcgtcatcggctcatccagttcgctgccttcgagcatctccgtcatccagctaaacagttggttgacgttcttcatgcgcatttcggcggctttcgggctgggcgatgtttcgtacagccaggattcataatccatgccgtggatcagatcacgcaccgcggcaatcggctcccgctccgccagacgctggatttccgccaaccagtgagtgaagcgggtcaatgcttcataaccacgtccgctcagggtctgactcaggcccatatcaaagctggcggtaaacatgcttttattgcgcgtcatcgcccattcacctagctttttcagcgtcgccgggccaatctctcgcttcggcgtgttaacgatacgcagaaatgcgctgtcatcgtccgggttagtcagcacgcgcagataagccagcaagtccttgatttcaggacgagagaaaaacgacgtaccgccagatattttgtacgggatgcggttttgcatcaggaatttttcaaatacccgcgactgatggttgccgcgataaagaatggcgtaatctttgtactgcgttttattgacgaagtgatgggcgatcagctcgccggtgacgcgctcggcttcatgttcctcgttattcgcgcttaaaacttttagctctgtgccgtaacccagttcggagaacagacgcttttcaaagacgtgcgggttattggcgatcaggatgttcgccgctttcaaaatacgtccggaagagcggtagttctgctcaagcttaatcaccttcagcgccggaaaatcctggctcagcagcaccagattctgcggacgtgcgccgcgccaggagtagatcgactggtcatcgtcacccaccacggtaaagcgcgcgcggctgcccaccagcagtttcaccagttcatactggctggtgttggtgtcctgatactcatccaccagcaggtagcgaattttgttctgccagcgctcgcggacttcttcattgcgttgcagcagcaacgttggcaataaaatcagatcatcgaagtcgagaacgttacaggctttcaggtgtgcatcatacagcccataacaatgggcaaaaatacggtcccgctcgccctttgcctctgccgccgcctgcgccggtgttttgagatcgttcttccagttggagatggtcgaaattagctgttgcaggagaactttgtcatcttcaatcagcccctcggtcaactctttaagcaaagcaagctgatcggtatcgtcaaacagcgaaaagttagacttcatccccaacgccgcatattcgcgcttgataatatccagcccaagcgtgtggaaggtggagatcatcaaccctcgcgcctctttgcgccccagcgtctgcgccacacgctctttcatctcgcgcgccgctttgttggtaaaggtgactgccgcaatatgccgcgcctgataaccgcaaccgcgaatcaggtgagcgattttattggtgatcactcgcgtcttaccggaacccgcacccgccagcaccaggcaggggccggtaacgaattcgacagcttgttgttggccggggtttagacgcataggaaaatcgctcaatgaaagtcgggaggggaaaataacagcgtggtagtatagccagcctcatccttaccactcaaggcacgatcatggcaaaaacagcagcagcactgcatatccttgtaaaagaagagaaactggctctggatcttctcgagcagatcaagaatggtgccgatttcggcaagctggcgaagaaacactccatttgcccgtcaggcaaacgcggcggtgatttgggtgaattccgccagggtcaaatggttccggcgttcgataaagtggttttctcttgtccggtactggagccaaccggcccgctgcatacccagttcggttaccacatcattaaggtgctgtaccgtaactaacagcaaggccttctccgggagaaggccttgaactctgaatcgctattaacccgcaacagcaatacgtttcatatccgtcatatagccgcgcagtttcttacctacctgctcaatcgcatggctgcgaatcgcttcatttacatcacgcagttgcgcgttatctaccgcaccttccggaatagctttacccaggtcgcccggttgcagctctgccataaacggtttcagcagcggcacacaagcgtaagagaacagatagttaccgtactcggcagtatcggagataaccacgttcatttcgtacagacgcttacgggcgatggtgttggcaatcagcggcagttcgtgcagtgattcatagtaagcagattcttcgatgatgccggaatcaaccatggtttcaaacgccaactcaacgcctgcttttaccatcgcgatcatcagtacgcctttatcgaagtactcctgttcgccgattttgccttcatactgcggcgcggtttcgaatgcggttttgccagtctcttcacgccaggtcagcagtttcttatcgtcgttggcccagtcagccatcatgccggaggagaattcgccggagatgatgtcgtccatatgtttctggaacagcggcgccatgatctctttcaattgctcagagagcgcgtaagcacgcagtttcgccgggttagaaagacggtccatcatcagggtgatgccgccctgtttcagcgcttcggtgatggtttcccaaccgaactgaatcagtttttctgcgtatgccggatcggtgccttcttccaccagcttgtcgaagcacagcagagaaccagcttgcaacataccgcacaggatggtttgctcgcccatcaggtcagatttcacttccgcaacgaaagaggattccagaacgcccgcacggtgaccgccggttgcagccgcccatgctttagcgatcgccatgccttcgcctttcggatcgttttccgggtgaacggcaatcagcgtcggtacgccgaatccacgtttgtactcttcacgtacttcggtgccagggcatttcggcgcaaccattacgacggtgatgtctttacggatctgctcacccacttctacgatattgaaaccatgagagtagcccagcgccgcgccgtctttcatcagcggctgaacggaacgcactacgtcagagtgctgcttgtctggcgtcaggttaaccaccagatccgcctgcgggatcagttcttcgtaagtgccaactttgaagccgttttcggtcgctttacgccaggatgcgcgcttctcggcaatcgcttctttacgcagagcgtaggagatatcgagaccagaatcacgcatgttcaggccctggttcagaccctgtgcaccacagccgacgatgactacttttttaccctgaaggtagctcgcgccatcggcgaattcatcgcgccccataaagcgacatttgcccagctgtgccaactgctggcgcagattcagtgtattgaagtagttagccatggtgattcctcgtgatgttgtgcttcttattgttcggttcgcgtttgcgagattgaattcactatatgacaggaaatttattgcggaaattgatatattcacaacgtcacattgcaatttctgcaacgtcaacattaagggctgcgccattggatttacgcgatctgaaaaccttcctgcatctggcggaaagccgccattttggccgcagcgcgcgggcaatgcacgttagcccgtccacgctctctcggcagattcagcgcctggaagacgatctcggtcagccgctgtttgtgcgcgataaccgcacggtaacgctaaccgaagcaggcgaagaactgcgcgttttcgcccagcaaacgctgttgcagtatcaacagctgcgccacaccatcgatcagcaaggaccgtcgctctctggcgaattacatatcttctgctcggtgaccgctgcctacagccatctgccgccgattctcgatcgcttccgcgcggaacacccgtcggtggagattaaactcacgactggtgatgcggcagatgcgatggaaaaggtagtcactggcgaagcggatctggcgattgccgggaaaccggagactctgcccggcgcagtggcgttttcgatgctggagaatctggcagtagtgctgattgcccccgcgctaccctgcccggtgcgtaaccaagtttcggcagagaagccggactggtctacagtgccgtttatcatggccgatcagggaccggtgcgccggcgcattgaactgtggtttcgacgcaacaaaatcagcaacccgatgatttacgccacggtcggcgggcatgaagcgatggtgtcgatggtagcgctcggctgtggcgtggccttgttgccggaagtggtgctggaaaacagcccggaaccagtgcgtaaccgcgtgatgattttagagcgcagtgatgagaaaacaccttttgaactgggcgtctgtgcgcagaaaaagcggctgcatgagccgctgattgaggcgttctggaagattttgccgaaccattaacccgccaaaaagaacctgaacgccgggttattggtttcgtcgtggcaatcgtaacccaactcattcaaccgggtttcgaaatccggttcatggtcgccaagttcgaacgccgccagtacgcgcccgtagtcggtgccatggctgcgatagtggaacaaagaaatgttccagtgcgtacccagcgtgttgaggaagcgcaacagcgcgcccggcgattccgggaattcgaagctgtagaggcgttcctgcaacggatgcgacggacgcccgccgaccatatagcgcacatgcagcttcgccatttcgtcgtcggagagatccactacgctgtagccgccatcgttgagcatctgcaaaatttctttgcgctcttcgagaccacggctcaggcgcacaccaacaaaaatgcaggcgtttttggcatcggcaaaacggtagttgaactcggtgaccgagcgcccgccaagcagctggcagaacttcaggaagctgcccttctcttccgggatggttaccgccagcaacgcttcacgctgttcgcccagttcgcaacgttccgagacgtagcgcaggccgtgaaagttcacgttagcaccagaaagaatatgcgccagccgctcaccgcgaatgttgtgctgggcgatatattttttcattcccgccagtgccagcgcgccagagggttccgctaccgcgcgcacatcttcgaacaggtctttcatcgccgcacatatggcatcgctatcgacggtgatgatgtcgtcgagatactcctggcataaacggaaggtttcgtcgccgatgcgtttcaccgcaacaccttcggcaaacagccccacgcgtggcagatcaaccggatgacctgcatccagcgccgctttcaggcaggcggagtcttccgcttccacggcaatcactttgatttgcggcatcagttgtttgatcagtaccgccacgcccgccgccagaccgccgccgccgactggcacaaatacgcggtcgagatgggcgtcctgctggagcagttccagcgccagcgtgccttgcccggcgatcaccatcggatggtcgaacggcggcacccaggtgaagccctgctgctgtgacagttcgatcgctttcgcttttgcttcatcaaagttcgcgccgtgaagaagcacttcgccgccgaagccgcgcaccgcgtcgactttgatatcggcggtggcggttggcatgacgatcagtgccttcacgcctaaccgtgcggaagaaaacgcgacgccctgcgcgtggttacccgcagaagcggtgatcacgccgtgcgctttctgttcttccgtcaggcccgccatcatggcgtatgcgccgcgcagcttaaagctatgaactggctgacggtcttcgcgtttcaccagaatcacgttatcgagacgcgacgagagtttttccattttttgtagcggcgtgacctgcgccgcttcgtagaccggcgcgcgcagcaccgctcttaaatattcggcaccttcaggggcaccggacaggggttgtgagtctgccatcattaaccccccagtttcgatttatcgcgcaccgcgcctttgtcggcgctggttgccaggctggcgtaggcacgcagcgcaaaggaaacctgacgttcacggtttttcggcgtccaggctttgtcaccccgagcttcctgcgcttcacgacgcgccgccagttcggcatcgcttacctgtaactgaatgccacggttcggaatgtcgatagcgatcaggtcaccatcttcaatcaggccaatgctgccgccacttgccgcttccggtgagacgtggccgatggaaagaccagaggtgccgccagagaaacgaccgtcggtgatcagcgcacaggctttaccgagacccattgatttcaggaaactggttgggtagagcatttcctgcatccccggaccgcctttcgggccttcatagcgaattactaccacatctccggcgacaactttaccgccgagaatcgcttctaccgcgtcgtcctggctttcgtagactttcgccgggccagtgaatttgaggatgctgtcatcgacgcctgcggttttaacgatgcagccgttttctgcgaaattaccgtagagcaccgccaggccgccgtctttgctgtaggcgtgttccagcgagcggatacagccattggagcgatcgtcgtccagcgtatcccagcggcaatcctgcgagaatgcctgtgtagtacgaatgcccgccgggccagcgcggaacatattttttaccgcatcatcctgggtcacgatgatgtcgtattgttccagcgtttgcggcaacgtcaggccaagtacatttttcacatcacggttcagtaaccccgcacgatccagctcgccgagaataccgataacaccaccagcacggtgaacatcttccatatggtatttttgggtgctcggcgcaactttacacagctgcggtactttgcgggagagcttatcgatatcactcatggtgaagtcgatttccgcttcctgcgccgccgccagcaggtggagaacggtgttggtagagccgcccatcgcgatatccagcgtcatggcgttttcaaacgccgccttactggcgatgttacgcggcagtgcgctttcatcatcctgttcgtagtaacgtttggtcaattcaacaatgcgtttaccagcattgaggaacagttgcttgcgatcagcgtgggttgccagcagcgagccgttgcccggctgcgacaggcccagcgcttcggtcaggcagttcattgagttagcagtaaacatcccggagcaggaaccgcaggttgggcaggcggatcgttcaacctgatcgctctgggagtcagaaactttcgggtctgcgccctggatcatcgcatcaaccagatcgagcttaatgatctgatcggacagtttggttttcccggcctccatcgggccgccggaaacaaagatcaccggaatattcaggcgcagggaagccatcagcatccccggggtgattttgtcgcagttagagatgcagaccatggcgtcggcgcagtgggcgttgaccatatattcaacggaatcagcgatcagttcgcgagatggcagtgaataaagcatgcccccgtggcccatagcgatcccatcatccaccgcaatggtgttgaactctttggcaacgccgccagccgcttcaatttgttcggcaaccagtttaccgagatcgcgtagatggacgtgacccggtacaaattgggtgaacgagttcacaaccgcgataatcggcttaccgaaatcggcgtcggtcattccggtggcgcgccacagcgcacgagcacccgccatattacgaccatgagtggtggtggcggaacggtacttaggcatactttatttactcccagtgtctgtctcgtaaatgggacggtgcgtgccgtcccattttttgtatttattgattaacttgatctaaccagccccatttatcttcggtctcgccagtgaagaggccgaagaaggcttgctgaatgcgtttggtaaccgggccgcaacggccttcaccaacctgaataccatctacactgcgcactggcgtgatttctgccgccgtaccggacataaagacttcatccgccaggtacagggattcgcgcgacagcacctgttcatgcacttcaattcccagctctttcgccagtttgatgatggcatcacgggtaatacccggcagcgcggaggaggtgaacggtggagtgaacagcacaccgtctttcacttcaaacaggttttctcctgcgccttcagagatataaccattcacatccaatgcgataccttcctgataaccgtggcggcgcgcttcgctacccaccaacagggaagagaggtagttacctccagctttcgctgcggttgggatggtgtttggtgcagcacggttccaggaggaaaccatcgcatcgatcccctgctccagcgcttctgcgcccagatacgccccccacgggaaagcggcgataatcacatcggttgagtatcccgctggcgggtttacgcccatgccaacatcaccgacgaaaatcagcggacggatataggcgctggtgagattgtttttgcggatcacgtcgcgacaagcttccatcagctcatcaatgctctgcgaaaccgggaaacgatagattttggcggagtcatgcagacgctgcatatgctcacgatggcggaatacaaccggtcctttgtgcgagtcgtagcaacggatgccttcaaaaaccgaggtgccatagtgcagcgcgtgcgacatcacatgcaccttcgcgtcttcccagcgaaccatctccccattgaaccaaatgtaatcagctttcttcgtggtcatttttatattccttttgcgctcaggcgcggatttgttgtgatgtggttgtgctctggcagatagcaacgtgtgcgacgtccaccagtttatttaactgactaaacagtaagtcgaccgaccgtgggctggcaacggtcaattcgatatttatattttgtgcatcgctggcggcggccatattcattgagcagacgtggaaaccacgatgacgcaccacgcgtaaaacacgttctaaggtttccggattgaagcgagccgatacattgacctgatgttgcatcatgataatttctccaacatttcagaattactggcaccaggcggcaccagcggccagacgttctcaagttcgtcgattgagacatgaagcaggtatggcccatcactgttcagcatggtgtcgagtgccgcttcaacctggtctttatgggtgatgtgttggccagggatgccgaaggcgctggctaacatgaggaaatcggggttatcggtaagggtagtttcgctgtatcgttcctggaaaaacagttgctgccattgtcgaaccatccctaaccgttggttatcgagtaagacgattttcaacggtaactgcttgcgttttacggtgcccagttcttgcacattcatcatgaaagagccgtcaccggagatacagacgacagtatcgttcggtcgcgcgacttgtgcgccaaccgccgccggtaaaccgaaacccatggtgcctaagccgctggaggtgatgaagttttccgggcgagtgtggacgatgtgctgggcagcccacatctggtgctgccccacatctgtggtcacgatgcaatccgcagatttacgatccgacagttgttttaacaacaacggcgcgtagatagcgtcaccaggatggtcgtaacgccaggcatgttcatcacgcagttgcgcgcagtgttgctgccagtcatcgatatttaacggctgctgtaatgctggtaacagagcatttaaatcaccctgtaatgccacatgtgcctgacgcagcttgttcatttctgccggatcgatatccatatggataacgctggcgtgtggtgcgaaggtgttcagtttgccggtcacccggtcatcaaaacgtgcgcccacggcgatcagtagatcgcactcctgcactgcgaagttcgccgctttggtgccgtgcatccccagcatgcccagatagtacggataatctgcttctactgcgcccagccctttcaacgtacaggtggcaggcatttttgtggcagcgagaaattcacgcaaagccgaaactgcctgcgccatgcccacgccaccgccaacgtacagcatcggtttttgcgcttttgccagcatctgacgcgcttgctcgacttcggcatgtgagaaagtcacttcgttttcaacagtggtgaaccacggttccagatcgccgctggctaactggatatcttttggaatatcgaccaaaaccggaccaggacgaccagagctggcgacgtcaaacgcttcggccatgatacgcggtaactcttccagtgattgcaccaggaaactgtgcttggtgcaggctaacgacaaccccagaatatccacctcctgaaatgcgtcagtgccgataaacggtgcggatacctgaccggtgatagcaacaacggggatggaatctaacagcgcgtccgcaagcccggttatcaggttggttgcacctggaccagacgtggcgatgcaaacgccagttttgccggtagcacgggcataaccgatagccgccattgctgcaccttgctcgtgtcggcacagcaagtgttccacgccaccgtcatacaatgcatcgtaaaccggcataattgcgccacccggataaccgaaaacggtgttcacaccctgtgcccgcaacgcatgtaccacccactgtgcgccattcatagttagttccccgtcctgaatcttgagaaacagaattttgtgctgttattcattgtctgctcctcagttatgtttttaaggtcaaaaaaaacccccggacctttcggtgcgggggtcttagttcgttaaggcttgatctctaagcctttcctcgtccaagtgcagccccgcacggtgggataataatcaccaccacgctaatcacgaccaggctaatcactcgtagaagggctgtcattttgtcttttcttgcatcttgttcgaaggaatgcctaaagagttaccatagattttgcgaatagcacaagatattttttggccgatttttatgatgtctttaataatttcaagagaaattgttgttttttaaaaagaaaatagtgagtgaaaaaaattcaatttcagtatgaatgttgttcccttcctcgtagttcatcctttgcacgctgcatttttgcgagcatcattccaccgccagaacaactcaacttcacttgcacaaataaacaggaatcagccactaaaattcacgaattagcgggctacagcagcgatatcttatgcacataatggtgactcaaggagggcttatgtcactgtcaattgttcatacccgcgcagccctgggagtaaatgcgcccccaatcactgttgaggtacatatcagtaaaggtctaccaggcttaacgatggtgggcttaccagaaacaacggtaaaagaagctcgcgatcgcgtgcgcagcgccattatcaatagcggatatgaatatccggcgaaaaaaatcaccatcaaccttgctccagccgatctgccaaaagaagggggacgatatgatttgcctatcgctattgcgttactggcggcctcagaacagcttacagccaataagttagatgaatatgaattagtcggagaactggcgcttacaggcgctctgcgtggcgttcccggcgcaatctccagtgcaactgaagctattaagtcgggcagaaaaattatcgtcgcgaaagataacgaagatgaagtggggctaattaacggtgaaggatgcctgatagccgatcatctgcaggctgtctgcgcgtttctggaaggtaagcacgctctcgaacacccgaaaccaactaatgcagtatcccgggcgctacaacatgatctcagtgatgttgtcggtcaggagcaaggaaagcgaggactggaaattaccgccgctggcgggcacaaccttttactgattggaccgccgggaacaggtaaaacaatgctcgccagccgtattaatggccttttgccagatttaagcaatgaagaggcactggagagcgctgcgatattaagtctggtaaatgctgaatcagtacaaaaacaatggcggcagcgcccgttccgctcacctcatcacagtgcgtcgttaactgcgatggtgggcggtggtgcaattccagggccaggtgaaatttcgctggcgcataacggcgtgctttttcttgatgagctacctgaatttgaacggcgtacactggatgccttgcgagagccgattgaatccgggcagatccatctttcacgcacacgagcaaaaataacctatccagcccgtttccagcttgtcgcggcaatgaatcccagccctaccggacattatcagggaaaccataaccgctgcacaccagaacagacattacgttatctcaaccggctctcggggccctttctcgaccgcttcgatctctcactggagatcccattaccgccccccggcattttgagtaaaacggtagtgccgggagaaaacagcaccaccgttaaacaacgtgtaatggccgccagagagcgccaatttaagcggcagaataaactgaacgcctggctggataatccggaaatacgccaattctgcaagcttgaaagcgaagatgcgcagtggctggaagaaacgctgatccatctggggttatcgattcgtgcctggcagcggttattgaaagttgcacgaaccattgctgatattgatcagtctgacattatcacacgtcagcatttgcaggaggcagttagctatcgtgcgattgaccgtttgctcatccatctgcaaaaactactgacataaaaaaagggcatttcgccctttttattaatcgtcagaatcggtgtagtcttcagcaccttcaacctgcggtttaccgccggaaagggtgtgaaaacgttttggacgcttgatacgcgtcatatacttggaccacacgcgttctgcttctgtcactggttcacgttcgccacggcatactgctacgaagagtttctcttcctcggtaaccggctcgcgtttgccaagatccaactcattgaaggcataaccatgacgctcaagcagttgtgcctctttgatggtgaagtcaccatgacgagagaatccacgtggataatgtttattgtcgaaatatcgattagtcgtcgtaaagctttccgccatcctgcacgctcctaattctttgaccgagctagttatggcgcggagtattagttacgcttgacagagtgtaaaacaaaacatttaaatcataacgacaaataattttgcggagagcactgtggatacggaattgttaaaaactttcctggaagttagccgaacgcgtcactttggtcgagcggctgaatcgctctatctgacccaatcagccgtgagctttcgaatcagacaactggaaaatcaactgggtgtgaatcttttcacccgccacagaaacaatatccgtttaaccgctgccggagaaaagcttctgccttatgcagaaacgctcatgagcacctggcaggccgcccgcaaggaggtggcgcatacctcacgacataatgagttttctatcggtgccagcgcctcgctgtgggagtgtatgcttaatcagtggctgggacgcttgtatcaaaatcaggatgtccatacaggcttacagttcgaagcgcgaattgcccaacggcagtctctggtaaaacagttgcatgaacgccagcttgatcttcttattacaactgaagcccccaaaatggacgaattttgtagtcagttgctggggtatttcactttagcgctttataccagtgccccttctaaactaaagggagatcttaactatctgcgactagagtgggggccagattttcaacagcatgaggcaggtttgatcggtgctgacgaagttcccattctgacaaccagttctgctgaactggcacagcaacagattgcgatgcttaatggttgcacctggctacccgtcagttgggcacgtaaaaaaggcggcctgcataccgttgtcgatagcacaacactttcacggccgctttatgccatatggctacaaaatagcgataaaaatgcgttgattcgcgatctattgaaaattaacgtgctggatgaagtgtattaatctgaatggctggcaaggatgccggtagaaggagttacttcggagagggttatttcagataaaaaaaatccttagctttcgctaaggatgatttctggcaggggcggagagactcgaactcccaacacccggttttggagaccggtgctctaccaattgaactacgcccctaattagggtggcggaacggacgggactcgaacccgcgaccccctgcgtgacaggcaggtattctaaccgactgaactaccgctccaccgaattcttttacaaccaccggtttataaccggcttactgctaaatttgatgcctggcagttccctactctcgcatggggagaccccacactaccatcggcgctacggcgtttcacttctgagttcggcatggggtcaggtgggaccaccgcgctacggccgccaggcaaattctgttttatcaacacgtcctgttctgacctgtcgatttaatctgtatcaggctgaaaatcttctctcaatccgccaaaacatcttcggcgttgtaaggttaagcctcacggttcattagtaccggttagctcaacgcatcgctgcgcttacacacccggcctatcaacgtcgtcgtcttcaacgttccttcaggactctcaaggagtcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggccaacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcgttaccgctaaccccatcaattaaccttccggcaccgggcaggcgtcacaccgtatacgtccactttcgtgtttgcacagtgctgtgtttttaataaacagttgcagccagctggtatcttcgactgatttcagctccacgagcaagtcgcttcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgtcgcttcagcaccgtagtgcctcgtcatcacgcctcagccttggttttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcaaccctcacaggccaccttcacaggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcaccccataaagaggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacaatatgtgcatttttgtgtacggggctgtcaccctgtatcgcgcgcctttccagacgcttccactaacacacacactgattcaggctctgggctcctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcacctcaccgacgcttatcgcagattagcacgtccttcatcgcctctgactgccagggcatccaccgtgtacgcttagtcgcttaacctcacaacccgaagatgtttcttgcgattcatcatcgtgttgcgaaaatttgagagactcacgaacaactctcgttgttcagtgtttcaattttcagcttgatccagatttttaaagagcaaatatctcaaacatcacccgaagatgagttttgagatattaaggcaggtgactttcactcacaaaccagcaagtggcgtcccctaggggattcgaacccctgttaccgccgtgaaagggcggtgtcctgggcctctagacgaaggggacgtatcagtctgcttcgcaagacgccttgcttttcactttctatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacggttcccgaaggcacattctcatctctgaaaacttccgtggatgtcaagaccaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgcttcg

SEQ ID NO: 10031 - DNA, 37686 bp, Escherichia coli
cgcgtatagtagcagcgtttaaaagctctaacttttgttgcattaccgggatgtaaagtgaatacaacgctgtttcgatggccggttcgcgtctactatgaagataccgatgccggtggtgtggtgtaccacgccagttacgtcgctttttatgaaagagcacgcacagagatgctgcgtcatcatcatttcagtcaacaggcgctgatggctgaacgcgttgcctttgtggtacgtaaaatgacggtggaatattacgcacctgcgcggctcgacgatatgctcgaaatacagactgaaataacatcaatgcgtggcacctctttggttttcacgcaacgtattgtcaacgccgagaatactttgttgaatgaagcagaggttctggttgtttgcgttgacccactcaaaatgaagcctcgtgcgcttcccaagtctattgtcgcggagtttaagcagtgactgacatgaatatccttgatttgttcctgaaggctagccttctggttaaacttatcatgttgattttgattggtttttcaatcgcatcctgggccattattatccagcggacccgtattcttaacgcagcggcgcgcgaagccgaagcgtttgaagataaattctggtctggaatcgaactctctcgcctctatcaagagagccaggggaaacgggataatctgagcggttcggaacaaatcttttacagcggcttcaaagagtttgtgcgcctgcatcgtgccaatagccatgcgccggaagccgtagtggaaggggcgtcgcgtgcgatgcgtatttccatgaatcgtgaacttgaaaatctggaaacgcacattccgttcctcggtacggttggctccatcagcccgtatattggtctgtttggtacggtctgggggatcatgcacgcctttatcgccctcggggcggtaaaacaagcaacactgcaaatggttgcgcccggtatcgcagaagcgttgattgcgacggcaattggtttgttcgccgcaattccggcggtaatggcttataaccgcctaaaccagcgcgtaaacaaactggaactgaattacgacaactttatggaagagtttaccgcgattctgcaccgccaggcgtttaccgttagcgagagcaacaaggggtaagccatggccagagcgcgtggacgaggtcgtcgcgatctcaagtccgaaatcaacattgtaccgttgctggacgtactgctggtgctgttgctgatctttatggcgacagcgcccatcatcacccagagcgtggaggtcgatctgccagacgctactgaatcacaggcggtgagcagtaacgataatccgccagtgattgttgaagtgtctggtattggtcagtacaccgtggtggttgagaaagatcgtctggagcgtttaccaccagagcaggtggtggcggaagtgtccagccgtttcaaggccaacccgaaaacggtctttctgatcggtggcgcaaaagatgtgccttacgatgaaataattaaagcactgaacttgttacatagtgcgggtgtgaaatcggttggtttaatgacgcagcctatctaaacatctgcgtttcccttgcttgaaagagagcgggtaacaggcgaacagtttttggaaaccgagagtgtcaaaggcaaccgaacaaaacgacaagctcaagcgggcgataattatttcagcagtgctgcatgtcatcttatttgcggcgctgatctggagttcgttcgatgagaatatagaagcttcagccggaggcggcggtggttcgtccatcgacgctgtcatggttgattcaggtgcggtagttgagcagtacaaacgtatgcaaagccaggaatcaagcgcgaagcgttctgatgagcagcgcaagatgaaggagcagcaggctgctgaagaactgcgtgagaaacaagcggctgaacaggaacgcctgaagcaacttgagaaagagcggttagcggctcaggagcagaaaaagcaggctgaagaagccgcaaaacaggccgagttaaagcagaagcaagcggaagaggcggcagcgaaagcggcggcagatgctaaagcgaaggccgaagcggatgctaaagctgcggaagaagcagcgaagaaagcggcggcagacgcgaagaaaaaagcagaagcagaagccgccaaagccgcagtcgaagcgcagaaaaaagccgaggctgctgctgcggcgctgaagaagaaagctgaagcggcagaagcagctgcagctgaagcaagaaagaaagcggcaaccgaagctgctgaaaaagccaaggcagaagctgagaagaaagcggctgctgaaaaggctgcagctgataagaaagcggcagccgacaaaaaagcagcagaaaaagcggctgctgaaaaggcagcagctgataagaaagcagcggcagaaaaagccgccgcagacaaaaaagcggcagcggcaaaagcagcagctgaaaaagccgctgcagcaaaagctgccgcagaggcagatgatattttcggtgagctaagctctggtaagaatgcaccgaaaacgggggggaggggcgaaagggaacaatgcttcgcctgccgggagtggtaatactaaaaacaatggcgcatcaggggccgatatcaataactatgccgggcagattaaatctgctatcgaaagtaagttctatgacgcatcgtcctatgcaggcaaaacctgtacgctgcgcataaaactggcacccgatggtatgttactggatatcaaacctgaaggtggcgatcccgcactttgtcaagctgcgttggcagcagctaaacttgcgaagatcccgaaaccaccaagccaggcagtatatgaagtgttcaaaaacgcgccattggacttcaaaccgtaatcgcgatgttgactgttccgacggtcaacatcaggcaccggttgccacggggttctggtagttttgtgtattttagtttgttaacattctgctaaattatcgtgggccatcggtccagataagggagatatgatgaagcaggcattacgagtagcatttggttttctcatactgtgggcatcagttctgcatgctgaagtccgcattgtgatcgacagcggtgtagattccggtcgtcctattggtgttgttcctttccagtgggcggggcctggtgcggcacctgaagatattggcggcatcgttgctgctgacttgcgtaacagcggtaaatttaatccgttagatcgtgctcgtctgccacagcagccgggtagtgcgcaggaagtacaaccagctgcatggtccgcgctgggcattgacgctgtggttgtcggtcaggtcactccgaatccggatggttcttacaatgtcgcttatcaacttgttgacactggcggcgcaccgggtactgtacttgctcagaactcgtacaaagtgaacaagcagtggctgcgttatgctggtcataccgccagtgacgaagtatttgaaaaactgaccggtattaaaggtgcgttccgtacccgtattgcctacgttgttcagactaacggcggtcagttcccgtatgaactgcgcgtatctgactatgacggttacaaccagtttgtcgttcaccgttcaccgcaaccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagcctgaacctgtacgtaatggatttggcttctggtcagatccgccaggtaactgatggtcgcagtaacaataccgaaccgacctggttcccggacagccagaacctggcatttacttctgaccaggccggtcgtccgcaggtttataaagtgaatatcaacggcggtgcgccacaacgtattacctgggaaggttcgcagaaccaggatgcggatgtcagcagcgacggtaaatttatggtaatggtcagctccaacggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtgataataattaattgaatagtaaaggaatcattgaaatgcaactgaacaaagtgctgaaagggctgatgattgctctgcctgttatggcaattgcggcatgttcttccaacaagaacgccagcaatgacggcagcgaaggcatgctgggtgccggcactggtatggatgcgaacggcggcaacggcaacatgtcttccgaagagcaggctcgtctgcaaatgcaacagctgcagcagaacaacatcgtttacttcgatctggacaagtacgatatccgttctgacttcgctcaaatgctggatgcacacgcaaacttcctgcgtagcaacccgtcttacaaagtcaccgtagaaggtcacgcggacgaacgtggtactccggaatacaacatctccctgggtgaacgtcgtgcgaacgctgttaagatgtatctgcagggtaaaggcgtttctgctgaccagatctccatcgtttcttacggtaaagaaaaacctgcagtactgggtcatgacgaagcggcgtatgccaaaaaccgtcgtgcggtactggtttactaagagaattgcatgagcagtaacttcagacatcaactattgagtctgtcgttactggttggtatagcggccccctgggccgcttttgctcaggcaccaatcagtagtgtcggctcaggctcggtcgaagaccgcgtcactcaacttgagcgtatttctaatgctcacagccagcttttaacccaactccagcaacaactctctgataatcaatccgatattgattccctgcgtggtcagattcaggaaaatcagtatcaactgaatcaggtcgtggagcggcaaaagcagatcctgttgcagatcgacagcctcagcagcggtggtgcagcggcgcaatcaaccagcggcgatcaaagcggtgtggcggcatcaacgacgccgacagctgatgctggtactgcgaatgctggcgcgccggtgaaaagcggtgatgcaaacacggattacaatgcagctattgcgctggtgcaggataaatcccgccaggatgacgcaatggtggcatttcagaatttcatcaaaaattaccctgattcaacttacctgccaaacgccaattattggctgggtcagttaaactacaacaagggtaaaaaagatgatgcggcgtattattttgcttcggtagtgaaaaactatccgaagtcaccgaaggctgcagatgcgatgtttaaagtcggcgtcatcatgcaggacaaaggtgacaccgcaaaagcgaaagccgtataccagcaggttatcagtaaataccctggtactgatggcgctaaacaggcgcaaaaacgtctgaacgcgatgtaatgcataacacacgaccagaagtcgcattatttctggtcgtgtcgtgcgaatcataagcagttgagtgatctacatcgaaatttttgttgcgctcaagtctgaaatcagtaatatatgccgccgttgccacgggatatcaaacaaaccgaaagcaacgaaaaagtgggtcgttagctcagttggtagagcagttgacttttaatcaattggtcgcaggttcgaatcctgcacgacccaccactaacatagttagttgtagtatccagcgtagtatcgggtgattagctcagctgggagagcacctcccttacaaggagggggtcggcggttcgatcccgtcatcacccaccaccgggtcgttagctcagttggtagagcagttgacttttaatcaattggtcgcaggttcgaatcctgcacgacccaccactgattacggtgggttcggtggaagtagtttgtagtatccagcgcagtatcgggtgattagctcagctgggagagcacctcccttacaaggagggggtcggcggttcgatcccgtcatcacccaccactcgggtcgttagctcagttggtagagcagttgacttttaatcaattggtcgcaggttcgaatcctgcacgacccaccaattttaaacattggttccgagtagaaatctttcaggtaacacccgtatgggtcgttagctcagttggtagagcagttgacttttaatcaattggtcgcaggttcgaatcctgcacgacccaccatcctgaatgattaaagcagcataatcccgcaaggggtcgttagctcagttggtagagcagttgacttttaatcaattggtcgcaggttcgaatcctgcacgacccaccaatgcaaaaaagcgccctaaaggcgcttttttgctattcaggcatctctcaatttcaattcttgaccctgatgacatactccgcgcttgctgcgtaaacaactctacgtcggaggaataagacgcaaagtgtggcattcggcatctcatacgtaattcgagtgacttttccccaccattcgactatcttgtttagcatataaaacaaattacgccgataatagcgaatatcacgcttaagtcggttttaacgttaagcctgtaaaacgagatggtaagatgagcgtgatgtttgatccagacacggcgatttatcctttccccccgaagccgacgccgttaagcattgatgaaaaagcgtattaccgcgagaagataaaacgtctactaaaagaacgtaatgcggtgatggttgcccactactataccgatcccgaaattcaacaactggcagaagaaaccggtggctgtatttctgattctctggaaatggcgcgcttcggtgcaaagcatcccgcttctacgttgttagttgctggggtgagatttatgggagaaaccgccaaaattctcagtccggaaaaaacaattctgatgccgacacttcaggctgaatgttcactggatctcggctgccctgttgaagaatttaacgcattttgcgatgcccatcccgatcgtactgtcgtcgtctacgccaacacttctgctgcggtaaaagcgcgcgcagattgggtggtaacttcaagcattgccgtcgaacttattgatcatctggatagtttgggtgaaaaaatcatctgggcacctgacaaacatctggggtgttacgtgcaaaaacagacgggcgcagacattttatgctggcagggtgcctgcattgtgcatgatgagtttaagactcaggcgttaacccgcttgcaagaagaatacccggatgctgccatactggtgcatccagaatcaccgcaagctattgtagagatggcggatgcggtcggttccaccagtcaactgatcgctgctgcgaaaacattgccacatcagcggcttatcgtggcaaccgatcggggcattttctacaaaatgcagcaggcggtgccagataaagagttactggaagcaccaaccgcgggtgagggcgcaacctgtcgcagctgcgcgcattgcccgtggatggccatgaatggccttcaggccatcgcagaggcattagaactggaaggaagcaatcacgaggtttatgttgatgaaaggctgctagagagggcgctggtgccgctcaatcgtatgctggattttgcggctacactacgtggataattgataataaggcgtcacattacgctttgggggaacgatggatttttttagtgtgcagaatatcctggtacatataccaataggggcaggcgggttatgatctctcatggatcgaagcggtaggcacgatcgccgggttgctgtgtattggccttgccagtctggagaagatcagtaactacttctttggcctgatcaacgtcaccttgtttggcattattttctttcagattcagctgtatgccagcctgctattacaggtgtttttctttgccgcgaatatttacggctggtatgcgtggtcgcgacaaaccagtcagaacgaggcggagttgaaaattcgctggttgccattgccgaaggcgctaagctggttggcggtttgcgttgtttcgattggtctgatgacggtatttatcaatccggtgtttgcatttttgacccgcgtggcagtcatgatcatgcaagcattaggattacaggttgcgatgcctgaactacagccggacgctttcccgttctgggattcatgcatgatggtgttatctatcgtggcaatgattctgatgacgcgtaagtatgtggaaaactggctgttgtgggtgattattaacgtgattagcgtcgttatttttgcacttcagggcgtttacgccatgtctctggagtacatcatcctgacctttattgccctcaacggcagccggatgtggatcaacagcgcacgcgaaagaggttcacgcgcgctgtcccattaatggtgatgatgtgaatggccagacaccccttcattcaggtggcagtctggcccatgacaaggttgatattccatctgaatagtggcgtgctcaatctgatagtgatccatcaggtagtgttggatctgatctaacaaggcatcgtgatcgtgtggcgggatcacctgcacatgcagcgtcatcaccggcttctcgcctaccatccatacatgcacatggtgcacattgcggacttccgggatttcccggcacaagcgacgcttcagttcagcgatatccagcgataccggtgcaccttcaagtaattcattcacactatctttcaacagtcgccacgcgctacgcagaaccagaagcgacaccagtattgagagaatggggtcagcaggtgtccagccggtccagataataatcaacgcggcaataatagccccaaccgaacccagcaggtccccgagcacatgcagtgccgctgctcgcacgttgaggtttttctcttcgctaccgtgatgaagtaaccagaaagaaagtatatttgccaacagcccagccacggcaattgccatcatcatgccgccctcgaccggacgcggtgtgcggaagcgttctatcgcctcccagacaatcaaaatggtaatcaccaccagggcgatagcattcacaaatgctgcgagcgtggtcaatcttagccaaccgaaagtgtggcgaatggtgggaggtcgacgtgaaaattgcacggcgagtagggcgaaaagcagggcggcagtatcggtcaacatatgacccgcatcggccagcaatgccagagaaccggaaagaaaaccgccaatgacttctacgagcataaacccggcagtcacgccgaaagcatacaacaagcgacgagcattattatcttctggcaggtgtgaggaagcgtgtgagtgtgagtgcgccatgacgagtcatcccttaattattctcacttaactttatgacatcatactgcttgtagaagggaaaaattaaaagggagagactccgctctcccattattggctattttgcagggttactgcgtggtaccgtcggttttggtatcgacatcattattgatgccatcaccagtttgtacctttttattgatatccgggcagcgaccatctttacacatggtgttcttgtgctcttcatctttggtcatgccgtcattgttcattgaagaaccatccggatgcagcattgtgccgtcggaaccggtatttaccccgttattgtcgacgttatttggcgcgacattttcacgggcgtcaggggctacctggcccgcatcagctgcggcgtttgcctggccgttattgctttgcgctccgctatcggcagccagtgcggcaccgctggcaaggcttagagtggcagtcaaaaatagtgtggccagttttgtcattttcataggatgctcctgttatggtcgttatgtcggataacctcttccaacagtgcatttgcaggtgaatatcaggcattggtttaagatttcagccagcttatgaaacgcagcagagaatcttgaaataattaacaaacaaaggagttacagttagaaattgtaggagagatctcgtttttcgcgacaatctggcgtttttcttgctaattccaggattaatccgttcatagtgtaaaaccccgtttacacattctgacggaagatatagattggaagtattgcattcactaagataagtatggcaacactggaacagacatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataacagcttccagatcaacgacggtctgcgtattgcccgtaaattgctgcttgatattaacgacagcggtctgccagcggcgggtgagtttctcgatatgatcaccccacaatatctcgctgacctgatgagctggggcgcaattggtgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctttcagtgaccaaatggggtcattcggcgattgtgaataccagcggtaacggcgattgccatatcattctgcgcggtggtaaagagcctaactacagcgcgaagcacgttgctgaagtgaaagaagggctgaacaaagcaggcctgccagcacaggtgatgatcgatttcagccatgctaactcgtcgaaacaattcaaaaagcagatggatgtttgtgctgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgaatgcagtaaacgcgcgtcgcgggtaaagtttaattgtcggatgcgccgtcagagtggcgtatccgattaatcaccggaggcctgataaaacgcgcagcgtcgcatcaggcaatgtgctccattggtagcaacgaaaaataaaaaagccgactcattttgcagtcggctttctcatttttaagcgaatgacgtttacttcgctttaccctggttagcaaccgccgctgctttcgccgcgatctcgtcagcattacccagataatagcgtttcagcggtttgaagttctcgtcaaactcataaaccagcggcacgccggtcgggatattcagctcaagaatctcttcttcgctcatgttatcgagatatttcaccagcgcacgtaacgagttaccgtgtgcggcgatgatgacgcgctcaccgctcttcatacgcggcagaatggtttcattccagtaagggatcacgcggtcaatggtcagcgccaggctttccgtcagcggcagttctttctcgctcagtttcgcgtaacgcggatcgtgacccggataacgctcatcatctttagtcagttccggcggagtcaccgcaaaaccacgacgccactgtttcacctgctcgtcgccatacttttcagcggtttccgctttgttcagaccctgcaacgcaccgtagtgacgttcgttcagtttccaggatttctcaacgggcagccatgcctgatccagttcgtccagcacattccacagggtatgaatagcgcgtttcagcacagaggtgtaagcaaagtcaaagctgtaaccttcctctttcagcagcttacctgctgcttttgcttcgcttacgcctttctcagacagatccacgtcgtaccaaccggtgaaacggttttctttgttccactgactttcgccatgacgaaccagaaccagcttagttacagccatatacttactcctcaaatcatcttttaatgataataattctcattatattgccgtgacgaagcaacagcaatgcttacgcataaccatagcgaaaatagtgtcgcagtgtaaggttgttgtgaatattgagttgcaaatatgtcggtgtttgctggtgatttgaacaatatgaagataaagccctcatgacgagggcttaacattactgagcaataaactgatattccgtcaggctggaatactcttcgccaggacgcaggaagcagtccggttgcggccattcagggtggttcgggctgtccggcagaaattcgctttccagagccagcccttgccagtcggcgtaaggttcggttccccgcgacggtgtgccgccgaggaagttgccggagtagaattgcagagccggagcggtggtgtagaccttcagctgcaatttttcatctgctgaccagacatgcgccgccactttcttgccatcgcctttggcctgtaacaagaacgcgtgatcgtaacctttcactttgcgctgatcgtcgtcggcaagaaactcactggcgatgattttggcgttgcggaaatcaaaagaggttccggcgacagatttcaggccgtcgtgcggaatgccgccttcatcaaccggcagatattcttccgccagaatctgcaacttgtgattgcgcacgtcagattgctcgccgtcaagattgaaatagacgtgattagtcatattcaccgggcaaggtttatcaactgtggcgcgataagtaatggagatacggttatcgtcggtcagacgatattgcaccgtcgcgccgagattacccgggaaaccctgatcgccatcatctgaactcagggcaaacagcacctgacgatcgttctggttcacaatctgccagcgacgtttgtcgaacccttccgggccgccatgcaattggttgacgccctgacttggtgaaagcgtcacggtttcaccgtcaaaggtataacggctattggcgatgcggttggcataacgaccaatagaggcccccagaaatgcggcctgatcctgatagcattccgggctggcgcagccaagcagcgcctcgcggacgctgccatcggaaagcggaatacgggcggaaagtaaagtcgcaccccagtccatcagcgtgactaccatccctgcgttgttacgcaaagttaacagtcggtacggctgaccatcgggtgccagtgcgggagtttcgttcagcactgtcctgctccttgtgatggtttacaaacgtaaaaagtctctttaatacctgtttttgcttcatattgttcagcgacagcttgctgtacggcaggcaccagctcttccgggaacaacgcgacgatacagccaccaaatccgccgccggtcatgcgtacgccacctttgtcgccaatcacagctttgacgatttctaccagagtgtcaatttgcggtacggtgatttcgaaatcatcgcgcatagaggcatgagactccgccatcaactcgcccatacgtttcaggtcgccttgctccagtgcgctggcagcttcaacggtgcgggcgttttcagtcaggatatgacgcacgcgtttcgccacgattgggtccagttcatgcgcaacagcgttgaactcttcaatggtgacatcgcgcagggctggctgctggaagaaacgcgcaccggtttcgcactgttcacgacgggtgttgtattcgctgccaaccagggtacgtttgaagttactgttgatgatgacgacagccacacctttgggcatggaaactgctttggtccccagtgagcggcagtcaatcagcaaggcatgatctttcttgccgagtgcggaaatcagttgatccatgattccacagttacagcctacaaactggttttctgcttcctgaccattaagcgcgatttgtgcgccgtccagcggcagatgataaagctgctgcaatacggttccgaccgcgacttccagtgaagcggaagaacttaaccctgcaccctgcggcacattgccgctgatcaccatgtccacaccgccgaagctgttgttacgcagttgcagatgtttcaccacgccacgaacgtagttagcccattgatagttttcatgcgcgacaatgggcgcatcgagggaaaactcgtcgagctgattttcataatcggctgccattacgcgaactttacggtcatcgcgtggcgcacagctgatcacggtttgataatcaatcgcgcagggcagaacgaaaccgtcgttgtagtcggtgtgttcaccaatcaaattcacgcggccaggcgcctgaatggtgtgagtggcagggtagccaaatgcgttggcaaacagagattgtgttttttctttcagactcatttcttacactccggattcgcgaaaatggatatcgctgactgcgcgcaaacgctctgctgcctgttctgcggtcaggtctcgctgggtttctgccagcatttcataaccaaccataaatttacgtacggtggcggagcgcaacagaggcggataaaagtgcgcgtgcagctgccagtgttgattctcttcgccattaaatggcgcgccgtgccagcccatagagtaggggaaggagcactggaagaggttgtcataacgactggttagctttttcaacgccagtgccaaatcgctgcgctgggcgtcggtcaaatcggtgatccgcaaaacgtgggctttgggcagcagtagcgtttcgaacggccaggcagcccagtaaggtacaacggctaaccagtgttcggtttcgacaacggtacggctaccgtctgccagctcgcgctgaacatagtccaccagcattggcgatttctgtgcggcgaaatattctttttgcagacggtcttcgcgctcagcttcgttaggcaggaagctatttgcccaaatctgtccgtgcggatgcgggttagagcagcccatcgccgcgcctttgttttcaaagacctgcacccatgggtacgtttcccccagctctgcggtttgctcctgccaggttttgacgatttccgtcaatgccgcaacgctcagttctggcaacgttttactgtgatccggtgaaaagcagatcacccggctggtaccgcgcgcgctctggcaacgcattagcggatcgttgctttctggcgcatctggcgtgtcagacatcaaggccgcaaagtcattagtgaaaacgtaagtcccggtgtaatcggggtttttatcgcctgtcacccgcacattacctgcgcagaggaagcaatctggatcgtgcgcaggtaacacctgtttggctggcgtttcctgcgccccctgccaggggcgcttagcgcggtgcggtgaaaccagaatccattgcccggtgagcgggttgtagcggcgatgtggatgatcaacgggattaaattgcgtcatggtcgttccttaatcgggatatccctgtggatggcgtgactgccagtgccaggtgtcctgcgccatttcatcgagtgtgcgcgttacgcgccagttcagttcatggttggctttgctggcgtccgcccagtaggccggaaggtcgccctcgcgacgcggtgcaaaatgataattaaccggtttgccgcaggctttgctgaaggcattaaccacgtccagcacgctgctgcccacgccagcgccgaggttgtagatgtgtacgcctggcttgttcgccagtttttccatcgccacgacgtgaccgtccgccagatccattacgtggatgtaatcgcgcacgccagtaccgtcttcggtcggataatcgttaccaaaaatcgccagcgagtcgcgacggcctacagcaacctgggcgatgtatggcatcaggttattcggaatgccttgcggatcttcgcccatatcgcccgacggatgcgcgccaactgggttgaagtagcgcagcagggcaatgctccagtccggctgggctttttgcagatcggtgaggatctgttccaccatcagcttgcttttgccgtaagggctttgcggtgtgccggtcgggaagctttcaacatatggaattttgggctgatcgccataaacggtggcggaggagctaaagataaagtttttgacgttagcggcgcgcatggcgctaatcaggcgcagagtaccgttgacattgttgtcgtaatattcaagcggtttttgtaccgattcgccaacggctttcagcccggcgaagtggatcacggtgtcgatagcgtgatcgtgcaggatctcggtcatcaacgcttcgttacggatatcgccttcaacaaacgttggatgtttgccgcctaaacgctcgataacaggcagtacgctgcgcttactgttacagaggttatcaagaatgatgacatcatgaccgttttgcagtaattgcacacaggtatgacttccaatgtaaccgctaccaccggtaaccagaactctcataattcgctccattaggcttatggtatgaaataaccatagcataacaaagatgcgaaaagtgtgacatggaataaattagtggaatcgtttacacaggaatttagccgttttttatgcgcgattaagtgattataaaacagcggctttatgaatgattgcgctttttatctgaaaaaaaagacgcggtttcatgcctggatgcgtcaaaccgttggccggataacacgtttacgccgcctccggcacggtcagcactaccgactcagtttatttttgtcagcgcatagcgataaaagtcaccgtccggcacgaactcaagacgatgggtaatacaggcaggcgcatcttcagcgtggtgcgaaacaaacaacaattgcgttttaccttcgctaatcagcacatcaacaaaacggcggataagctggcgattgagcggatcaagcccctgtagtggttcatcgagaataagcaacgtcggatgtttcactagcgcacggacgatcagcgccagacgctgctgtccccaggaaagactatggaaaggagcgtcagccgtgcgtttatcaatgccgagaatatccagccactgctgcaccagtttttgctggcgatccgaaacggcctgataaatgccaatcgaatcaaaatagccagaaagaatcacattacgcacagtagtgctgacccggtaatccagatgcaaactactgctgacgtaaccgatatgctttttgatatcccagatggtttcgccgctgccgcgacgtcgtccgaaaagcgtcaaatcgttgctgtaaccttgcggatgatcgccagtaatcaggcttaataacgtcgattttcccgcgccatttggcccgacaatttgccagtgttcgcctggattcacctgccagctaaggttattaagaatggggcgatcgttataagaaaccacgccattgttcagcacaatgcgcggttcgttggcgggtaaggcgtgacgtgctgaaggttcatctggctccggcatttgcacaccttcaagcagttcgctatgcgccagttgcgcaacgagtgcttgttggagcagttcttctttagcgccagtttccgctaacgtgcaatccgccagcacgccagcaaactggacaaattccgggatctcatcgaagcgattgagcaccagtaccagagtaataccggactgatgtaacgaggcgagtagctcagccagatgctgacgtgaggcaacatccaggccatcgaacggctcatcaaggatcaacaagtcaggctccgacatcagcgcctgacacagcagggtttttcgcgtctcgccagtggaaaggtatttaaagcgtcggtcgaggagggcggtaataccgaactgctgcgccagttgcatgcaacgcggagcatcctttacttcatcctgaatgatctcagccgtggtacgcccggtgtcatcttcgccaggactaagcatatcggtgttattccgctgccattcgtcgctgacgagcttttgcaattgctcgaaggagagacgagtgatgtgggaaaactggctttgccgttcacctttcaaaagcggaagttcccccgacagcgcgcgggccagcgccgatttcccgcttccattcgaaccgacaaacgcccaactatcacccgcgtttaacgttagccgaggcaattgcagcgtttttgtgtcgccaagacgaaacgtgccttgcaaaatttgcaacgatgacattttatatcccattttgtgcagcgattactgacagggatacgtgtttcataacaaattgtcaacacgcttagcacagcgtggcgataatcacgctgtcggcattaaagtaggccgtgacattctgtccttgctgaagagaagtcgcttcatttaccggcactgtggcgcacagtgtttgcccgtcgggtagcgccattaatacttcgcactgctctgcgccgcgctcaatatgactaataatacctggtaattggttgtcagcgttttgcgcgaccgcatcgtcctgagtaatacctacccacggcgcttttagcaatatcaacacttctttgccttcatccagccccagacgcgcgccgctttgtgcggtaactgcgactttcaggcgtgtttttccatcagccagtaagacatcaacatgctgttgaacgtcatcatgatcgcgggcggtgatggtaccgaaccactggttacgggcgctggtttgcagtgaaaaacgtgagatcgcggccagcaggctgttcagcggcagggcgtcatcgtcacttaacacatcaaaggctttttgctgtatttgcgccagtaagtcatagagctgaatcagtcgctgaccatagcgggtcagtactgcgccgccgccacctttaccgcctgttgcgcgctcaaccagaatatgctcacttaactgattcatctcgttaatggcatcccaggcgcttttatagctgataccggcatctttcgctccctggctaatggaaccggaaagcgcaatgtgttttagtagcgaaatgcggcgcgggtcggcgaataatttttgttggagcttaagggtgagaaggatttcggcctgcataacaatgtcctggcaaaagtcttattgtgacggaaaacgaacgccacgcaaagctgaccgcacaaaaggggagtgcttttctgtgcttagcggttagaatagtctcatgactatatctggagttgaccatgttagagttattaaaaagtctggtattcgccgtaatcatggtacctgtcgtgatggccatcatcctgggtctgatttacggtcttggtgaagtattcaacatcttttctggtgttggtaaaaaagaccagcccggacaaaatcattgattccctgaatgcccgcttagtcgggcattttctttttctcaacttcctgctttttctgccgatattttttctcatctacctcacaaaggttagcaataactgctgggaaaattccgaacttgccgttatattgacgcctacataacgttacattaaggggttaccaatggctcgtaaatggttgaacttgtttaccggggcggcactctctttcgctgttgctggcaatgcactggcagatgaagggaaaatcacggtgttcgccgccgcatcactgactaacgcaatgcaggacattgctacgcagtataaaaaagagaaaggcgtggatgtggtttcttctttcgcttcgtcatctactttggcccgtcagattgaagcgggtgcgcctgcggatctatttatttctgccgatcagaaatggatggattatgcggttgataaaaaagcgatcgatacggcttcgcgccagacactgctcggcaatagcctggtcgttgtagcaccgaaagccagcgagcagaaagatttcaccatcgacagcaaaaccaactggacttcgctgctgaatggcggtcgcctcgcggttggtgatccggaacatgtccctgctggcatttatgcgaaagaagcactgcaaaaactgggcgcatgggatacgctctccccgaaactggctccggcggaagatgttcgtggcgcgctggcgttggtcgaacgcaatgaagcgccgctgggtattgtttacggttctgacgcagttgccagcaaaggggtaaaagtggttgccaccttcccggaagattcacataaaaaagtggaatatccggttgctgttgtggaagggcataacaatgcgacagtgaaagcattttatgattatctgaaggggccgcaggctgcggaaatctttaaacgttacggatttacaaccaagtaatgatactgaccgatccagaatggcaggcagttttattaagcctgaaagtttcttccctggctgtgctgtttagcctgccgtttgggatcttttttgcctggttactggtacgttgcacgtttccgggcaaagctctgctcgacagtgtactgcatctaccgctggtgttaccgcccgtggtcgtcggttacctattattagtttcgatgggacggcgcggatttatcggtgaacgtctgtatgactggtttggtctttctttcgcgtttagctggcgcggtgcggttctcgctgccgctgtcatgtcttttccgctgatggtgcgggcgattcgtctggcgctggaaagtgttgatatcaaactggagcaggccgcaagaacactgggggccgggcgctggcgcgttttctttactatcacgttaccgctgaccttaccgggaattattgttggtacggtgctggcattcgctcgttcgctcggtgaatttggcgcaaccatcacctttgtgtcgaacattcctggtgaaacgcgaaccattccttctgccatgtataccctgatccagacccctggcggggaaagtggcgcggcgagactgtgtattatttctattgcgctggcgatgatctccctgttgatttcagaatggctggccagaatcagccgtgaacgggcggggcgctaatcatgctggaactgaatttttcccagacgttgggcaaccattgcctgacgattaatgaaacgctgcccgccaatggcatcaccgctatttttggtgtctctggtgccggaaaaacctcgctgattaacgccatcagtgggctgacacgtccgcaaaaagggcggattgtcctcaatggtcgggtactaaatgatgccgaaaaaggtatctgcctgtcgccggaaaagcgtcgcgttggctatgtttttcaggatgcgcggctgttcccgcattacaaagtgcgtggcaatctgcgctacggcatggcgaaaagcatggtcaatcagttcgataagctggtggcgcttttaggcattgaaccgttgcttgatcgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacgtctgacgcgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggttaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggagctggaagtcggcggtaaaacgctgtgggcgcgtatcagcccgtgggccagggatgaactggcgatcaaacctggcctgtggctgtacgcgcaaattaaaagtgtgtcgataaccgcctgattaaatcaggtggctataaatgaactgggcaatgctgtcggtggtgttatcaccaatcacaatgttggcgcgcgcttttaccgcgtcatcggcgttgcccatcgccacgcctgtaccagcggcctccagcatactgatatcattaaagttatcgccgaaggccacgacgttttccatcgaccagccttgcgcctcaacccatttcgtcaaacgtttacctttgctgttgccgccgcgtgcaatatcaacctgatcgtgccaggaccattcacactcaagtcccagttcatgttcgacatgcttaccaaaatgctgcaattgcggcaggtcatcgtgcgtcagggcgaacttccatacggcgttaacttgttgcgccgtttcagccagagaagcgacttgtgtgaaagtcggacgctgttccggcggcagggtttgcgcccagttagacgtgcgaatgacatgcccggtcgggtgctcatagaccatcgcatcatccacatacatcagaccgtgaatgtggtgttcattcagcatctcaatgagttgcagggctttattaacgggcattgggtccgcttccagcactgtttttgcatgataatcatacaaataggtgccattacagcaaatagcaggtgtatccagcgccagcgcctgataaaaaggatgaatagcgacgtgatggcgacctgtgacgatgattaattgatagcctgcttcgcgagcgcgggccagggcttctatcgatgaaggaagcagggtctttttcggggtcaataaggtgccgtctaagtcgagagcaatcacgcgtgtggtcatggcgtattccagattaaggttaagaattttcttctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaacctgaatcatgaaggcgcactgacgctgacacaggtagtcgatgtgccggggcaggtgcagccgatggtggtcagcccggacaaacgctatctctatgttggtgttcgccctgagtttcgcgtcctggcgtatcgtatcgccccggacgatggcgcgctgacctttgctgcagagtctgcgctgccggggagcccgacgcatatttccaccgatcacctggggcagtttgtctttgtcggttcttataatgcgggtaacgtgagcgtaacgcgtctggaagatggcctgccagtgggcgtcgtcgatgtggtcgaggggctggacggttgccattccgccaatatctcaccggacaaccgtacgttgtgggttccggcattaaagcaggatcgcatttgcctgtttacggtcagcgatgatggtcatctggtagcgcaggaccctgcggaagtgactaccgttgaaggggccggcccgcgtcatatggtattccatccaaacgaacaatatgcctattgcgtcaatgagttaaacagctcagtggatgtctgggaactgaaagatccgcacggcaatatcgaatgtgtccagacgctggatatgatgccggaaaacttctccgacacccgttgggcggctgatattcatatcaccccggatggtcgtcatttatacgcctgcgaccgtaccgccagtctgattaccgttttcagcgtttcggaagatggcagcgtgttgagtaaagaaggcttccagccaacggaaacccagccgcgcggcttcaatgttgatcacagcggcaagtatctgattgccgccgggcaaaaatctcaccacatctcggtatacgaaattgttggcgagcaggggctactgcatgaaaaaggccgctatgcggttgggcaggggccaatgtgggtagtggtcaacgcgcactaaccgctgatttaaccggcgcagtctctcctgcgccggtgtattaacctatctcctgtaacgcatgtctctggcgttcgacgatattggtccacaaattgtctttatcgtcagtccacaaattaatcagcaaggcaaaaaagcgttcagctgccggagaaagcacggcatctttgcggcgaataatccccaatgtccgacgtataacgggttccaccagtgggataccaataatcgaagaatagggcgcatggggcattgccagaccaggaagcgccgaaatccccagtcccgcctccaccagccctaatgacgtcgaaagatgacgcacttcgtaaaaccagtccagcttccagggcttgtcggctagctgttgttctatcaatagtcggttgccgctggaggagcgtacgccaatcattttgtaacccactaactcctgccattctacaagctgctttttggccaatggatggtcacgccgacaggccagcacgaacggctcgttgaccagtggggtaaaatcaatggatgaatttgtgacgttgttcatgtttatgccaaagtctgattcgttacacagcaccgattccatgcaattattcgtgccttgttccagaatccgcactttaatattgggatacagctcattaaatttaccgattgccagcggtaaaaaataaaatactgcggtcggaatacacgctaacgtcaccataccacgatgataagcattcatatcacgaatattaaaaagcgtttcatcgaatttttttattaattcccgcgcctccgggagcaacctttttcctgcttttgttaacgtaaccttgcgagttgtacgctcaaatagttgaatgtgtaaatcttcctccatcttttttattcttcgcgttaatgcaggttgcgtaatattgagtaatttagcagcattgttaaatgaactggactctgccagtatgacaaatgccttcatacttgataattcatgcttcattattactccggaaaatggaagcgtcgattttgggtggctggccattaaaaattttaactgcatttagccaacttaaattaatgaaaaaatgttattaatcgttgagctaaagtcattagagatgctttgcccttaatgtaaccatatcgcaataagttatgtttttaaattgagggcattattatgaaaaaaataccctgcgtgatgatgcgaggtggaacctcgaggggcgcgttcctgttagcggaacatttacccgaagatcaaacgcagcgcgataaaatattgatggcaattatgggttccggtaacgatctggaaattgacggtattggcggcggtaatccgctgaccagtaaagtcgccattattagccgctccagcgatccgcatgcagatgtcgattatctgtttgctcaagttatcgtccatgagcaacgtgtcgataccacgcctaactgcggcaatatgctgtctggcgttggggcattcgccattgaaaatggtttgattgcagcgacttcgccagttacccgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgccggaacgaaaaccggaaaagtcttcccgactgataatcagattgattattttgacgatgtcccggtgacctgtatcgatatggcgatgccagttgtcattattcctgctgaatatctgggaaaaacaggctatgaattaccggcagagctggatgccgacaaagcattattagcccgcattgaatctatccgtctacaagcgggtaaagcaatgggcttaggcgatgtcagtaatatggttatccctaaacctgtacttatttctccagcgcagaaaggcggggcaattaatgtgcgttattttatgccgcattcttgccatcgcgctttggcgataaccggtgctattgctatttccagtagttgtgcattggaaggtaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgaccagaaaaatattttccggtgaagtttatcttccctgaaaaattttgttgtcgtgataatgatactcaataaaggaattctgtatgagtcatacagaaagaacaggatattaaatgaataaaaaatcgttatggaagctaattctgatattagcgatcccatgtattattggctttatgccagctccggcaggattaagcgaactggcgtgggtgctttttggtatttacctggcggccattgtggggctggttatcaagcctttcccggaacctgtcgtactgttaattgccgtcgccgcatcgatggtcgtggtgggtaacttatcaggtggggaatttaaaaccaccgccgtattaagcggttactcttccggtaccacctggctggtgttttctgcgtttactttaagcgccgcgtttgtaaccacaggcttaggtaaacgtattgcctatctgctgattggtaaaattggtagcactaccctgggtctgggttacgttacggtatttctcgatctggtactggctccggcaacaccgtctaacaccgcgcgtgcgggcggcatcgtgttaccgatcatcaacagcgtggcagtggctttgggatcagaaccggaaaaaagtccgcgtcgtgttggacattacctgatgatgtccatttacatggtcaccaaaaccaccagctatatgttctttaccgcaatggcggggaacattctggcgctgaaaatgatcaacgacattctgcacctgcaaattagctggggtggatgggcgttagccgccggattgccgggcatcattatgctgctggtcaccccgctggtgatttacaccatgtatccaccagaaattaagaaggtggataacaaaaccatcgctaaagcgggccttgccgaactgggaccgatgaaaatccgcgaaaaaatgctgctcggtgtctttgtactggcgctgctgggctggattttcagtaagtctctgggggttgatgaatccaccgtggcaatcgttgttatggcaactatgctgctgctgggcatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcatcatcgtgcgttatttcttcgcttctggtagtgcctatatcgttgccatgttaccggtatttgccatgctggcgaacgtctccggcgcaccgttaatgttaaccgcgctggcactgttgttctctaactcctatggcggcatggttactcactatggcggcgcggcaggtccggtcatctttggcgtgggttacaacgatattaaatcctggtggttggtcggtgcggtactgacgatattaaccttcctggtgcatatcaccctcggcgtgtggtggtggaatatgctgatcggctggaacatgctgtaaatatactcgtcatacttcaagttgcatgtgctgcgtctgcgttcgctcaccccagtcacttacttatgtaagctcctggggattcactcgcttgtcgccttcctgcaactcgaattatttagagtatatccatttattatctttctgcgcacttcacggtgcgcagatatctggagcatttgatgatcaagttatctgaaaaaggcgtgtttctcgccagcaataacgaaataattgccgaagaacatttcaccggcgaaataaaaaaagaagaagcaaaaaaaggcactattgcctggtctattctctcttctcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgtgctgtgggcggcaccattaacggtgatgaccatgtttttggtttatcggcggcccagcgttatggcggtatttttgtgccaccgcatattgcggtcatccatcaatatatgcgtgaaatgatggcgggcggcggcaaaatgatcctcggatcagacagccatacccgttacggtgcgttagggacaatggcggttggcgagggcggcggcgagttggtaaaacagctgcttaatgacacctgggatatcgactatccgggcgtggttgcggtgcatctgaccggaaaacctgcgccgtatgtggggccgcaggatgtggcgctggctatcatcggtgccgtgttcaaaaacggttacgtcaaaaacaaagtgatggagttcgtaggtcccggtgttgcagcgctctctaccgatttccgtaacagcgttgacgtgatgaccactgaaacgacctgtttaagttctgtctggcaaaccgatgaagaagtccataactggctggcgctgcacggtcgcggccaggattactgccaacttaaccctcaaccaatggcgtactacgatggcagcatcagcgttgatttaagcgccatcaaaccaatgattgcgctgccattccacccgagcaacgtgtatgaaatcgacacgctgaaccagaatctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcgctgcgcggtcaatcctgcggcaacgataccttctcgttggcggtttacccgtcatcacagccggtgtttatggatctcgccaaaaaaggtgtggtagcagatttgattggcgcaggcgcaatcatcagaaccgcgttctgcggcccatgctttggtgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaactcgattgctgggacaacgtgccggagtacgccttcgatgtaacgccgtataaaaatcgcgtctatcaaggctttgtgaaaggggcgacccagcaaccgctgatctacggaccgaacatcaaagactggccggaattgggcgcgctgactgacaatatcgtcctcaaagtgtgctcgaagatcctcgacgaagtaaccaccaccgacgaactgattccttccggtgaaacctcttcttatcgttcaaatccgattggtctggcggagtttaccctgtcacgccgcgatccaggttatgttggcagaagtaaagcgactgctgagctggaaaatcagcgtctggcgggaaatgtcagtgagctggcagatatgtttgcgcgcattaagcagattgctggtcaggaacatgttgatccgctgcaaactgaaattggcagcatggtttatgcggtgaaaccaggcgatggttctgcgcgtgaacaggcggcgagttgtcagcgtgtgattggcggtctggcgaatattgccgaggagtacgcgactaaacgctatcgttctaacgtcatcaactgggggatgttaccgctgcagatggcggaagtaccgaactttgacgtaggtgattacatttatatccctggcattaaagcggcgctggataatcctggaacgacgtttaaaggttatgtgatccatgaagatgcaccggtaacggagattacgctctatatggaaagtctgactgctgaagagcgcgagattatcaaggcgggtagtttgattaacttcaataaaaaccgtcagatgtaaaaagcgccatgtgaatgtaggtcgcatccggcacttattgtcggatgcgatgctggcgcatcttatccgaccgacaaatcgcatcgaaccgtaggccggataaggcgtttacgccgcatccggcacatagttaacagctcctacttcttcgcctctgcaaccactttgctacccacgccgcggttattgtattcccacatgcggttgtagttagtgtcattcagattgcgctgtacttcgtcgttatcatcaacgctgccggtgttacccgcaaacggacgattagagatcaccgcatcagcccacggtttggctgtgttaaaaccttcgttgatggcgctatcacggatcactacctgaccgttggtattggcatcaacatccagcgagcggcccagttgcgccacgccatcaccggaagcattgaaacggctgtttacggcgaggaaaccgtagtaaatgttggacagcgtagccggtgcaaacacatacgcttcttgctgggtacgggagttcaccacgcggaattcggtgttatcgaacaccactgcgccgcgaccagaaacgatatccacatccccttcaatatagctgttggtcaccagcgtacgcggctggcgattcgtttccagacggttctgcacaccgctgttggtgacaaagaaggtgttctgacgaccgagaatgttgacgttattgatctgcactttgtcgccatcagtacgcagtgccaccgccggatggttacccgcatctacgctatcgcccagcgtgttttcgatggtcaggttttgcagttgcaggccattgttttgtgaccagaagaccgcagagcagagaacaccgatactgtcgctgcgtttactctggcagctatcgtacatataccacgccggtttacctggcatatatttgccgcgcgggttgacgtcgtgacgccagtcggcagggctcatgccaccatcaagggaaagcccaatcttcacatcaatcggtttttcacctgtaccgtacagagtaattccacccggagcggcagggacatacaccgttccctgatactcaccaggcatcacggcaatatactggcgcttgttggtacgcttgataattgccgcatctaccgccgcctgaatcgtggtatgcgttacaccttgagtacccgccgggccgacaacaaagtcaggttgcgcaggcagggtaatcggggaaggattccacgctgccgcacctggtgtcagggatgcaaaatagtgttgagcatcgaaattctgcgcttcttttgccgacagaatcgggcgcgaagaggtaccaggcgcggtttgatcagaaggacgttgatcgggcggtgttgagctacaggcggtcagcgtcacgccaaaagccaatgccagcgccagacgggaaactgaaaatgtgttcacaggttgctccgggctatgaaatagaaaaatgaatccgttgaagcctgcttttttatactaacttgagcgaaacgggaaggtaaaaagacaaaaagttgtttttaatacctttaagtgataccagatggcattgcgccatctggcagagtgattaactaaacatcgcagtaatcgaggcactcgccagagagtgaaaatgaacgttaaacccgaccatcgcgccgctggcaccttcatcgacatcaatacgttctacatccagcgcgtgaacggtaaaaatgtagcgatgggtttcgcctttcggcggcgctgcgccatcgtacccggttttaccaaagtcggtacgcgtctgcaaaacgccgtctggcatagctaccagaccagagccaaacccttgcggtaatacgcgggtatcagcgggtaaattaacaactacccagtgccaccagccggagccggttggcgcatccgggtcatagcaggtgacaacaaaacttttcgttcccacaggaacatcatcccacgccagatgcggtgaaatattatcgccatcgtaacccatgccgttaaagacatgacgatgcggcagcttatcgccatcgcgcagatcgttactgatgagtttcatgaaccctcctttcttgtttgcagaaagtgtagccagaaaccctcacgctgacttcccgttattggcaaaaaaatgtttcatcctgcaccgcacggttaaccgctgcggtcagacgctgcaactgttgcgggagaataatatagggcggcatcaggtaaatcagtttgccaaaaggccggatccagacaccctgttcgacaaagaatttttgcagcgctgccatattcaccggacgagtggtttcgaccacgccgattgcccccagtacgcgcacatcggcaaccatttcggcgtcacaggcgggggcaagttgctcgcgtagctgcgcttcaatagccgccacctgatgctgccagtcgccagattcaagaatcgccaggctggcgtttgctgctgcgcaggccagcggattgcccataaaagttggcccatgcataaagcagccggcttcgccgttactgatggtttccgcaacctcgcgcgtggtgagcgtggcggaaagggtcattgtgccgccggttaaggctttaccgagacacaaaatatccggcgcgatttctgcatgttcacaggcaaacagtttgccggtacgaccaaatccggtggcgatctcgtcggcaatcagcaagataccttcgcgatcgcacattttgcggattcgttttaaccattccggatggtacatgcgcatcccgcctgcgccctggacaatcggttcaatgatcaccgccgcgatttcatgacgatgcgctgccatcaggcgggcaaagcccaccatatcgcgctcatcccattcgccatccatgcggctttgcggggcgggagcaaacaggttttctggcagatagcctttccacaggctgtgcattgagttgtccggatcgcacaccgacatcgcgccaaaggtatcgccatgataaccattgcggaaggttagaaaacgctggcgcgcttcgcctttggcctgccagtactgcaacgccattttcatcgccacttctaccgctacggagccggagtccgcgagaaaaacgcactccagcggttgcggcgtcattgccaccaatttgcggcacagctcaatggcgggcgcatgggtgataccgccaaacatcacatgcgacatagcatcaatttgcgacttcatcgccgcattaagctgcgggtgattgtaaccgtggatcgccgcccaccaggacgacataccgtcaaccaggcgcctgccgtcagacaaaattagctcgcaaccttcggcgcttgccaccggataaaccggcagcggggaggtcatggatgtgtatgggtgccagatatggcgttggtcaaaggcaagatcgtccgttgtcataatcgacttgtaaaccaaattgaaaagatttaggtttacgagtctacaccgaattaacaacaaaaaacacgttttggagaagccccatggctcaccgcccacgctggacattgtcgcaagtcacagaattatttgaaaaaccgttgctggatctgctgtttgaagcgcagcaggtgcatcgtcagcatttcgatcctcgtcaggtgcaggtcagcactttgctgtcgattaagaccggagcttgtccggaagattgcaaatattgcccgcaaagctcgcgctacaaaaccgggctggaagccgagcggttgatggaagttgaacaggtgctggagtcggcgcgcaaagcgaaagcggcgggatcgacgcgtttctgtatgggcgcggcgtggaagaatccccacgaacgcgatatgccgtacctggaacaaatggtgcagggggtaaaagcgatgggtctggaggcgtgtatgacgctgggcacgttgagtgaatctcaagcgcagcgcctggcgaatgccgggctggattactataaccacaacctcgacacctcgccggagttttacggcaatatcatcaccacccgcacctatcaggaacgtctcgatacgctggaaaaagtgcgagaagctgggattaaagtctgttcaggtggcattgtgggcttaggcgaaacggtgaaagatcgcgccggattattactgcaactggcaaacctgccgacgccgccggaaagcgtgccaatcaacatgctggtgaaggtgaaaggcacaccgctggcggataacgatgatgtcgatgcctttgattttattcgcaccattgccgtagcgcggatcatgatgccgacctcttacgtacgcctttctgccggacgcgagcagatgaacgaacagactcaggcgatgtgctttatggctggcgcaaactcgattttctacggttgcaaactgctgactacgccgaatccggaagaagataaagacctgcaactgttccgcaaactggggctaaatccgcagcaaactgccgtgctggcgggcgataacgaacaacagcagcgtctggagcaggcgctgatgaccccggacactgacgaatattacaacgcggcagcactatgatctggcaggagaaaatcgacgcggcgcttgatgcgcggcgtgttgctgatgccttgcgtcgccgttatccggtggcacaaggagccggacgctggctggtggcagatgattgccagtatctgaacttttccagtaacgattatttaggtttaagccatcatccgcaaattatccgcgcctggcagcagggcgcggatcaatttggtgtcggtagcggcggttccggtcacgtcagcggttatagcgtggcgcaccaggtgctggaagaagaactggccgaatggctgggctattcgcgggcgctgctgtttatttctggttttgccgctaatcaggctgtcattgccgcgatgatggcgaaagaggaccgtattgttgccgaccggcttagccatgcctcattgctggaggctgcaagtttaagcccgtcgccgcttcgccgttttgctcataacgatgtcactcatctggcgcgactgcttgcttccccctgtccggggcagcaactggtagtgacagaaggtgtgttcagcatggacggcgatagtgcgccactggaggaaatccagcaggtaacgcaacagcacgatggctggttgatggtcgatgacgcccacggcacgggcgttatcggggagcaggggcgtggcagctgctggctgcaaaaggtaaaaccagaattgctggtggtgacgtttggcaaaggatttggcgtcagcggggcagcggtgctttgctccaatacggtggcggattatctgctgcaattcgctcgccatcttatctacagcaccagtatgccgcccgctcaggcgcaggcattacgtgcgtcgctggcggtcattcgcagtgatgagggggatgcacggcgcgaaaaactggcggcactcattacgcgttttcgtgccggagtgcaggatttgccgtttacgcttgctggctcatgcagcgccatccagccattgatcgtcggtgataacagccgtgcgttacaactggcagaaaaactgcgccagcaaggctgctgggtcacggcgattcgcccgccaaccgtacccgctggtactgcgcgactgcgcttaacgctaaccgcagcgcatgaaatgcaggatatcgaccgtctgctggaggtgctgcatggcaacggttaataaacaagccattgctgcggcatttggacgggcagccgcacactatgagcaacacgccgatctacagcgccagagtgctgacgccttactggcaatgctcccacagcgtaaatacacccgcgtactggatgcgggttgtggaccaggctggatgagccgccgctggcgagagcgtcacgcgcaggtgactgcgttagatctctctccgccaatgcttgttcaggcacgccagaaggatgccgcagaccattatctggcgggagatatcgaatccctgccgttagcgactgcgacgttcgatcttgcatggagcaatctcgcggtgcagtggtgcggtaatttatccacggcactccgcgagctgtatcgggtggtgcgccccggaggcgtggtcgcgtttaccacgctggtgcagggatcgttacccgaactgcatcaggcgtggcaggcggtggacgagcgtccgcatgctaatcgctttttaccgccagatgaaatcgaacagtcgctaaacgccgtgcattatcaacattatattcagcccatcacgctgtggtttgatgatgcgctcagtgccatgcgttcgctgaaaggcatcggtgccacgcatcttcatgaagggcgtgacccgcgaatattaacgcgttcgcagttgcagcgattgcaactggcctggccgcaacaacaggggcgatatcctctgacgtatcatctttttttgggagtgattgctcgtgagtaaatgttattttgtcaccggaacggataccgaagtggggaaaactgtcgccagctgcgcgcttttacaagccgcaaaggcagcaggctaccggacggcaggttacaaaccggtggcctctggcagcgaaaagaccccgaaaggcttacgtaatagtgacgcgctggcgttacagcgcaacagtagcctgcagctggattacgcaacggtaaatccttacaccttcgcagaacccacctcgccgcatatcatcagcgcgcaagagggcaggccgatagaagcattggtaatgagcgccggattacgcgcgcttgaacaacaggctgactgggtgttagtggaaggtgctggcggctggtttacgccgctttctgacactttcacttttgcggattgggtaacacaggaacaactgccagtgatactggttgtgggcgtgaaactcggctgtattaatcacgcgatgttgactgcgcaggcaatactacacgccggactgactctggcggggtgggtggcgaacgatgtcacgcctccgggaaaacgtcacgctgaatatatgaccacgctcacccgcatgattcccgcgccgctgctgggcgaaattccctggcttgcagaaaatccagaaaatgcggcaaccggaaagtacatcaatcttgccttaatgtagtcatcctgtacttggttaaattgtgagcgagatcgcgtctccgattgactgcaatttaaccaattaaattctaaaaa

SEQ ID NO: 10032 - DNA, 36491 bp, Escherichia coli
cgcttcttagctgatttgatattagccaaggtccaactcccaaatgtgttctatatggacaattcaaaggccgaggaatatgcccttttagccttcttttgtcaatggatttgtgcaaataagcgccgttaatgtgccggcactcgttacgtagtgatggcgcaggattctaccagcttgcggggtgtgaatacagcttttccgcgagaaaaattgcagcaggcggtcagtttcttcccatgatttgcgccatagcaatgaaaagccacttctttctgatttcggtactcaatcgccggttaaccttgaccgctgtacaaggtatactcggacgattttcactgttttgagccagacatgaagctgatacgcggcatacataatctcagccaggccccgcaagaagggtgtgtgctgactattggtaatttcgacggcgtgcatcgcggtcatcgcgcgctgttacagggcttgcaggaagaagggcgcaagcgcaacttaccggtgatggtgatgctttttgaacctcaaccactggaactgtttgctactgataaagccccggcacggctcacccggctgcgggaaaaactgcgttatcttgcagagtgtggcgttgattacgtgctgtgcgtgcgttttgacaggcgttttgcggcgttaaccgcgcaaaacttcatcagtgatcttctggtgaagcacttgcgggtaaaatttcttgccgtaggtgacgatttccgctttggcgctggtcgtgaaggcgatttcttgttattacagaaagcgggcatggaatacggcttcgatatcaccagcacgcaaactttttgcgaaggtggcgtgcgtatcagcagcaccgccgtgcgtcaggcgcttgcggatgacaatctggctctggcagaaagtttactggggcacccgtttgccatctccgggcgtgtagtccacggtgatgaattagggcgcactataggtttcccgacggcgaatgtaccgctacgccgtcaggtttccccggtgaaaggggtttatgcggtagaagtgttgggccttggcgaaaagccgttacccggcgttgcaaacatcggaacacgcccaacggttgccggtattcgccagcaactggaagtgcatttgttagatgttgcaatggacctttatggtcgccatatacaagtagtgctgcgtaaaaaaatacgcaatgagcagcgatttgcatcgctggacgaactgaaagcgcagattgcgcgtgatgaattaaccgcccgcgaattttttgggctaacaaaaccggcttaagcctgttatgtaatcaaaccgaaatacggaaccgagaatctgatgagtgactataaatcaaccctgaatttgccggaaacagggttcccgatgcgtggcgatctcgccaagcgcgaaccgggaatgctggcgcgttggactgatgatgatctgtacggcatcattcgtgcagctaaaaaaggcaaaaaaaccttcattctgcatgatggccctccttatgcgaatggcagtattcatattggtcactcggttaacaagattctgaaagacattatcattaagtccaaagggctttctggatatgactcgccgtatgtgcctggctgggactgtcatggtctgccaatcgagctgaaagtagagcaagaatacggtaagccgggggagaaattcaccgccgctgagttccgcgccaagtgccgcgaatacgctgcgacccaggttgacggtcagcgcaaagactttatccgtctgggcgtgctgggcgactggtcgcacccgtacctgaccatggacttcaaaactgaagccaacatcatccgcgcgctgggcaaaatcatcggcaacggtcacctgcacaaaggcgcgaagccggtgcactggtgcgttgactgccgttctgcactggcagaagcggaagttgagtattacgacaaaacttctccgtccatcgacgtcgctttcctggcggtcgatcaggatgcgcttaaaacgaaatttggcgtaagcaatgttaacggcccaatttcgctggttatatggaccaccacgccgtggacgctgcctgctaaccgcgcaatctccattgcacctgattttgattatgcgctggtgcaaatcgacggtcaggccgtgatcctcgcgaaagatctggttgaaagcgtaatgcagcgtatcggcgttagcgattacaccattcttggcacggtgaaaggtgccgagctggaactgttgcgctttacccatccgtttatggacttcgatgttccggcaattctcggcgaccacgttacgctggatgccggtaccggtgccgttcataccgcgccaggccacggtccggacgactatgtgatcggtcaaaaatatggtctggaaaccgctaacccggttggcccggacggcacttatctgccgggtacttacccgactctggatggcgttaacgtcttcaaagcgaacgatattgtcattgcgttgttgcaggaaaaaggcgcactgttgcacgttgagaaaatgcaacacagctatccgtgctgctggcgtcataaaacgccgatcatcttccgcgcgacgccgcagtggttcgtcagcatggatcagaaaggtctgcgtgcgcagtcactgaaagagatcaaaggcgtgcagtggatccctgactggggccaggcgcgtatcgagtcgatggttgctaaccgtcctgactggtgtatctctcgtcagcgtacctggggcgtgccgatgtcactgttcgtgcacaaagacacagaagaactgcatccgcgtactctcgaactgatggaagaagtggcaaaacgcgttgaagttgacggcattcaggcgtggtgggatctcgatgcgaaagagatcctcggcgacgaagctgaccagtatgtgaaagtaccggatacgctggatgtatggtttgactccggatctacccactcttccgttgttgatgtgcgtccggaatttgccggtcacgcagcggacatgtatctggaaggttctgaccaacaccgtggctggttcatgtcttccctgatgatctctaccgcgatgaagggcaaagcgccatatcgtcaggtactgactcacggctttaccgtggatggtcagggtcgcaagatgtctaaatccatcggtaacaccgtttcgccgcaggatgtgatgaacaaactgggtgcggatattctgcgtctgtgggtggcatcaaccgactacactggcgaaatggccgtttctgacgagatcctgaaacgtgctgccgacagctatcgtcgtatccgtaacaccgcgcgcttcctgctggcaaacctgaacggttttgatccggcaaaagatatggtgaaaccggaagagatggtggtactggatcgctgggccgtaggttgtgcgaaagcggcacaggaagacatcctcaaagcgtacgaagcatacgatttccacgaagtggtacagcgtctgatgcgcttctgctccgttgagatggggtccttctacctcgacatcatcaaagaccgtcagtataccgccaaagcggacagcgtggcgcgtcgtagctgccagactgcgctgtatcacatcgcagaagcgctggttcgctggatggcaccaatcctctccttcaccgctgatgaagtgtggggttacctgccgggcgaacgtgaaaaatacgtcttcaccggcgagtggtacgaaggcctgtttggtctggcagacagtgaagcaatgaacgatgcgttctgggacgagctgttgaaagtgcgtggcgaagtgaacaaagtcattgagcaagcgcgtgccgataagaaagtgggcggctcgctggaagcggcagtaaccttgtatgcagaaccggaactggcggcgaaactgaccgcgctgggcgatgaattacgatttgtcctgttgacctccggcgctaccgttgcagactataacgacgcacctgctgatgcccagcagagcgaagtcctcaaagggctgaaagtcgcgttgagtaaagccgaaggtgagaagtgccctcgctgctggcactacacccaggatgtcggcaaggtggcggaacacgcagaaatctgcggccgctgtgtcagcaacgtcgccggtgacggtgaaaaacgtaagtttgcctgatgagtcaatcgatctgttcaacagggctacgctggctgtggctggtggtagtcgtgctgattatcgatctgggcagcaaatacctgatcctccagaactttgctctgggggatacggtcccgctgttcccgtcgcttaatctgcattatgcgcgtaactatggcgcagcgtttagtttccttgccgatagcggcggctggcagcgttggttctttgccggtattgcgattggtattagcgtgatcctggcagtgatgatgtatcgctcgaaggccacgcagaagctaaacaatatcgcttacgcgctgattattggcggcgcactgggcaacctgttcgaccgcctgtggcacggcttcgttgtcgatatgatcgacttctatgtcggcgactggcacttcgccaccttcaaccttgccgatactgccatttgtgtcggtgcggcactgattgtgctggaaggttttttaccttctaaagcgaaaaaacaataataaaccctgccggatgcgatgctgacgcatcttatccggcctacagattgctgcgaaatcgtaggccgcatccggcaaaaatcctcaaaatataagagcaaacctgcatgtctgaatctgtacagagcaatagcgccgtcctggtgcacttcacgctgaaactcgatgatggcaccaccgctgagtctacccgcaacaacggtaaaccggcgctgttccgcctgggtgatgcttctctttctgaagggctggagcaacacctgctggggctgaaagtgggcgataaaaccaccttctcgctggagccagatgcggcgtttggcgtgccgtcaccggacctgattcagtacttctcccgccgtgaatttatggatgcaggcgagccagaaattggcgcaatcatgctttttaccgcaatggatggcagtgagatgcctggcgtgatccgcgaaattaacggcgactccattaccgttgatttcaaccatccgctggccgggcagaccgttcattttgatattgaagtgctggaaatcgatccggcactggaggcgtaacatgcagatcctgttggccaacccgcgtggtttttgtgccggggtagaccgcgctatcagcattgttgaaaacgcgctggccatttacggcgcaccgatatatgtccgtcacgaagtggtgcataaccgctacgtggtcgatagcctgcgcgagcgtggggctatctttattgagcagattagcgaagtaccggacggcgcgatcctgattttctccgcacacggtgtttctcaggcagtacgtaacgaagcgaaaagccgcgatttgacggtgtttgatgccacctgtccgctggtgaccaaagtgcatatggaagtcgcccgcgccagccgtcgtggtgaagaatctattctcatcggtcacgccgggcacccggaagtggaagggacgatgggccagtacagcaacccggaagggggaatgtatctggtcgaatcgccagacgatgtgtggaaactgacggtcaaaaacgaagagaagctctcctttatgacccaaaccacgctgtcggtggatgacacgtctgatgtgatcgacgcgctgcgtaaacgcttcccgaaaattgtcggtccgcgcaaagatgacatctgctacgccacgactaaccgtcaggaagcggtacgcgccctggcagagcaggcggaagtagtactggtggttggttcgaaaaactcctccaactccaaccgtctggcggaactggcccagcgtatgggcaagcgcgcgtttttgattgacgatgcgacagatatccaggaagagtgggtgaaagaggcgaaatgcgtcggcgtgactgctggcgcatcagctccggatattctggtacagaacgtagtcgcacgtttacagcagcttggcggtggcgaagccattccgctggaaggtcgtgaagaaaacattgttttcgaagtgccgaaagagctgcgtgtcgatattcgtgaagtcgattaagtcattagcagcctaagttatgcgaaaatgccggtcttgttaccggcattttttatggagaaaacatgcgtttacctatcttcctcgatacagaccccggcattgacgatgccgttgccattgccgccgcgatttttgcccccgaactcgatctgcaactgatgaccactgtcgcgggtaatgtttcggtagagaaaaccacccgcaacgccctgcaactgctgcatttctggaatgtggatattccgcttgcccagggcgctgccgtaccactggttcgtgcgccgcgcgatgcggcatctgtacacggtgaatcgggaatggctggctatgactttgttgaacacaaccgtcagccactgggtataccggcgtttctggcaattcgtgatgccctgatgcgtgcgccagagcccgttaccctggtggccatcggcccgttaaccaatattgcgctgttactttcacaatgcccggaatgtaagccgtatattcgccgtctggtgatcatgggcggttctgctggtcgcggcaactgcacaccaaacgccgagtttaatatcgctgccgatccagaagcggcagcctgtgtcttccgtagcggcatcgaaatcgtcatgtgcggtctggatgtcaccaatcaggcaatattaacccctgactatctcgctactttgccggaattgaatcgcaccggaaaaatgctacacgccctgtttagccactaccgtagcggcagtatgcaaagtggactacgtatgcacgatctttgcgctatcgcctggctggtgcgcccggaattgttcactctcaaaccgtgttttgtcgcggtagaaactcagggtgaatttacctcaggcacgacggttgttgatatcgacggttgcctgggcaaaccagccaatgtacaggtggcgctggatctggatgtgaaaggcttccagcaatgggtggctgaggtgctggccctggcgctctaataataaaacaaggaagtgttctatgacgtatggagaagcgtatctggaagggtggaaaaacatctttaattatgaaggtgtttccaatcgcttcgagttctggtcgtttatgattggtagtggcgttatctgtctgcttccgcttttatgttggtggttagcggtaacaattaacaatgactatggtgttttcattttttttgcgctgcccgcgtcatttattttaacgttgatttttgccataccggcgatagcgttagccgtcagaaggatgcacgatatcggatattcagggtggtgggttaccattgtcgtgttgatccctgttacgggcgtaattctgcttatactgtgctgcctgccgtcaaagtcacaagaccaggcataatgacagagggtatgacgcatcactttctgcgtcatgcctttcactgatatccctccctgtttatcattaatttctaattatcagcgtttttggctggcggcgtagcgatgcgctggttactctgaaaacggtctatgcaaattaacaaaagagaatagctatgcatgatgcaaacatccgcgttgccatcgcgggagccgggggccgtatgggccgccagttgattcaggcggcgctggcattagaaggcgtgcagctgggcgcggcgctggagcgcgaaggatcttctttactgggcagcgatgcgggcgaactggccggagccgggaaaacaggcgttactgtgcaaagtagtcttgatgcgataaaagatgattttgatgtgtttatcgattttacccgtccggaaggtacgctgaaccatctcgctttttgtcgccagcatggcaaagggatggtgatcggcactacggggtttgacgaagccggtaaacaggcgattcgtgacgccgccgccgatattgcgattgtctttgccgccaattttagcgttggcgttaacgtcatgcttaaactgctggagaaagcagccaaagtgatgggggactacaccgatatcgaaattattgaagcacatcatagacataaagttgatgcgccgtcaggcaccgcactggcaatgggagaggcgatcgcccacgctcttgataaagatctgaaagattgcgcggtctacagtcgtgaaggccataccggtgaacgtgtgcctggcaccattggttttgccaccgtgcgtgcaggtgacatcgttggcgaacataccgcgatgtttgccgatattggcgagcgtctggagatcacccataaggcatccagccgcatgacatttgctaacggtgcggtaagatcggctttgtggttgagtggtaaggaaagtggtctttttgatatgcgagatgtgcttgatctcaataatctgtaaccacaagatatttatggtgatgcaaaaacaacacatttaattcgttgaatataaagggctttaatttttggcccttttatttttagtgttatgcttttaaatctaatgcaaatgctgaaaattacatgttttgtattctgtttttgttgttttaatgtaaattttgaccatttggtccacttttttctgctcattttgatttcatgcaatcttcttgctgcgcaagcgttttccagaacatgttatatgatctttttgtcgcttaatgcctgtaaaacatgcatgagccacaaaataatataaaaaatcccgccattaagttgacttttagctcccatatctccagaatgccgccgtttgccagaaattcgtcggtaagcagatttgcattgatttacgtcatcattgtgaattaatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcactaatgacgccgatgaagaatcttctcaggttcatgcccaaggtctggtgattcgcgacctgccgctgattgccagcaacttccgtaataccgaagacctctcttcttacctgaagcgccataacatcgtggcgattgccgatatcgatacccgtaagctgacgcgtttactgcgtgagaaaggtgctcagaatggctgcattatcgcaggcgataacccggatgcggcgctggcattagaaaaagcccgcgcgttcccaggtctgaacggcatggatctggcaaaagaagtaaccaccgcagaaccctatagctggacacaagggagctggacactgaccggcggcctgccagaagcgaaaaaagaagacgagctgccgtaccacgtcgtggcctacgatttcggtgccaagcgcaacatcctgcgtatgctggtggatagaggctgtcgcctgaccatcgttccggcgcaaacttctgcggaagatgtgctgaaaatgaatccggacggcatcttcctctccaacggtcctggcgacccggccccgtgcgattacgccattaccgctatccagaaattcctcgaaactgatattccggtattcggcatctgcctcggtcatcagctgctggcgctggcgagcggtgcgaagactgtcaaaatgaaatttggtcaccacggcggcaaccatccggttaaagatgttgagaaaaatgtggtgatgatcaccgcccagaaccacggttttgcggtggatgaagcaacattacctgcaaacctgcgtgtcacacataaatccctgttcgacggtacgttacagggcattcatcgtaccgataaaccggcgttcagcttccagggacacccggaagccagccctggtccacacgacgccgcgccgttgtttgaccactttatcgcgttaattgagcagtaccgtaaaaccgctaagtaatcaggagtaaaagagccatgccaaaacgtacagatataaaaagtatcctgattctgggtgcgggcccgattgttatcggtcaggcgtgtgagtttgactactctggcgcgcaagcgtgtaaagccctgcgtgaagagggttaccgcgtcattctcgtgaactccaacccggcgactatcatgaccgacccggaaatggctgatgcaacctacatcgagccgattcactgggaagtggtacgcaagattattgaaaaagagcgcccggacgcggtgctgccaaccatgggggggcagacggcgctgaactgtgcgctggagcttgagcgtcagggcgtgctggaagagttcggcgtcaccatgattggtgccactgccgatgcgattgataaagccgaagaccgccgccgtttcgacgtagcgatgaagaaaatcggtctggaaactgcgcgttccggtatcgctcattcaatggaagaagcgctggcggttgccgctgaagttggcttcccgtgcattattcgcccatcctttaccatgggcggtagcggtggcggtatcgcttataaccgtgaagaatttgaagaaatttgcgcccgcggtctggatctttctccgactaaagagctgctgattgatgagtcgctgatcggctggaaagagtacgagatggaagtggtgcgtgataaaaacgacaactgcatcatcgtctgctctatcgaaaactttgatgcgatgggcatccacaccggtgactccatcactgtcgcgccagcccaaacgctgaccgataaagaatatcaaatcatgcgtaacgcctcgatggcggtactgcgtgaaatcggcgttgaaaccggtggttccaacgtccagtttgcggtgaacccgaaaaacggtcgcctgattgttatcgaaatgaacccacgcgtgtctcgctcctctgcgctggcgtcgaaagccactggtttcccgattgccaaagtggcggcgaaactggcggtgggttacaccctcgacgagctgatgaacgacatcaccggtgggcgtactccggcctccttcgagccgtccatcgactatgtggttactaaaattcctcgcttcaacttcgagaaattcgccggtgctaacgaccgtctgaccactcagatgaaatcggttggcgaagtgatggcgattggtcgcacgcagcaggaatccctacaaaaagcgctgcgcggcctggaagtgggcgcaactggcttcgatccgaaagtgagtctcgacgacccggaagcgctgactaaaatccgccgcgaactgaaagatgctggcgcagagcgtatctggtatatcgctgatgccttccgcgcgggcctgtctgtagacggtgtatttaatttgaccaacattgaccgctggttcctggtacagattgaagagctggtgcgtctggaagagaaagtcgcagaagtgggcatcactggcctgcacgctgaattcctgcgccagctgaaacgcaaaggctttgccgatgcgcgtctggcaaaactcgcgggcgtgcgtgaagcagaaatccgcaagctgcgcgaccagtatgacctgcacccggtttacaagcgcgtggatacttgtgcggcagagttcgccaccgacaccgcttacatgtactccacttatgaagaagagtgcgaagcgaatccgtccaccgatcgtgaaaaaatcatggtgctcggcggcggcccgaaccgtatcggtcagggtatcgaattcgactactgctgtgtacacgcctcgctggcgctgcgcgaagacggttatgaaaccattatggttaactgtaacccggaaaccgtctccaccgactacgacacctctgaccgtctctacttcgagccggtaactctggaagacgtgctggaaattgtgcgtattgagaagccgaaaggcgttatcgtccagtacggcggtcagaccccgctgaaactggcgcgcgcgctggaagctgctggcgtaccggttatcggtaccagcccggatgccatcgaccgtgcggaagaccgtgaacgcttccagcatgcggttgagcgtctgaaactgaaacaaccggcgaacgccaccgttaccaccatcgaaatggcggttgagaaagcgaaagagattggctacccgctggtggtgcgtccgtcttacgttctcggcggtcgggcgatggaaatcgtctatgacgaagctgacctgcgtcgctacttccagacagcggtcagcgtatctaacgatgcgccagtgttgctggaccacttccttgatgacgcagtagaagttgacgtggatgccatctgcgacggcgaaatggtgctgattggcggcatcatggagcatattgagcaggcgggtgtgcactccggtgactccgcatgttcactgccagcttacaccttaagtcaggaaattcaggatgtgatgcgccagcaggtgcagaaactggccttcgaactgcaggtgcgcggcctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgtgtgatggctggcaaatcgctggctgagcagggcgtaaccaaagaagttatcccgccgtactactcggtgaaagaagtggtgctgccgttcaataaattcccgggcgttgacccgctgttagggccagaaatgcgctctaccggggaagtaatgggcgtgggccgcaccttcgctgaagcgtttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgactcacggcacggcgattgtgctgggcgaagcgggtatcaatccgcgtctggtgaacaaggtgcatgaaggccgtccgcacattcaggaccgtattaagaatggcgaatatacctacatcatcaacaccacctcaggtcgtcgtgcgattgaagactcccgcgtgatccgtcgcagtgcgctgcaatataaagtgcattacgacaccaccctgaacggcggctttgccaccgcgatggcgctgaatgccgatgcgaccgaaaaagtaatttcggtgcaggaaatgcacgcgcagatcaaataatagcgtgtcatggcggatatttttcatccgctaatttgatcgaataactaatacggttctctgatgaggaccgtttttttgtgcacagaaaacccccagctaggctgggggttccggaaagctttcagctttgagccagttattaaaaccccttttgatttgttaaaacaccttgcggtctggcaactgcaagtgtcaaacaagaaatcaaaagggggtcccaatggggaacgaaaagagcttagcgcacacccgatggaactgtaaatatcacatagtatttgcgccaaaataccgaagacaggtgttctacagagagaagcgtagagcaataggctgtattttgagaaagctgtgtgagtggaaaagtgtacggattctggaagctgaatgctgtgcagatcatatccatatgcttgtggagatcccgcccaaaatgagcgtatcaggctttatgggatatctgaaagggaaaagcagtctgatgccttacgagcagtttggtgatttgaaattcaaatacaggaacagggagttctggtgcagagggtattacgtcgatacggtgggtaagaacacggcgaagatacaggattacataaagcaccagcttgaagaggataaaatgggagagcagttatcgattccctatccgggcagcccgtttacgggccgtaagtaacgaagttggatgcaaatgtcagatcgtgtgcgcctgttagggcgcggctggtaagagagccttataggcgcatttgaaaaacctccggctatgccggaggatatttatttgcccattaagtaaatcttttggggaatcgatatttttgatgacataagcaggatttagctcacacttatcgacggtgaagttgcatactatcgatatatccacaattttaatatggccttgtttaattgctgcaaaacgagtcatagccagtcttttaatttgtgaaactggagttcgtatgtgtgaaggatgtgttgaaaaaccactctatttgttaatcgccgaatggatgatggctgaaaaccggtgggtgatagcaagagagatctctattcatttcgatattgaacacagcaaggcggttaataccctgacttatattctgtcggaagtcacagaaataagctgcgaagttaagatgatccctaataagctggaagggcggggatgccagtgccagcgactggtaaaagtggttgatatcgatgagcaaatttacgcgcgcctgcgcaataacagccgggataaattagtcggcgtaagaaagacgccgcgtattcctgccgttccgctcacggaacttaaccgcgagcagaagtggcagatgatgttgtcaaagagtatgcgtcgttaatgtcatttcgttgataccgtgcgacctggtcgctggatgcgatgctggcgcatcttatccggcctacggttgctttacagccaggtcggataaggcgtttatgccgcatccgacgatgttaccgtttcggcgtcacatccgtcgtcccctgcaaacgggggcgattttcctccatttgcctcagtggctgcgtttcatgtaacgctgcatgacagcgcccgacaagatcctgatactctttggtattcaaccgtttccagtgtaactcgtcgtcactcacgctgcgtacagcgcgggctggcgtacccatcaacaactggcgtttctcgccgcgaaagcccgctttgacaaagctcatagcggcaacaatgctctcttcgccaatgaccgcgccatccataatcacgctgttcatcccgaccagtgcatcgcgaccaatcacacaaccatgcaggatcgctccgtgcccgatatgaccgttttccccaacgatggtgtcagtgtcgcagtagccatgcataatgcagccatcctgaatattggctcccgcttgcacgatcaaccgcccgtagtcaccacgcagtgaggcgagtgggccgatgtagacaccggctcccacaatcacatcgccaatcaatactgcactgggatggacaaacgccgtcgggtgaacaaccggaattaacccctcaaaggcgtaatagctcacggttgttaacgtcctttccacactggatcgcgcttctcggcaaacgccagcggcccttcaatggcatcctccgaatgcagaaccgatggatagtgtttcaacacgccgctgcgaatatagcgatacgcttcttctaccggcatttcactggtggtgcggtagatctctttcagcgccgcaatcgccagcggagcgctgttaaccagctgctgcgccagttcgcgggcgttatccatcagttccgcctggctaaccacgcggttgactaccccccaacgcagcgcctcttctgcgcccattcgtctgccggtcatcaccatttcattgacgatggcaggcggcaggatcttcggcagacgcagcacgccgccgctgtcaggaacgatgcccagtttggcttccggtagggcgaagctggcgttatcggcacaaacaataaaatctgccgccagcgccagttcaaagccgccgccaaaggcatagccgttcacagcggcgatgaccggtttgtcgagattgaaaatttcggttaatcccgcaaaacctcccgggccaaagtcagcatccggtgcttcgccttctgctgccgcttttaaatcccagcccgcggaaaagaatttctctccggcaccggtaataatggcgacacgtaattgcggatcgtcacggaaatttagaaatacttcgcccatttcaaagctggtttttgcatcaatagcattcgcttttggacgatcaagggtaatttccagaattgatccattgcgggtcagatgtaatgattcactcattccttttctccatttttgctttttcagggacgacaacatccctgcaaaaaatgcatattgttttagagcgtgattattagctgacagggtagttccctgccgtttcatttatttcagattctttctaattattttccccgagcaattacgtggcagatcttttctgatctccagataagagggcactttaaatttcgccatattctgttcacagaagcagaagaattcctcttcgctcaatgtttcaccttcattcagcaccacaaatgctttgatggcttcatcgcgaatcgaatctttaatacccacaaccacgatatcctgaatttttggatgggtggcgatgatattttcgagctccacgcaggagacattctcgccaccgcgtttgatcatattgcagcggcgatcgacgaaataaaaaaagccctcttcgtcgcggtatccggtatcgccggtatgtagccagccatcggcttccagcactttcgcagtggctttcgggttgagaaaatactctttgaagatggttttccctggtacgcctttaatacagatttcaccgagctcaccagccgggaggggacgattgtgatcgtcgcggatctccgcttcgtagcaaaagcccgcccgaccaatcgacggccagcgccgtttatcgccagggcgatcgccgataatgcccacaatggtttccgtcatcccataagacgtcagcaagcgaacgccgaagcgttcacaaaacgcgtctttttcctgttccgacaagttgagataaaacatcacttcccgcaggcggtgttgccgatcgttcgctgaaggcggctgcaccatcaacgtacgaatcatcatcggaatacattcggtaatggtggcgcggtacttctgcacctgtccccagaaggcgcgggcgctgtatttctcgaccagcacaaaggtggccccggcagaaaacgccgccatcgccgcagtacactggcaatcgatatgaaacgcaggcattaccgtcaggtagacgtcatcgtcacgcagtgcacactgccaggcggagtaatatccagcgaagcgcaggttgtaatgggtaatcaccacccctttcggtcgggaggtagtgccggaggtgaagagaatttccgccgtatcgtcagtcgatagcggcggtgcatagcacaaggtggcaggttgttgatttttcagttgagtaaacgaactcacgccatcatcagcgggaagtgccatatctatcaggcaaatgtgccgcaactgagaggcatcttcctgctgaatctgttgatacataggataaaattgcgcactggtcaccagcaggcacgcctggctattttgcaggatccacgtgctttcttcgcgcaacaggcgggcgttaattggcaccataatcgcgccaatttttgccagcccgaaccagcaaaagataaattccgggcagttgtcgagatgtagagcaaccttgtcgcctttgcgaatccccagcgtataaaacaggtttgccgtgcggttaatctcctgatttaactcaagataactataccggttaacgactccgccgctggattcacaaatcagcgccgttttatgaccgtaaacgtccgccagatcgtcccacatttgacgtagatgttgtccgccaatgatatccattgcacctctatccattttgttcgtttgttattgggcgggcgctagtcaggcaagttgactgacgccacgcgtttagtcctcaactttggccagacctttgctgaccaactcctgaatgtcgttttcgctgtagccgatatttttcaaaatggcagccgtgtccatgccatgtgagggcattccgcgccagatttgtccggggttatttttgaatttcggcatgatattcggccctttgcaggtgcgaccatccatcgtttgccactgagtgattgattcgcgagccacatactgtggattgctttccagttccggcacggtcagtactttggcacaggcgatattcagttcggcaaagcgttctttaacttctgcgatggtatgtgccgccagccaggcatcgagtttctcttctaccagtgggccgtaagggcattcgatacggtggataagctgagtgccttccgggatttccggcgtaccgagcagatgtgcgaggccaatatctttaaagcactctgcaatttgagtaatgcccaccagttccatcacgatgtagccgtcggcgcatttatacagaccgcaaccggcgtagtagggatctttacctttggtcatgcgcgggcacatttcgccgccgttgaagtaatccatcatgaagtactggcccatacgcagcatcacttcatacatggcgatgtcgatgctttcgcctttaccggtttcacgcactttatgcagtgctgccagcgccgccgtggtggcggtcaggccagaaaagtaatcggcggtatacgggaaggcaggcattggctggtcaacatcaccgttctgaatcaggtaaccactgaaggcctgggcgatagtgttataggccggaagattggtgtactcctcggtgccatactgaccaaaaccggaaaggtgagcgataaccagttttgggttgtgctgccacaggacttcatcggtaatgccacgacgggcaaaggccggacctttactggcttcgatgaagatatcggtggtttccattaatttcagaaacgcttcgcgcccttcatctttgaaaatatttaacgacagcgcatgcaaattgcggcgggagagctgcgggtagttcggttgaacgcgaatggtgtcggcccaggcgacgttctcgatccagataacttccgccccccattctgcgaacatttgtccggcgaacggcccggcgatttcgataccggagaagacaacgcgtaatccggccagcggcccgaatttcggcatgggtagatgatccattattagctcctgaaaaatttatgtagcgcatgactgccggatgcggcgtaaacgccttatccggccatcttcgtgctcccgtaggcctgataagacgcgtcagcgtcgcatcaggcagcgcacggacttaacggtattgcttcagcaccgcgcgacccagcgtcaggatctgcatttcgtcagatcctccggaaacgcggtctacacgcaggtcacgccagaagcggctgatgcggtggttgcccgcaatcccgacaccgcccagcacctgcattgcgctatccaccacttcaaatgccgcattggcgcagaagtatttgcacatcgctgcatcgccagaggtgatggtgccgttgtctgctttccacgctgcttcatacagcatgtttttcatggagtttaatttgatcgccatgtgggcgaatttttcctgaatcaactggaaacgaccaatagcctcgccaaactgcacacgctggttggcgtagcgcgccgcatcttcaaaggcgcacatcgccgtaccgtagttggtcagggctaccaggaaacgttcatggtcgaactcttctttgacgcggttaaagccgttaccttcccgaccgaacatgtctttctcgtccagttccacgtcgtcaaaggtgatttcacagcagctatccatacgcagaccgagcttttcaagtttggtcactttgatgcccggtttgctcatatcaacaaaccattcggtgtagacaggtttgtccggagaagccccgtcgcgcgccatcaccacgatgtacggggtgtaggcgctgctggtaataaaacacttactaccattaagataaatcttaccatttctacgggtataagtcgttttcaggctacccacgtcggagcctgcgcccggttcggtaattgctgagttccacatctgcttaccggtgccgcggaaagccataatcttgtcgatctgctcttgcgtaccttcacgcaggaaggtgttaaacccgcccggtaactgatacagcacgtaagttggcgctcccagacgacccagttccatccacacggcggcgagagtaacaaaccccgcgtccagaccaccgtgctcttcagggatcagcagactgtcgatacccatatccgccagggctttgacaaaacgttccgggtagacgctgtcacggtcgcactcggcaaaataggcctcccagttttcgctggccatcagttcgcggataccggcgacaaacagttcctgctcatcatttaaattaaaatccatctttcaacctcttgatattttgggggttaattaatctttccagttctgtttcgcgtctttaataaaggagagcgtcaccatgatgttgacgaagaacagcgggcatcctccggcgataatggcggtttgaatcggtttcaggccgccgagcgccagcagaacaataccgataatgccaaccagaattgaccagccgatacgcaccagcagcgggggttcttcaccatcgcgtacttcgcggcaagtggacatcgccagggtataagagcaggcgttaaccagcgtaacggtggcaataaagcagaggatgaagaagccccacatggtggcggtgctgagtggcagagcggcccaggtttcgatgatggcgcgcgccacaccgtactgttcgatcagatttggaatgttgatgatgtttttatctatcaacagcagagtgttactaccgagtacagtccacaggatccaggttgacgctgtcagccccagcaccatgccgaagcacagttcacgcacggtacgaccacgggagatgcgggcgaggaagatgctcatctggatagcgtaaatcacccaccatgcccagtagaacacggtccagccctgcgggaagccgcctttagcgatgggatcggtatagaacaacatgcgcggcagatacatcagtaacatccccaccgaatcggtgaagtagttcatgatgaagctggcaccgctgacgatgaacacccaacccagcatcaggaagctcaggtaactacgcacgtcactggcgatacgtacccctttttgcagaccgcaagcgacgcaaatggcgttgaggataatccagcaggtaatgatgatagcgtccagttgcagggtatgcggaatgccaaacaaccattgcatacactcggtcaccagcggcgtggcaaggcccagactggtacccatcgcgaagatcaaggcgacgagatagaagttgtcgacgatagtgccgaacaaccctttggcgtgtttttcacctaccagcggcaccagggtggagctggggcgaatcacttccattttgcggacaaagaagaagtaagcgaaggcgactgaaaggaagctgtaagtggcccacggcagaggtccccagtggaacaagctgtaagccagccccaactctttcgcgcctgttgagttcggttctaagccaaacggcggggtggagatgtagtagtagatctcaatcgatccccagaacagtacggcagcagacgtacaggaggcgaacatcataaagatccaactggcggtactaaattctggtggttcgttacctaaacgctttttggcatacgggccaaacaccagccagaaccagccgaaaagcatcaccaccatataccattcaaatgcccatccccatacattggtgacgtaactgaatacagcattaataacgacattcgccgcatccagatctctgactgtaagccaacaaagtatgccgacgattattaacggcggaaagaaaaccttcggttctattcccgtttttctcttttcattcttcatgagttaattccactgtgaaaacgaacatttattttgcgttcccgtttgttttatttttgttaacatttaatataattattattaacctcgtggacgcgttaatggctaactcataatgggtattcaataagctgcattctgtgattgttatcacatttttgtttcgggtgaatagagggcattttttcgttaattttgattattaatcagtttgttatgttctgttgtgagtaaaaaaatagcatctgactttcaatattggtgatccataaaacaatattgaaaatttctttttgctacgccatgttttcaatattggtgaggagcttaacaatattgaaagttggatttatctgcgtgtgacattttcaatattggtgattaaagttttatttccaaattaaagggcgtgatatctgtaattaacaccaccgatatgaacgacgtttccttcatgatttctggagatgcaatgaagattattacttgctataagtgcgtgcctgatgaacaggatattgcggtcaataatgctgatggttcgttagacttcagcaaagccgatgccaaaataagccaatacgatctcaacgctattgaagcggcttgccagctaaagcaacaggcagcagaggcgcaggtgacggccttaagtgtgggcggtaaagccctgaccaacgccaaagggcgtaaagatgtgctatcgcgcggtccggatgaactgattgtggtgattgatgaccagttcgagcaggcactgccgcaacaaacggcgagcgtactggctgcagccgctcagaaagcaggctttgatttgatcctctgtggcgatggttcttccgacctttatgcccagcaggttggtttgctggtaggcgaaatccttaatattccggcagttaacggcgtcagcaaaattatctccctgactgcagataccctcaccgttgagcgcgaactggaagatgaaacagaaaccttaagcattccgctgcctgcggttgttgctgtttccactgatatcaactccccacaaattccttcgatgaaagccattctcggcgcggcgaaaaagccagtccaggtatggtcggcggcggatatcggttttaacgcagaggcagcctggtcagaacaacaggttgccgcgccgaaacagcgcgagcgtcagcgcatcgtgattgaaggcgacggcgaagaacagatcgccgcatttgctgaaaatcttcgcaaagtcatttaattacaggggatgctatgaacacgttttctcaagtctgggtattcagcgataccccttctcgtctgccggaactgatgaacggtgcgcaggctttagctaatcaaatcaacacgttcgtcctcaatgatgccgacggcacacaggcaatccagctcggcgctaatcatgtctggaaattaagcggcaaaccggacgagcggatgatcgaagattacgccggtgtcatggctgacactattcgccagcacggcgcagacggtctggtgctgttgccaaacacccgtcgcggcaaattactggcggcgaaactgggttaccgccttaacgcggcggtgtctaacgatgccagcgctgttagcgtgcaggacggtaaagcgacagtgaaacacatggtttacggcggtctggcgattggcgaagaacgcattgccacgccgtatgcggtactgaccatcagcagcggcacgttcgatgcggctcagccagacgcgtcacgcactggcgaaacgcacaccgtggagtggcaggctccggctgtggcgattacccgcacggcaacccaggcgcgtcagagcaacagcgtcgatctcgacaaagcccgcctggtggtcagcgttggtcgcggtattggcagcaaagagaacattgcgctggcagaacagctttgcaaggcgataggtgcggagttggcctgttctcgtccggtggcggaaaacgaaaaatggatggagcacgaacgctatgtcggtatctccaacctgatgctgaaacctgaactgtacctggcggtggggatctccgggcagatccagcacatggttggcgctaatgcgtcgcaaaccattttcgccatcaacaaagataaaaatgcgccgatcttccagtacgcggattacggcattgttggcgacgccgtgaagatccttccggcactgaccgtagctttagcgcgttgatccactctggcagggctgcattttggccctgccgctgacagggagctcttatgtccgaagatatctttgacgccatcatcgtcggtgcagggcttgccggttcggttgccgcactggtgctcgcccgcgaaggtgcgcaagtgttagttatcgagcgaggcaattccgcaggtgccaagaacgtcaccggcgggcgtctctatgcccacagtctggaacacattattcctggtttcgcagactccgcccccgtagaacgcctgatcacccatgaaaaacttgcgtttatgacggaaaagtcagcgatgactatggactactgcaatggcgacgaaacctcgccatcccagcgttcttactccgttttacgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggggtgaattccatccttgccgaaaagctggggatggcaaaacgcgttaaaccgacggatgtggcggttggcgtgaaggaactgatcgagttaccgaagtcggttattgaagaccgttttcagttgcagggtaatcagggcgcggcttgcctgtttgcgggatcacccaccgatggcctgatgggcggtggcttcctttataccaatgaaaataccctgtcgctggggctggtttgtggtttgcatcatctgcatgacgcaaaaaaatcggtgccgcaaatgctggaagatttcaaacaacatccggccgttgcaccgctgatcgcgggcggcaagctggtggaatattccgctcacgtagtgccggaagcgggcatcaacatgctgccggagctggtcggtgacggcgtattgattgctggtgatgccgccggaatgtgtatgaacctcggttttaccattcgcggtatggatctggcgattgccgccggggaagcagcagcaaaaactgtgctttcagcgatgaaaagcgacgatttcagtaagcaaaaactcgcggaatatcgtcagcatcttgagagtggcccgctgcgcgatatgcgcatgtaccagaaactaccggcgtttcttgataacccacgcatgtttagcggctacccggaactggcggtgggcgtggcgcgtgacctgttcaccattgacggcagtgcgccggaactgatgcgcaagaaaatcctccgccacggcaagaaagtgggcttcatcaatctgatcaaggatggcatgaaaggagtgaccgttttatgacttctcccgtcaatgtggacgtcaaactgggcgtcaataaattcaatgtcgatgaagagcatccgcacattgttgtgaaggccgatgcagataaacaggccctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctgatgttggtttgatacgtaatgccgtactgactctcattgcaaaaaaacaggaataacccatgcaaccgtccagaaactttgatgatcttaaattctcctctattcaccgccgcattttgctgtggggaagcggtggtccgtttctggatggttatgtactggtaatgattggcgtggcgctggagcaactgactccggcgctgaaactggacgctgactggattggcttgctgggcgcgggaacgctcgccgggctgttcgttggcacatcgctgtttggctatatctccgataaagtcggacggcgcaaaatgttcctcattgatatcatcgccatcggcgtgatatcggtggcgacgatgtttgtctcatcccccgtcgaactgttggtgatgcgggtacttatcggcattgttatcggtgcggattatcccatcgccacctcaatgatcaccgagttctccagtacccgtcagcgggcgttttccatcagctttatcgccgcgatgtggtatgtcggcgcgacctgcgccgatttggtcggctattggctttatgatgtggaaggcggctggcgctggatgctgggtagcgcagcgattccctgtttattgattttgattggtcgattcgaactgcctgaatctccccgctggttgttacgcaaagggcgagtaaaagagtgcgaagagatgatgataaaactgtttggcgaaccggtggctttcgaggaagagcagccgcagcaaacccgttttcgcgatctgtttaatcgccgccattttccttttgttctgtttgttgccgccatctggacctgccaggtgatcccaatgttcgccatttacacctttggcccgcaaatcgttggtttgttaggattgggggttggcaaaaacgcggcgctggggaacgtggtgattagtctgttctttatgctcggctgtattccgccgatgctgtggctaaacactgccggacggcgtccattgttgattggcagctttgccatgatgacgctggcgctggcggttttggggctgatcccggatatggggatctggctggtagtgatggcctttgcggtgtatgcctttttctctggcgggccgggtaatttgcagtggctctatcctaatgaactcttcccgacggatatccgcgcctctgccgtgggcgtgattatgtccttaagccgtattggcactattgtatcgacctgggcactgccgatctttatcaataattacggtatcagtaacacgatgctaatgggggcgggtatctcgctatttggcttgttgatttccgtagcgtttgccccggagactcgagggatgtcactggcgcagaccagcaatatgacgatccgcgggcagagaatggggtaatttgttcagatttctctcttttctgaatcaatattattgactataagctgcgtgaatatatgactacactttgtgggaaaacaaaggcgtaatcacgcgggctacctatgattcttataatttatgcgcatccgtatccgcattattcccatgcgaataaacggatgcttgaacaggcaaggacgctggaaggcgtcgaaattcgctctctttatcaactctatcctgacttcaatatcgacattgccgccgaacaggaggcgctgtctcgtgccgatctgatcgtctggcagcacccaatgcagtggtacagcattccaccgcttcttaaactttggatcgataaagttttctcgcacggctgggcttacggtcacggcggcacggcgctgcacggcaaacatttgctgtgggcggtgacgaccggcggtggggaaagccattttgagattggtgcgcatccgggctttgatgtgctgtcgcagccgctacaggcgacggcaatctactgcgggctgaactggctgccaccgtttgccatgcactgcacctttatttgtgacgacgaaaccctcgaagggcaggcgcggcactataagcaacgtctgctggaatggcaggaggcacatcatggatagccatacgcttattcaggcgctgatttatctcggttcggcggcgctgattgtacccattgcggtacgcctcggtctgggatcggtacttggctatctgatcgccggctgcatcattggcccgtgggggctgcgactggtgaccgatgccgaatctattctgcactttgcagagattggcgtggtgctgatgctgtttattatcggcctcgaactcgatccacaaaggctgtggaagctgcgtgcggcagtgttcggcggtggcgcattgcagatggtgatttgcggcggcctgctggggctgttttgtatgttacttgggctgcgctggcaggtcgcagaattgatcggcatgacgctggcgctctcatcaacggcgattgccatgcaggcgatgaatgaacgcaatctgatggtgacgcaaatgggccgcagtgcctttgcggtgctgctgttccaggatatcgcggcgatcccactggtggcgatgatcccgctactggcagcgagcagtgcttcgacgacgatgggcgcatttgttctctcggcgttaaaagtggcgggcgcgctggcgctggtggtattgctggggcgctatgtcacgcgtccggcactgcgttttgttgcccgctctggcttgcgggaagtgtttagtgccgtggcgttattcctcgtgtttggctttggtttgctgctggaagaggtcggcttgtcgatggcgatgggcgcgtttctggcgggcgtactgctggcaagctcggaataccgtcatgcgctggaaagcgatatcgaaccatttaaaggtttgctgctggggctgtttttcatcggcgttggcatgtcgatagactttggcacgctgattgaaaacccattgcgcattgtcattttgctgctcggtttcctcatcatcaaaatcgccatgctgtggctgattgcccgaccgttgcaggtgccaaataaacagcgtcgctggtttgcggtgctgttaggacagggcagtgagtttgcctttgtagtatttggtgcggcgcagatggcgaatgtgctggagccagagtgggcgaaatcgctgactctggcggtggcactgtcgatggcggcaacgccgattctgctggtaatcctcaatcgccttgagcaatcttctactgaagaggcgcgtgaagccgatgagatcgacgaagaacagccgcgggtaatcattgccggattcggtcgttttgggcagataaccggacgtttactgctctccagcggggtgaaaatggtggtgctcgatcacgacccggaccatatcgaaacgctgcgtaaattcggtatgaaagtgttttatggcgatgccacgcggatggatttactggaatctgccggagcggcgaaagcggaagtgctgattaacgccatcgacgatccgcaaaccaacctgcaactgacggagatggtgaaagaacatttcccacatttgcagattattgcccgcgcccgcgatgtcgaccactacattcgtttgcgtcaggcaggcgttgaaaagccggagcgtgaaaccttcgaaggtgcgctgaaaaccgggcgtctggcactggaaagtttaggtctggggccgtatgaagcgcgagaacgcgccgatgtgttccgccgctttaatattcagatggtggaagagatggcaatggttgagaacgacaccaaagcccgtgcggcggtctataaacgcaccagcgcgatgttaagtgagatcattaccgaagaccgtgaacatctgtcattaattcaacgacatggctggcagggaaccgaagaagggaaacatactggcaatatggcggatgaaccggaaacgaagccctcatcttaataaagagtgacgtaaatcacgctttacagctaactgtttgtttttgtttcattgtaatgcggcgagtccagggagagagcgtggactcgccagcagaatataaaattttcctcaacatcatcctcgcaccagtcgacgacggtttacgctttacgtatagtggcgacaattttttttatcgggaaatctcaatgatcagtctgattgcggcgttagcggtagatcgcgttatcggcatggaaaacgccatgccgtggaacctgcctgccgatctcgcctggtttaaacgcaacactttaaataaacccgtgattatgggccgccatacctgggaatccatcggtcgtccgttgccaggacgcaaaaatattatcctcagcagtcaaccgggtacggacgatcgcgtaacgtgggtgaagtcggtggatgaagccattgcggcgtgtggtgacgtaccagaaatcatggtgattggcggcggtcgcgtttatgagcagttcctgccgaaagcgcaaaaactgtatctgacgcatatcgacgcggaagtggaaggcgacacccatttcccggattacgagccggatgactgggaatcggtattcagtgaattccacgacgccgatgcgcagaactctcatagctattgctttgagattctggagcggcggtaattttgtatattagaattccggcatcactgatacgtgcagatatccgtgtataccagacgtataaattgtacaggagcacgagatcatgactgcaaaacgtaccacacaaagtgtgaccgtcaccgtcgaccgtgagttagtcaatcgcgctcgtgatgcaggcttaaatatgagcgccacccttacggttgcgctcaatgctgaacttaaaaaacatgcagcaacacgttggcgtgaagagaacgcagaagctatcgctgcgttaaatcaattggctgatgaaaccggatgtttctctgatgagtaccggagcttctagcgatgcaatttacggtataccgcagtcgcggcaggaacgccgcgtttccctttgttattgatgttaccagcgacattgttggtgagattaatcgccgtatcgttattccattaacacctatttgaacgatttagccgtattcgcccaccagaacggcttaacccaatccttttaccggtagacggcaaagaatatgtgctcatgacgcatgagactgcaactgttccagttaacgcgctgggaacgaaattttgcgatgccagcgcgcaccgaacgttgattaaaggagcattagattttatgctcgacgggatttaagacgctaccgcctctccctcactcaaatccttatgccggttcgacggctggacaaaatactgtttatcttcccagcgcaggcaggttaatgtaccaccccagcagcagccggtatccagcgcgtaaataccttccggcgtacctttgccttccagcgatgcccagtgaccaaaggcgatgttgtactcttcagcgacggggccaggaatcgcaaaccacggtttcagtggggcaggggcctcttccggcgattctttgctgtacatatccagttgaccgttcgggaagcaaaaacgcatacgggtaaaggcgttggtgataaaacgcagtcttcccagcccccgcaattccggcgaccagttatttggcatatcgccgtacatggcatcaaggaagaagggataggagtcactcgacagcaccgcttctacatcgcgcgcgcactctttggctgtctgcagatcccactgcggcgtgatcccggcgtgggccatcactaactttttctctttgtcgatttgcagcaaaggctggcgacgcagccagttaagcagctcgtcggcatccggcgcttccagcagcggtgtcaggcgatctttcggtttattgcggctgatcccggcaaataccgccagcagatgcagatcgtgattacccagcaccagacgtacgctgtcgcctaaggatttcacatagcgcagaacatccagcgaacccgggccgcgcgcgaccagatcgcccgtcagccagagggtatctttcccaggggtaaattctactttatgcagcaatgcgatcagttcatcgtaacaaccatgaacgtcgccaataaggtatgtcgccatattcttttaatgaatgagtgtgggaacggcgagtcggaatacgggaatgtcgatgctgaaagggacgccattttcatcgatcatttcgtagtgaccctgcatggtgcccagcggggtttcaatgattgcaccgctggtgtactggtactcttcgccaggcgcgataagtggctggacgccaaccactccttcgccctggacttcggtttcacggccattgccattggtgatcagccagtaacgccccaacaactgcactggcgctcgccccagattgcgtatggttacggtataagcaaaaacgtaacgttcattatcaggtgaagattgggcctcaatgtagacgctttgaacctgaatacacactcggggcgaattgatcatcgttaactctcctgcaaaggcgcgttctccgccagatagttcgccatctggcaatattgcgcgacagagatattttccgctcgcatcgccgggtcgatccccattcccgttaacacctcgacgctaaacaggttgccgaggctgttacgaatggttttacgacgctggttaaaggcttcagtggtgatgcggctcaacacgcgaacatctttaaccgggtgaggcatcgttgcatgaggaaccaggcgcacgacggcggaatccactttgggtggtggtgtaaaggctgacggcggtacttccagcaccgggatcacgttgcaatagtattgcgccatgacgcttaatcgaccatacgccttgctgttcggtcctgcaaccagacgattcaccacttctttttgcaacataaagtgcatgtcggcaatggcatcagtatagctaaacagatggaacatcaacggcgtggagatgttataaggcaggttgccgaaaacacgcagcggctggcccattttcgcggccagttcgccaaagttaaaggtcatcgcatcctgctgataaatcgtcagtttcgggcctaagaatggatgcgtttgcagacgtgccgccagatcgcggtcaagttcgatgaccgtcagctggtccagacgttcgccgaccggttcggtcaatgccgccagaccggggccgatttcgaccatcgcctggcccttctgcgggttaatggcagaaacaatgctgtcgatcacgaactgatcgttgagaaagttttgcccgaagcgtttacgggctaagtggccctggtggactcgattattcattgggtgttaacaatcattttgatggcgagattaagcgccgtaataaaactgccgacatcggctttaccacgtcccgccagttcaagcgcggtgccgtggtccactgatgtgcgaataaagggcaggcccagcgtaatgttcacaccgcgcccgaagccctggtattttagcacgggaagaccctgatcgtggtacatcgccagcacggcgtcggcgttatcgagatatttcggctgaaacagggtatcggcaggcagcggcccgttgagtttcatcccctgttcccgcagctcgttgagtaccggaataatagtgtctatctcttccgtacccatatgaccgccttcgcccgcgtgcggattcagcccgcagaccagaatgcgcggttcggcaataccaaatttggtccgcaaatcgtgatgcaaaatagcaatcacttcgtgcaaaagggcaggggtgatagcatctgcaatatcgcgcagcggtaaatgcgtcgttgccagcgccacgcgaagttcttcggtcgccagcatcatcaccacttttttcgcctgcgaacgctcttcgaaaaactcggtatgcccggtaaacggaatgcctgcgtcgttaatgacgcctttatgcacggggcctgtgatcagcgcagcaaattcaccgttcagacagccatcacacgctcgcgccagcgtttccaccacatagtgcccattttcaactgctaactgccccacagtgacagattcacgtagcgcgacaggaagtagcgttaatgtgcccgcagtttgcggttgtgcaggggagttgggggaataagggcggagggtgagcggcaaaccgagcatcgctgcccggtcggtaaggagagtggcatcggcacaaacaaccagttcgactggccactcacgctgtgcaagctggacaattaagtccgggccaatcccggcgggctcgccgggagtgatcacaacacgttgggttttaaccattagttgctcaggattttaacgtaggcgctggcacgttgttcctgcatccagcttgctgcttcttccgagaacttacggttcatcagcatgcggtatgcacgatctttctgtgccgcgtcggttttatcgacattacgggtatccagcagttcgattaaatgccagccgaatgaagagtgaaccggtgcactcatttgacctttgttcaggcgggtcagggcgtcacggaaggccggatcgaaaatatctggtgtagcccagccgagatcaccgccctggttagcagagcctggatcctgagagaactctttcgctgcggcagcaaaagtcgttttaccactcttgatatcggcagcaatctgttccagtttcacgcgggcctgttcgtcagtcatgatcggcgacggtttcagcagaatatggcgagcatggacttcggtcaccgagatatttttgctttcgccgcgcaggtcgttaactttcagaatatggaagccaacgccggaacgaatcgggccaacaatgtcgcctttcttcgcggtgcttaatgcctgggcgaagatccccggcaactcctgaatacggccccagcccatctggccgccgttcagcgcctgctggtcggcagaatgagcaatcgccagcttaccgaaatcagcgccgttacgcgcctgatcgacaatggcgcgtgcctggctttccgcttcgttcacctgatcagaggtcgggttttccggcagcgggatcaggatgtggctcaggttcagctcagtgctggcgtcgttttggttacccacttgctgcgccagggattcgacttcctgcggcaggatggtgatgcgacgacgcacctcgttgttacgcacttcagagataatcatctctttgcggatctggttacgataggtgttgtagttcagaccatcgtaagccagacggctgcgcatctgatccagcgtcatgttgttctgtttcgcgatgttagcaatcgcctgatccagctgctcatcggagattttcactcccattttctgccccatctgcaggatgatttgatccatgatcaaacgttccatgatttggtggcgcagcgtcgcgtcatcaggaagttgctgccttgcctgagcagcgttcagttttaccgactgcattaatccatcaacgtcgctttccagcacgacgccgttattgacgacggctgcgactttatcgactacctggggggcagcgaaactggtattcgcgatcatggcgataccgagaagcagcgttttccagttcttcatactttttccatttcaattaaccgcactgcggattacgtggtaaatcaacaaatcacaaagtgttttgatacggcagaatgttcgaacgcagcatctcttgcgtacccagaccgtagttggagctcaggccgcgaagttcgatgttaaagccgattgcgttgtcatataccgcatgttgtttatcgttatcccaaccgttcagcttccgctcgtaaccgacgcgaatcgcatagcagcaggagctgtattgcacacctaacatagagtcggcttgcttgttcgcattggtgtcgtagtagtaggccccaacaatggaccaacgatcggcaattggccagctggcgacggcacctacctgcgaaataccattcttatattgctcagcagtggaatagtacttaggcagcgttgcctgaatatattccgggctggcgtaacggtaattcagctgtaccagacggtcttcatcccgacggtattcaatgctggagttactggtcgctacgttatccagacgtgtatcgtactgaatcccgccacgcaatccccaacgatcagagatgcgccagtaagtatcgcctgcccataccagtgagcccgttttgtcgtcattctcccatgttatgttgtcatcgccagtgcgagactccgtgaaatagtagatttgaccaacggaaatattaaaacgttcaacggcagcatcatcatatatgcgagatgtgacaccggtcgtcacctggttagcggaggcaatacggtcaagaccgccgtaagtccggtcccggaacaggccggagtagtcagattgcagcagcgacgagtcgtagttatagattttgctctgatcgcgatatggcacatacagatactgcgcgcgtggttccagtgtctgggtatagcccggcgccagcatttccatatcacgctcgaagaccattctaccgtctaccttgaactgcggcattacacggttagcggactctgccagcttggtcgtgtttctggagttataccagtcaagattggtttgctgataatgggttgccagcaacttcgcttcagtattgatgctgccccagttattagagagcggcagattgatggtcggttccaggtgaacacgagtcgcctctggcatgtcatctctggtgttaacaaagtgcaccg

SEQ ID NO: 10033 - DNA, 32017 bp, Escherichia coli
tcactgatcaagcaaatctgcacgcgcagcgctcaaatattgcaacattgaccacagagtcagtaccgcagccacaaagaaaagtgcaataccggcgtactcaacccaaatgttcggacgccacagcagccaggctaacgccaccatctgggcagtggttttcactttcccaatccaggagacagccacgctactgcgtttacccaactccgccatccattcgcgtagcgcagaaataataatttcacgggcgatcatcgttgctgccggtaaggtcacccaccagctgtggtaatgctcggttaccagcaccatggcgatagccacgagaactttatctgcgacagggtcaaggaaagcaccaaaccgggtactctgattccagcggcgtgccagaaaaccatcgaaccagtcagtcaccgccgcgacgcagaaaatgagcgcggcggcaaacggcgaccaggtgacaggcagataaaagaccaatacaaagaatgggataaggatgacacggaacagtgtaagcaacgtagggatattaaattgcataatgacgggtaactatctgttgtcagtaagattacccctatgttgctacagagacatcaatgtttcaacgaccagaagatcttttctgccagaccttgcgaaatacccggcacttttgcaatttcctcaacgctggcgttacgtaaaccttgcaaaccacccatatatttcaacaacatttgccgacgttttggcccgatgccttcaatggtttccagggaactggtatttttgaccttcgcccgttttttacggtgcccgccaatcgcgtgatcgtgtgattcatcgcgaatatgctggataacatgcagcgcgggagaatctggcggcaaactaaatccctcaccttccggctcaaagaacagcgtttccagcccagccttacgatctgctcctttggcaacgccaagtagcagcggatgatttttatcccatgagacatccagttcggcgaagacatttttcgcctgcgcaagctggcctttgccgccgtctataaggatcacatccgggatcttactgtcgtcaatggctttaccataacgccgacgcagcacctgattcatcgccgcataatcatcgcccggtgtgatgccagtaatgttatagcgccgatactccgcacgcagcgggccgttagcatcaaacaccacacaggaagcgacggtttgttcacccatggtatggctgatgtcaaagcactccatccgcttcacttccggcaatttcaacacgctggcaagcgcggtcagccgctggtgaacggtagattgctgcgaaagtttgctggttaaggccgtcgccgcattggtacgcgcgagtttcagataacgcgctctatcgccacgaggtttggtttgaacattaatcttgcgtcccgccagttctgaaagggaatcggcgagcagcgttttatcgctaagattaaaatcgagcaggatctcacccggtaaggtgcgcatctggctgccttgtaaatagaactgacctacgaaggtttccaccacctcgctcagttccgtaccgccaggcactttcgggaaatagctgcggctgccgagcactttgccctgacgaatgaacaatacgtggacacaagccatacccgcatcgaacgccactccaataacgtcaaggtcgtcgccggtattggaaacaaactgtttttcggtgacacgtcgcaccgcctgaatttggtcgcgaatccgcgccgcttcttcaaactccagattctggctggcagtttccatacgactaatgagttgcgtaagcacctgatcatctttgccagacaaaaacaggcgcacatactcgacctgctgagcgtattcttcttcactcaccagtccttcaacgcacggccccagacagcgccctatctgatattgcagacacggacgcgagcggttgcgataaacactgttttcgcactggcgaatggggaaaatcttttgcagtagcgccagtgtttcacgtacggcatagccattcgggaacgggccgaaatattcacctttggcatgcttcgctccacgatgcatcgccagacgcgggtgggtatcgccactcaggaagataaaaggatatgatttatcatcgcgtagcaaaacgttgtaacgcggctgataaagtttgatgtagttgtgttccagtaacagcgcttcggtttctgtatgagtaaccgttacatcaatttgctggatctgggcgaccagcgcttcggttttgcgcgaagcgaggttgctacggaaatagctggaaagccgttttttcaggtctttcgctttgccgacatagataaccgtaccaccagcatcgtacatgcgataaacgcctggctggctggttacggtttttaaaaacgcttttgcgtcaaactgatcactcactgacttgataatgtctccgcattacacagaccatggcgaattgccaggtgagtcagctcaacatcgccatgaatgtttagtttactgaacatacgatagcggtagctgttcaccgttttcggactgagattgagctgttctgagatctcattgaccttctggcccttggtgatcatcagcataatctgcaattcacgttcagacaaactggcaaatgggctttctgttttttctggttcgatctggcttaacgccatttgttgagcgatatcagaagcaatgtaacgctgccctgaatagacagaacgaatcgcactcacgacttcctgcggagccgcgcctttgctgaggtagcccgcagctccggcctgcatgactttcgctggtaaagggttttctgtatggacggtaagcatgatgattttgacatcagctgtggaacgcgcgattttacgcgtcgcctcaagaccgccaatgcccggcatactcatgtccattagcaccacgtcaacggcatttgcccggcaccatttaacggcgtcttcaccgcacgatgcctcaccgacgacttttataccctttatatcttccagaatgcgtcgtatccctgcgcgcaccagttcgtggtcatcaacaagtagaacgttgatcaaaggaatatctccagaaatagggataacgctactgatagttagtcattcgtatattagcggtttttattgcaactttgaaacgttaaaaatggtgggtattcgatttttctctcgtttttgtcaattcgattgtccacagttatggtcacgcccgtcaccaacggcttccgggatcgtttcacagtaagcccggcgatgaaatgtgacaaaaattgactttattcagcaaaaatgaaaatcagcccgctgaatatgtaacattaattaacccgaacaatacgggcaaaaaacattcatgataaaaatatttattggtcattatattaacgtattttatagtactgttgatatcacgctcaaaaaacaaccactgctatttttagcaaagcttatggtatactccgccgccttaacatttttcaccgcaaattttcattgcaacatgacgaggaaaataaatgagtacgcctgatttttctactgccgagaataatcaagaactggcaaatgaagtctcctgcctgaaagcgatgctgacgctgatgctgcaggcgatgggacaagctgacgcgggccgcgtgatgttaaagatggaaaaacagcttgcgctgatcgaagacgaaacccaggctgcagtattttccaaaacggttaagcaaattaaacaagcctaccgtcagtaatataaaaccggctgagagcgtgcctttcagccggtttttgcatctggcacgcagaacagaaaagagatcaaattaagccagtagcggccgcgtaacaggcaacctgcgtcttattcggtgcattgatttttttctgcatgtttttctgatggaaattgaccgtattctcagagattgacaaaatcatcgctatctctgctgatgtcttaccttccgccgtccatttcagaatttctttttcgcgcttgctgaaattcatctctggcgtcatcactatttcatcatttaaacgcatcagagccatcagactttcgcgcaccagtagctgcatttttaattgcagttcatcactaagaatgggtatttcgcgcgtgctgcaacgggaaaaggacaaaaagcccaacgcccgatttggcagcattaaatactgagtgacaccgcggcgtaaaccatgtgcgcgcgcagcttcccataacggctgtgcttcgctgaataagtcatcattccacattaaatggccctgactaaagttttcagggttcagcaccggatcaattgcgagaaaattttttgcctgataataactaacccacgactcagggtaattggtatagaaagccactttaggtcgcgtgaatggtaccgggtggcgaacacataacgaatagtaatcgtactccagctgctgagcctgaagctctatttcatggtagacctcttctgcggcctccatcctctgaaaacgcaacaacatcgtgcgaagccagctgaaaaaatccgtatcctgcatagtaaaccgcaacgcccctgagagtgagtatcatttataatgataattcaaactatcacataaataagatttatatataatttatattattcaggcaatgaattacttttgcaagccatcgcattctcttatgttattaatgagttatgctgatttgttaagcagttttatcacgtttgaaatggcgtcccgccccgactggtgaatcgtcggggctgattttttcttattattgcagcagaaacttctccatgaactggcgggtgcgaggctgctgaggatcagcaaataacgcttttgctaccccctgctcgactatccgcccctggtccataaaaatcgcccggtccgcaacatcccgggcaaagctcatttcgtgcgtcacaatcaccatcgtgcgcttttcctgcgccagctgacgaatggtgttcaggacttcgcccaccagctctggatccagcgccgacgttggctcatcaaacaaaatcacttcaggacgcattgccagagcacgcgcaatcgcaacgcgctgctgttgaccgccagacaaacgacgtggataactggtttctttaccggccagcccaactttcgccagcagctcgcgagcgcgcgccgtggcctcttctttcggttcgcctttgacgatcaccggcccttcaataatgttttccagcaccgtacgatgcggaaacagattaaagttctggaagacaaacccgacgtgctgacgcaactggcgaatcagcgatttttgctgacttaatgaacgtgcagtatcaatagtgatatcgccaacggtgatggttcccgcttccggttgttccagcagatttatgctgcgtagcaacgtggttttgccggaaccactcggaccgataatagccactacttcgccaggcttcacctcaaggtcgataccatgcagcaccgtctgaccgtggaattttttcaccaggttcttaacttcaatggcactcatttgggttccctctcctggcgattaagttgattctcaaaatggttctgcaacgtcgataacacagtcgccataatccagtagatgagcgaagccgccaggtacatggtgaacacctccagcgtgcgcgaggtaatcaactgcgcctgacggaacagctccggcacctggattgtcgcggccagcgacgtatcttttaccaggctgataaagctgttcgacagcggcggcaacgccacccgcgccgcctgtggcaaaatcgcgcgacgcatggtctgccatggcgtcataccaatactggctgcagcttcccactgacctttatcaatagaagaaatggcggcgcgcagcgtttcggcagcataggcggcagtgttcagcgacagaccaatcattgctgacggaatgggatctagttcgatgccaaactgcggcaagccgtaatagatcataaacagttgggcgatgagcggcgtaccacgaaaaatagagatataaaaacgcgccagccagcgcacgggccagattggcgaaaggcgcatcagcgcgagaataaaccctagcagtaagccaaaaaacatgccgccgatactgagttgcagcgtatacccagcccctttcagcaggaacggcaaggaatcaataaccagttgtatactttcttgcatgagcgtttccggagctaaacgtggggatgataggcgaacagcgcaggcgcaccgccggtatgaataaacagaatcggcccttcatctttgaagcgtttctgactgataccgtcaatcagccccgccatcgcttttccggtatacacaggatcaagcagaatgccttccagccgcgccagcaatttcactgcttccatgccttcgtcgttcggcacgccgtagccaggtgcaaaatagtcatcccagagtaaaatttccgctgatgcggtcagctccagttctttcgcaatcgcctgttggaggttaaccactttcggcaattgatcggcaacagaacgcgacacagtcacgccaatcagttcgctttcaggcatcaggtgttccagcccaacagccagtccggcgtgagttccggcactgcccgatgcgaccaccaccgacgaaatattaactgccccttcacactgttgcgcgatttccagcgcactctccacataacccagcgcgcccaaagcattagaaccgccaaccggaatgacatacgggcgaaagccttgtgcttcgactcgcgtcgccagctcttccagttgggtattgggatcggtcagtgcgtcgcacatttcaatctgggtattgaacagatccagcaacaaacgattgccgttggttaaatagttttccgcggttgtaccaataggattttccagcagcgccacgcaatgcagaccgagtttcgcagcgactgcggcagtctggcgcacatggttagactggatcgccccggcagtaatcagcgtatcggcaccttcacgcagagcatctgccgcgagaaattccagcttacgtaatttattgccgcccattgccatgggagtgacgtcatcccgtttgatgaaaatttcccgtccaagataatcagaaaagcgcggcagatattcgagcggcgttggcgcgccgataaactccagccgtggaaaacgggttaaattatgcagtggcataacagcctccgatgtgtgttgttgtgattttcttattatgcacgctgaaaacgcgtaaataaaaaaggcgctagtgaaagcgcccttttttgtcattatgctgattatttggtcacatcagcaccaaaccatttttcggaaagggcttgcaaagtgccatctttttgcatttccgcaattgcatcattcaccgctttcagcaggtcttcatttcctttacgcagcgccacgccagactcctgacgggagaatgcttcaccggttactgccagcgtatcgttggttttcttcaccagatccagcgccgccagacgatcaacgaggatcgcatcgatacggcctacgcgcagatcctgatatttggtcgggtcatcatcataggtacgcacatccacgccctgaacattctgacgcagccactcttcatagttggtgcccagaccgacacccacttttttgcctttcagatcatcagccgttttaatggtgccttcgttaccttttttcaccagcgcctgaataccggaaatggtgtacggggtagagaaatcgtattttttcttgcgctcgtcagaaatggtgacctggttaatcaccacatcaatgcgtttagagtccagcgacgccagcataccgtcccatttagtcggttttagtgacgcctcaacgccaagatgttttgccagctgttgggcaaattccacttcaaaaccggttaatttgccgtcatccccctgaaaactgaacggcggataagttccttccagccctaccagcagcgtgccgcgctctttgactttattaagcagaccttcatctgcaaaacttttaacgctcatacccgcaaccagcgccacggccatcacacccatcaatgcctgacgtcccagatgtgctaatttcatatttaccccgaatgttgttatgtctgtttgcagtgtagagccattgtttgtaaacacaaaaacaactccgctacatcttattcttatttaatatatatcagaagcaggttggctggaggatttctgcacaagtccggtacacgtttgacgctgatagtgttgatacttccgtaacgcgatgcggtaattgttggtgctggtggagggcagccacggggcgaggatttcatcaaggaaaccgtcctgcagctggtcgagggaaatattttgctcgtgtagatgattccccaaacggcgcagacgaacgacatattcacgcaccgtaccagggctcatttcagtttgctcaaaaagaaatttcttaaagccgataatatcgaaaaaatcactctgcgttttgcaatgtaaatcaccgcaaaatcggcacaatgccgcccatgattgttgttccacttgccagccattttcatcaagcagcgtgtccaggcgggaaatctcgattttattcactattttgccgtcgcgaactaaggtaatgcgatcgagtaatttacggcaatgcgcgcaatgggtctggctgtgtttaaagtctttaagatagcggcttaatggccgtcttttcaggtgctgcaccatcattaagaactcctggtagtcaaaattaaagtgcggcatttactgacgttataacttacccagtttagtgcgtaaccgtttaatagcctggctgtgtaactgactgacccgcgattccccgacctccagcaccgcgccaatctctttgagattcagctcttcctgataatagagggttaataccagtttttcgcgctccggcaacgtttcgatggtttccatcacccgctggcgcagattactgtccagcagttgttgtagcgggttttctcgctgatgatcatcagtaaccagttcgatgctatcgccgtgctcttcgcgccactcatcgtaggagaagagctggctgttattggtgtcgagcaacatttggcgataatcggcaatatcgatccctaaacgttccgctacctcagtttccgtggcgttgcggccaagttcctgctccagttgccctattgcctgtgccacttcacgcgcgttgcgtcgcacgctgcgcggcacccagtcacggctgcgaagttcatccagcatagcgccacgtatacgctgcactgcgtaagttgtaaatgccgttccttgtagggcgtcatagcgttcgacggcattaagtaacccaatgccgcccgcctgtagcagatcgtcaagttccacgctcgcgggcagtcgaacctgcaggcgcaatgcttcgtgacgcaccagcgggacataacgctgccacagcgagtgtttatccattacaccttcagcggtatagagtgaattcacgataaacagccctgcgttatatgagttatcggcatgattatccgtttctgcagggtttttaatcgggcgattagtgggtgaaatgaggggttatttgggggttaccggtaaattgcgggcagaaaaaaaccccgccgttggcggggaagcacattgctgacaaattacgcttcatgttgccggatgcggcgtaacgccttatccggcctacaaaaatctgcaaattaaataaattgcaattcaccttgtaggcctgataagcacagcgcaccaggcaatttggcgttgccgtcagtctcagttaatcaggttacggcgattaaccctgcagcagagacagaacctgctgcggtacctggttggcttttgccagcacggagttaccggcctgctggataatctgcgctttcgacatgttggacacttcggtcgcatagtcggcgtcctgaatacgggactgcgcttcagacaggttggtagtggtgttgttcaggttggtgactgcggaatccagacggttctggatagcacccagggaagaacggaatttgtcgatggagctgatagcgtcgtccagggcagcaagcgggttggtcgttgcagaaccagcactggtagtctcagtagtgattttacccgcggagttcacatttacagcagtaccaattgctggagcataatctttattggtatcagtcgctgaagcatacccggcaacagtcacagagccgttatccttgttaacgctgtaagagactgtatagtcggcaacgttagtaataccacctttatcatccacataagacttcgcagcatcactggattcacccgcggtaaacccaatagttttgctcagtacaccggaattaaaggtaattgaagatgtcgcggcagccgctttggtttcgctcaatactacatctttactcactgtagcctgataagtaatcccaccagggattaacggagctactggagaggttgtcgcaggagttgcttttgcgatagtatattcagtgccattgaatgtcagagaagcaccgtcactaccttcgctcgcggctttaagcagcgctttcatatcagctttagctgcgctaccagcgttgttagtcgtcaagttgcctgcatcgtctacgtatgcctggcttccaccgatggtgatattacctgctgaatccgtttcgaaagaaacagtaccatcttttgtggtgtaagaaccattaacagatttacccacatcagcatgaagggtggcagctaacgcatcacgttttttagctgaatcagtagcctgcgccgcggcgtctacacccgtaccagcagtagatttggtggtagtaaaatcaccagatttagcgttgtaagtataatctacgccgccaacggtgactttatcgccattccctaatttatcgaatgcagcatcggtagttaacaaggtattttcggttttcagatcataaagacctgtcgtggtgtttaacttcgcgccagcagaagttaaatcacttaccgttgcagctttgttggtaatagtacctttaccatttacgttaaaaccattcagacccagagtatcagaatcgattttcttcaggtcgatagtgatagtttcaccgtcattcgcaccaacctgaattttcatcgaaccgtcttttgccagtacgttcacgccgttgaactgggtctggccggatacgcggtcaatttcatcaagacgggatttgatttcgtcctgaatggagtccagatccgaatcagagttagttccggtagaagcctgaaccgtcagctcacggatacgctgtaagttgttgttgatttcagacagcgcgccttcggtggtctgtgcaacagaaataccgtcgttggcgttacgtgcagcctgagtcaggcctttaatgttagaagtaaaacggttagcaatcgcctgacccgcggcgtcatccttcgcgctgttaatacgcaagccagaagacagacgctcgatagaactcgacagcgcagactggttcttgttgatattattttgagtgatcagcgagaggctgttggtattaatgacttgtgccatgattcgttatcctatattgcaagtcgttgattacgttttgggtttccacccgtcggctcaatcgccgtcaaccctgttatcgtctgtcgtaaaacaacctttagaatttttttcacaaacagccattttttgttagtcgacgaaatactcttttctctgccccttattcccgctattaaaaaaaacaattaaacgtaaactttgcgcaattcaggccgataaccccggtattcgttttacgtgtcgaaagataaaaggaaatcgcatggcaagtatttcatcgctgggagtcgggtcaggtctggatttaagttcaatccttgatagcctcaccgccgcgcaaaaagcgacgctaacccctatttcaaatcagcaatcgtcgtttaccgctaaacttagcgcctacggtacgctgaaaagcgcgctgacaactttccagaccgccaatactgcattgtctaaagccgatcttttttccgctaccagcaccaccagcagcaccaccgcgttcagtgccaccaccgcgggtaacgccatcgccgggaaatacaccatcagcgtcacccatctggcgcaggcgcaaaccctgacaacgcgcaccaccagagacgatacgaaaacggcgatcgccaccagcgacagtaaactcaccattcaacaaggcggcgacaaagatccgattaccattgatatcagcgcggctaactcgtcgttaagcgggatccgtgatgccatcaacaacgcaaaagcgggcgtaagcgcaagcatcattaacgtgggtaacggtgaatatcgtctgtcagtcacatcaaatgacaccggccttgacaatgcgatgacgctctcggttagcggtgatgatgcgctacaaagttttatgggctatgacgccagtgccagcagcaacggcatggaggtctcggtcgccgcccagaatgcacagctgacggtcaataacgtcgccattgagaacagcagcaacaccatcagcaacgcgctggaaaacatcaccctgaacctgaacgatgtcaccacaggcaaccagacgctgaccatcactcaggacacctccaaagcgcaaacggcgattaaagactgggtgaatgcctataactcgctaatagatacctttagcagcctgaccaaatacaccgccgtagatgcgggagctgatagccagaattctagcaatggcgcactactcggcgactccacgctgcgaacgattcagacgcagttgaaatcgatgctgagtaataccgtcagttcttccaactataaaacgctggcgcagattggtatcacgaccgatcccagcgatggcaaactggaactggatgccgacaaactcaccgctgcattgaaaaaagatgccagcggcgtaggtgcattgattgttggcgatggtaaaaaaaccggcatcacgaccaccatcggcagcaacctgaccagttggctttcgacaacgggcattattaaagccgctaccgatggcgttagtaagaccctgaataagttaactaaagactacaacgccgccagcgatcgcattgatgcgcaggtcgcgcgctataaagaacaatttacccaactggacgttttaatgacctcgttaaacagcaccagcagctacttaacacagcagttcgaaaacaacagtaattccaagtaatcaatattcatcgggagacaggtcatgtacgcggcaaaaggcacccaggcctatgcacaaattggcgtcgaaagcgccgtaatgagcgccagccaacagcagttggtcaccatgctatttgatggagtgctgagcgcactggttagagcgcgactgtttatgcaggacaacaatcagcaaggcaaaggtgtctctttgtcaaaagcgatcaacatcattgagaacggactgcgggtgagtcttgatgaagagagcaaagacgaattaacccaaaacttaattgctctttatagctatatggtcaggcgtttgctgcaagccaatttacgcaacgatgtctccgcagtcgaagaggtggaagcattaatgcgtaatattgccgatgcctggaaagagtctttactctccccttctttgattcaggacccagtctgatgaacaatgcaccgcatttgtatttcgcctggcaacaactcgtcgaaaaaagccagctcatgttacgcctggcaacggaagaacaatgggacgaactcatcgccagcgaaatggcgtatgtgaatgcggtgcaggagatcgcacacctgactgaagaggttgccccgtccactacgatgcaggagcagctccgcccgatgctgcacctgattctcgacaacgaaagcaaggtaaagcagttattacagattcggatggatgaactggcgaaactggtcggtcagtcatcggtgcaaaaatcggtgttaagtgcctatggcgatcagggcggctttgtgctggctccgcaggataacctcttttgaatcttaatgagccgatggctcgcgaataatccgattacggctacgcttctaatattccccttgaatggagtcgaagaatgcgtaatcccacgctgttacaatgttttcactggtattacccggaaggcggtaagctctggcctgaactggccgagcgcgcagacggttttaatgatattggtatcaatatggtctggttgccgcccgcctataaaggcgcatcgggcgggtattcggtcggctacgactcctatgatttatttgatttaggtgagtttgatcagaaaggctgcatccctactaaatatggtgataaagcacaactgctggccgccattgacgccctgaaacgtaatgacattgcggtgctgctggacgtggtagtcaaccacaaaatgggcgcagatgaaaaagaagctattcgcgtgcagcgtgtaaatgctgatgaccgtacgcaaattgacgaagaaatcattgagtgtgaaggctggacgcgttacaccttccccgctcgtgccgggcaatactcgcagtttatctgggatttcaaatgttttagcggtatcgaccatatcgaacaccctgatgaagatggcatttttaaaattgttaacgactataccggagaaggctggaacgatcaggttgatgatgaactcggtaatttcgattatctgatgggtgagaatatcgattttcgcaatcatgccgtgacggaagagattaaatactgggcgcgctgggtgatggaacaaacgcaatgcgacggctttcgtcttgatgcggtcaaacatattccggcatggttttataaagagtggatcgaacacgtacaggaagttgcgccaaagccgctgtttattgtggctgaatactggtcgcatgaagtcgataaactgcaaacgtatattgatcaggtggaaggcaaaaccatgctgtttgatgcgccgctgcagatgaaattccatgaagcatcgcgcatgggtcgcgactacgacatgacgcagatcttcactgggacgctggtggaagccgatccttttcacgccgtaaccctcgttgccaaccacgacacccaaccgttgcaagccctcgaagcaccggtcgaaccgtggtttaaaccgctggcgtatgccttaattttgttgcgggaaaatggcgttccttcggtgttctatccggacctctacggtgcacattacgaagatgtcggtggtgacgggcaaacctatccgatagatatgccaataatcgaacagcttgatgagttaattctcgcccgtcagcgtttcgcccacggtgtacagacgttatttttcgaccatccgaactgcattgcctttagccgcagtggcaccgacgaatatcccggctgcgtggtggtcatgtcgaacggagatgatggcgaaaaaaccattcatctgggagagaattacggcaataaaacctggcgtgattttctggggaaccggcaagagagcgtagtgacagacgaaaacggcgaagcgaccttcttttgcaacggcggcagcgttagcgtgtgggttatcgaagaggtgatttaaatccatccccggcggcaagccggggagatttcattacggcagtggcgtcggtaacggcgctttatccagcgcggcggcacactctgccgtcgggcgatccacacgctccatcgtcataccatcgtactcaatggtgttaccgtcacgctcaacctcgtacagctcacgttttacggtaacgttagtgagatcatcagacatcaatgtcaacttacccggcacggcaatcacccgctgccactgacggcaatccagggtatcgccctctttagtgacaatgaggctgcctatcgcttccggactgaccagcgcacgttgcggccctttggtctgccagtaacccgtcagccagtccggcgcgggggttttcacgacattgttatagttttcgacttcggcacagcccgccagcaacatgagcgcacctgcaattgcgagttttttcatcattcgtcctgcatgagaagaaaagaggattgtggcattaaagccctgatgtcgccagcctttccaggctcagagagaaatttgatctaaccattatttttgtgaattattaccccgaaaataaatttgcatggtgtatgattcgcgactcttgtttcaaaccttctgagttcagaggctacattcatgtcatggcagcaattcaaacacgcctggttgattaaattctgggcacccatccctgcggtcatcgcggcgggtattctctccacttactattttggcatcactggcacattttgggcagtcacgggtgaatttacccgttggggcggtcagctcctgcagttgttcggcgtccatgctgaagagtggggttattttaaaattatccatctggaaggatcgccattaacccgcatcgacggaatgatgatcctcggtatgtttggcggctgttttgccgcagcgctgtgggccaacaatgtcaaactgcgcatgccgcgcagccgtatccgcattatgcaggccatcattggcggtattatcgccggttttggcgcacgtctggcaatgggctgtaacctggcggcgttctttaccggaattccacagttctcgctgcacgcctggttctttgccatcgccactgccattggttcatggtttggcgcgcgctttaccctgctgcccatcttccgtattcccgtgaaaatgcagaaagtttctgccgcctcaccgctgacgcaaaaaccggatcaggcgcggcgtcgttttcgtctcgggatgctggtctttttcggcatgctgggctgggcgctgctcacggcgatgaaccaacccaaactggggctggcaatgctgtttggcgtcggctttggtttactgattgaacgtgcgcaaatctgctttacttcggcgttccgcgatatgtggatcaccggacgtacccatatggcgaaagcaatcattatcggtatggcggtaagtgccatcgggatcttcagttacgtacagttaggcgttgaacccaaaatcatgtgggcgggaccaaacgcggtaattggtggtttactgtttggttttggcatcgtgctggcaggcggctgcgaaaccggctggatgtaccgcgcggtagaaggccaggtgcactactggtgggtcggtctgggcaacgtgatcggctcaacgattctggcgtattactgggatgatttcgctccggcgctggccaccgactgggacaaaatcaacctgctgaaaacctttggtccgatgggtggcctgctggtgacatatttgctgttgtttgcagctctaatgttgattatcggctgggaaaaacgcttcttccgccgtgcggcaccgcagattgctaaggagatcgcatgaaaaatatcgttcctgattaccgtcttgatatggtgggtgaaccctgcccttatccggctgtcgcaacccttgaggcgatgccgcagttaaaaaaaggggagatcctggaagtggtgagcgactgtccgcagtcgatcaataatattccactggatgcgcgtaatcacggctatacggtgctggatattcagcaagacgggccgaccattcgttatttaattcagaagtaatccctcattcccgctgtggcccacagcgggaacatcgttacctctctatcacatagattttacccgccccctctcctattcttttcagtgtgctctcaggaggtttctatgtgtggacgctttgcccaatcccaaacgcgtgaagattacctcgcgtttctcgcggaagatattgaacgcgatattccctacgatcccgaacctattggcagatacaacgtcgcgccgggaaccaaagtccttctgctcagtgaacgtgatgaacaccttcatctggatccggttttctggggatatgctcccggatggtgggataaaccgccgctgattaacgcccgcgtagaaactgccgcaaccagtcgcatgtttaaaccgctctggcaacatggtcgggtaatatgctttgccgatggctggtttgagtggaaaaaagaaggcgacaaaaaacagccttattttatctatcgcgctgatggacaacctgtttttatagccgcgataggtagcacaccgtttgagcgcggtgacgaagccgaaggagttttaattgtcactgcagcagcagaccagggcctggtagatattcatgaccgccgcccgctggtactgtcgccagaaactgcgcgggaatggatgcggcaagacattggtggtaaagaagcctcagaaatcgctaccagaagctgtgtgccagcaaaccagttcatctggcaccctgtgtcgcgcgcggtgggtaatgttaaaaaccagggcgcggagttaattcaacctgtttgataagcctggagattatctacacctggatggacatcattgtactatgccccgtacatgccccatcacatcctcaacatcaaagtattagagccttgcaaaccattatgcgtctcagtttgtctcatctatcttacgcaaaaaaaatagaactaatatcaagcggcgctatattgcgtattaaataaaaccacctcaattacattaataaatctaaacaaatatcatgcaaataatttccatggttatttttaggctatttaaattaaaaaaataaattatgagtcaaacataaataacaacctttaatataatttgactaccaaatttatattcgttcacaaaatagtcatgcattgtgtgcaatagaaacagttcagataaaaatagggaactacttcacaatttaaatgagaaactaaaacttacatcttgaaataatctcattgattagatgaatatttgtagtgcagtgacatcatttttaaataatagttcaaataaaagggctcacgatgaaaaaattaacagtggcaatttctgctgtagctgcatcagtactgatggcgatgtctgctcaggcagcagagatttacaataaagacagtaacaagctggatctgtacggaaaagttaatgctaagcactacttctcttctaacgatgcagatgatggcgacacaacttatgttcgtctgggcttcaaaggcgaaactcaaatcaacgatcaactgactggtttcggtcagtgggaatatgaattcaaaggcaaccgtgctgaatctcaaggttcttccaaagataaaacccgtcttgccttcgctggcctgaaattcggtgactacggctccatcgattatggccgtaactacggtgtagcatacgatatcggtgcatggaccgacgttctgccagaattcggtggcgatacctggacccaaacagatgtgttcatgactggtcgcaccacaggtgttgcaacctatcgtaacaacgacttctttggtctggttgatggtctgaactttgctgctcagtatcagggtaaaaatgaccgcactgacgtaactgaagctaacggtgatggtttcggtttctccactacttatgagtatgaaggattcggtgtaggtgcaacctatgctaaatctgaccgcactaatgatcaggttatctacggtaacaacagcctgaatgcatctggtcaaaatgctgaagtatgggcagctggtctgaaatatgatgcgaacaacatctatctggctaccacctattctgaaacccagaacatgactgtttttggtaataaccatattgccaacaaagcacaaaacttcgaagtagttgcacaatatcagttcgacttcggtctgcgtccgtccgttgcttacctgcaatctaaaggaaaagacttgggtgcgtggggtgatcaggacctggttgaatatattgatgtaggtgcaacctattacttcaacaaaaatatgtccacttttgttgattacaaaatcaacctgattgataagagcgatttcacgaaagcatctggcgttgctaccgatgatatcgttgctgtaggattggtttaccagttctaatctgattactcaaagatatgttgtgggaggctttgcctccccaacatataagtggccccctcaagccactttccttagaagcactatcttgcttctgactatataaaccttctgttatatattaccctttattttctggggcgtttcaacgccccatttttaataatactcagtgaacaattaacgtatcaattagatttaataacaacgatatccgtacctaaccggatatctaatgtcataagcatccctttaattatcccctcaacctcttgtaactttcccactcttgaactccacatagtccaaacgccggatgcaaaaaaatcacacgtgcatttctgaaattgtgatgaaggaagatagtatcaattatatgtgcttataaacgaccccgattagcgcagaagtcaccggattgttcaggctccaataggttgagtatgccgtatttattttccaaaataaaaatcgatgctgttgctccttcataaaatacttttactctctggacgcttttcttagctctcttggtgttatcttaaaacgattatggaacctttcagtaaaacgagaaggacacttgtaaccattttccctggcaatctcgctgatgggttttactgtcgtttgtatagcagacaacgcattatttaacctcacgtcgtccaatatactttgaaaacttattccctcgcttgccagacggcgatgcaatgtggaaacagaaatgtagagatatctcgctaccttgtttgctgtccattttgttccaggttcggatagcattaggttataacaacgacttattaatgattgtttactatctgataaaagtaaacaattaacatgatgtgctcctaatgaaagtagaacgcccattgctaagtgttcctgaatttgcgttgagaagcctcggaaaatagatgtttttagttgctcccaacaatatattaactcggggttctgaggtaagcagaaacctgtcgtgttacgaatttgatcagttatcgcataaaatttttgaaacttttcaattagatcaatgggataataaagcatttctgcaagataaagacctgcttctggataattcgcaatataaaattcatatccacagggaaataatattatctgattattatcaacagttagactatgcgtctcccaattgataactttttttccctgacggatacgacataaagctggcataagaggcttaaccctgtgaatctcatgatgtttatgcatccgtatttcttcaatctttaggttagacttatcttttgccagcatactcttaccctactttatctcataaactggtgttatctcagcggttgcaattttattggcattaagcatataaccaactaacgctccgctggaattagaatccacaggaatcttatcagtttttagagcccatactttaaactggtaatgatggggtttatctcctttgggaggacatgctccaccaaatcctgcataaccaaaatcatttcggccttgaacagcaccagtcggaagttttgtaccatcacgtcttcctgcatcagtgggcaaatatgttacagttgctggaatattagcaacagtccagtgccaccatccactgcctgtaggagcatctggatcatacacagttacggcaaagcttttggtgccttcaggagcaccagaccaggttaatgagggcgatgtattacccccttcacacccaaatccagaaaatacatgagacgttgtaagttgctctcctgtttttatttcattactagtgacctgaaatgctgcggcctgcgcagaaaatgttatgaatgccaatacacttgaaacgataagttttttcataaaaacctcattgttgtgacctatcgttattttatttgatgtgccttgatctcattatgcataaaggcgcaatgatcgcgcaaatgcaatcataattataaaggtgccccgaacattagccataatatgcacaaatcagattcctgttatctcaaggataattattttttaatgcggtgcacttcgtgacaacaagttaatgactaacacaccggcacaaatcaacatcatgcctatgatagctggcaggtccagtcgttgaccaaaaaatccccaggaaagcaaactaatcagaacgataccgactcctgaccagatagcataagcaatccctgtaggtatataagccagcgtctgagctaataaccagaatgaggcacaatagcaaataattgtgccaacagagggccataaccgtgtaaacccctctgaaaacttcattaaggttgtaccaatgacctctgcaagtattgcgccaccaagataaatataagggttcatagcatattctttcctgttcatactggagagaattgtactacagtttgaacacaactcaccgttttcatcctggtgtatgtgtatccagggggctctggcgtggcaagagataaaggcaggaacaataatgatcagaaggaaccccaggctaacgaatgagttcactcttcctgggagcaaagcgaagacaaaacatgttatcgcgtttacggatcgtggatggcagaaaacaaccaggatcaggtatccattttaaaccagaaattgagtgagtttgccccatccatgccccacgctgtgggatcggatataattaaacaagcatagtcaacaggttacacaacctacacctgcatggacatcacttcctgatacgccgccaccagcttattacgcacctgaatccccatttgcatagaaactgaggctttttgcatatcggtcatcacatcgtttagcgccacgccgggttcaccgagggtgaatttttctgcctgcgtgcgggcgactgtttgtgtatcgcttatgcgatcgagcgcggcgtgcagctgcccggcaaaactaatggtcggttgcggcagtgattcctgcgcacgcgcactcatcgccgtagcctgtaactggctgataaccccttcaatcccctgtatcgctgacattttcgtctcccggataatttctggtagcaaagcctaccagtaagtcaataagacaaaggcgctaaatagcaacaaaaaaacgggtttattggcggatagaaaaaaacgaaagcacaaataatgggagcgtcaatttttcgagtttgctgacccgggagtgagtcttgttccactttgccaataacgccgtccataatcagccacgaggtgcgcgatgaatgcgactgcagcccagacaaaatctcttgagtggcttaatcgcctgcgtgcgaatccgaaaattccattgattgttgccggttccgcagcagtggcggtcatggtcgcactgatcctgtgggcgaaagcccccgactaccgcacattattcagcaatctttccgatcaggatggtggcgcaattgtcagccaactgacgcaaatgaatattccttaccgcttcagcgaagccagcggcgctattgaggttccggcagataaagttcacgaactgcgcctgcgcctggcgcaacaaggtttgcccaaaggcggcgcggtcggtttcgaactgctcgatcaggaaaagtttggtatcagccagttcagcgaacaggtgaattatcagcgggcgctggaaggcgagctttctcgtaccatcgaaactatcggcccggtaaaaggggcgcgcgtacatctggcaatgccgaaaccgtctttattcgtccgtgaacaaaaatccccttctgcatcggtgacggtaaatctgttacccggccgcgcactcgatgaagggcaaattagcgctattgtacatctggtttccagcgcggttgctggtctgccgccaggaaacgtcacgctggtggatcagggcgggcatctgttaacccagtccaataccagcgggcgcgatcttaatgacgctcagttgaaatatgccagcgatgtcgaaggccgtattcagcggcgtattgaagcgatcctgtcgcctattgttggtaacggtaatattcacgcccaggtcacggcgcaactggacttcgccagtaaagaacaaacggaagaacagtatcgccctaacggtgatgaatctcatgcggcgcttcgttcacgccagcttaatgagagcgagcaaagcggttccggttatccgggcggcgtaccgggagcgttgtcgaatcaaccggcacctgcgaataacgcgccaatcagcacgcctccggcaaatcaaaataaccgccagcagcaggcgagcaccaccagcaatagtgggccgcgtagcacacagcggaatgaaaccagtaactacgaagtcgatcgcaccattcgtcataccaaaatgaacgtgggcgatgtgcaacgtctgtcagtcgcggtagtggtgaattacaaaaccttgccagacggtaaaccattgcctctcagcaacgaacagatgaagcaaattgaagctctgacccgcgaggcgatgggcttttctgaaaaacgcggtgattcgctcaatgttgttaactcgccgttcaatagcagtgacgaaagcggcggagcactgccgttctggcaacagcaagtgtttatcgatcagttgctggctgccggtcgctggttgctggtactgctggtggcgtggttgctgtggcggaaagcggtacgcccgcagctaacacgtcgcgccgaggcggtgaagactgtgcagcaacaggcgcaggcccgcgaggaagtggaagatgcggtggaagtccgtctgagcaaagacgaacaactccaacaacggcgcgctaaccaacgactgggggcagaagtcatgagccagcgtatccgtgaaatgtctgataacgatccgcgcgtggtggcgctggtcattcgccagtggataaataacgatcatgagtaacctgacaggcaccgataaaagcgtcatcctgctgatgaccattggcgaagaccgggcggcagaggtgttcaagcacctctcccagcgcgaagtgcaaaccctgagcgctgcaatggcgaacgtcacgcagatctccaacaagcagctaaccgatgtgctggcggagtttgagcaagaagctgaacagtttgctgcactgaatatcaacgccaacgattatctgcgttcggtattggtcaaagctctgggtgaagaacgtgccgccagcctgctggaagatattctcgaaacccgcgataccgccagcggtattgaaacgctcaactttatggagccgcagagcgccgccgatctgattcgcgatgagcatccgcaaattatcgccaccattctggtgcatctgaagcgcgcccaggccgccgatattctggcgttgttcgatgaacgtctgcgccacgacgtgatgttgcgtatcgccacctttggcggcgtgcagccagccgcgctggccgaactgaccgaagtactgaatggcttgctcgacggtcagaatctcaagcgcagcaaaatgggcggcgtgagaacggcagccgaaattatcaacctgatgaaaacgcagcaggaagaagccgttattaccgccgtgcgtgaattcgacggcgagctggcgcagaaaatcatcgacgagatgttcctgttcgagaatctggtggatgtcgacgatcgcagcattcagcgactgttgcaggaagtggattccgaatcgctgttgatcgcgctgaaaggggccgagcagccactgcgcgagaaattcctgcgcaatatgtcgcagcgtgccgccgatattctgcgcgacgatctcgccaaccgtggtccggtgcgtctgtcgcaggtggaaaacgaacagaaagcgattctgctgattgtgcgccgccttgccgaaactggcgagatggtgattggcagcggcgaggatacctatgtctgataatctgccgtggaaaacctggatgccggacgatctcgcgccaccacaggcggagtttgtgccaatggtcgagccggaagaaaccatcattgaagaggccgaacccagccttgagcagcaactggcgcaactgcaaatgcaggcccacgagcaaggttatcaggcggggattgccgaaggtcgccagcaaggtcatgagcagggctatcaggaaggcctggcccaggggctggaacaaggtctggcagaggcgaagtctcaacaagcgccaattcatgcccggatgcagcaactggtcagcgaatttcaaactacccttgatgcgcttgatagtgtgattgcttcgcgcctgatgcagatggcgctggaggcggcacgccaggtgatcggtcagacgccaacggtggacaactcggcactgatcaaacagatccaacagttgttgcagcaagaaccgttgttcagcggtaaaccgcagctgcgcgtgcaccccgatgatctgcaacgtgttgatgatatgctcggcgcaactttaagtttgcatggctggcgcttgcggggcgatcccaccctccatcctggcggctgtaaagtctccgccgatgaaggcgatctcgacgccagtgtcgccacccgctggcaagaactctgccgtctggcagcaccaggagtggtgtaatgaccacgcgcctgactcgctggctaaccacgctggataactttgaagccaaaatggcgcagttgcctgcggtacgtcgctatgggcgattaacccgcgctaccgggctggtgctggaagccaccggattacaattgccgctcggcgcaacctgtgtgattgagcgccagaacggcagcgaaacgcacgaagtagaaagcgaagtcgttggctttaacggtcaacgactgtttttaatgccgctggaggaagtggaaggtgtcctgcccggcgcgcgtgtttatgccaaaaacatttcggctgaagggctgcaaagcggcaagcagttgccgctcggtccggcgttattaggtcgcgttctggacggcagcggtaaaccgctcgatggcctcccctcccccgatacgacggaaaccggtgcgctgattaccccgccatttaacccattgcaacgtacaccgattgaacatgtgctggacaccggcgtgcgcccaatcaatgccctgcttaccgtcgggcgcgggcagcgtatggggctgtttgccgggtccggcgttggtaaaagtgtgctgctggggatgatggcccgttacacccgcgccgatgtcattgtcgtgggtttgattggtgaacgagggcgcgaagtaaaagattttattgagaatatcctcggtgccgaaggacgtgcacgctccgtggtgattgccgctccggcggatgtttctccgctcctgcgaatgcagggcgccgcctatgccacgcgcattgccgaagattttcgcgatcgtggtcagcatgtgttgctgattatggactccctcacccgctatgcgatggcccagcgtgaaattgcgctggcgattggcgaaccacctgccactaaaggttatccaccgtcggtgtttgccaaattaccggcactggtcgagcgtgccggaaatggcattagcggcggcggctcgattaccgcgttttataccgtgctcaccgaaggcgatgaccagcaggaccccattgccgactccgcgcgggcaatcctcgacggtcacattgtgctgtctcgccgactggcggaagccgggcactatccggctatcgatatcgaagcgtcgatcagtcgcgcaatgacggcgttgatcagtgagcaacattacgcgcgagtgcgcaccttcaaacagctgttgtcgagttttcagcgtaaccgcgatctggttagcgtcggcgcgtatgccaaaggcagcgatccgatgctcgacaaagccatcgccctgtggccgcagctggagagctatttgcaacaaggcatttttgaacgcgcggactgggaagcgtctctccaggggctggagcgtattttcccgacagtgtcataacccaggagataacggcagatggcggaacatggtgcgctggcgaccctgaaagatctggcagaaaaagaggtagaggatgccgctcgcctgctgggtgaaatgcgtcgcggatgtcagcaggcggaagaacagctcaaaatgctgatcgattatcagaatgaatatcgcaataacctcaatagcgatatgagtgccgggatgaccagcaaccgctggatcaactatcagcagtttatccagacgctggaaaaagccattactcagcatcgccagcaacttaatcagtggacgcagaaagttgacattgccctgaacagctggcgagaaaagaaacaacgtttgcaggcctggcagacactgcagaaacggcaatccacggcggcactgcttgcagaaaaccgcctcgatcagaaaaagatggatgagttcgcccagcgcgccgccatgaggaaacctgaatgattcgcttagcgcccttgattaccgccaacgttgacaccaccacattgcctggcggcaaagccagcgatgctgcacaagattttctcgcgttgttgagcgaagcattagcaggcgagacaacaaccgacaaagcggccccccagttgctggtggcaacagataagcccacgacaaaaggcgaaccgctggtcagcgatattgtttccgatgcgcaacaagcggatttactgatccctgtggatgaaacacttcctgtcatcaacgacgaacaatccacatcaacaccgttaaccaccgctcagacgatgacgttggctgcggtggctgacaaaaatacgacaaaagacgaaaaagcggatgaccttaatgaagacgtcaccgcaagtctgagcgccctttttgcgatgttgccgggttttgacaatacgcccaaagtgactgatgcaccgtcaaccgtgttaccggcagagaaaccaacgctcttcacaaaactgacttctgcgcaactcactacagcacagcctgatgacgcccccggcacaccagctcagccattaacaccgctggtagcagaagcccagagtaaagcggaagtcatcagcacgccttcgccggtgaccgctgacgccagcccgctaatcactccacaccagacacagccactgcccaccgtcgccgcgcctgttttgagtgcaccgctgggttctcacgaatggcaacaatcattaagccagcatatttcgctgttcacccgccaggggcaacaaagtgcagagttgcgtctgcacccacaggatttaggtgaagtgcaaatttccctcaaagtggatgataaccaggcgcagatccagatgatttcaccgcatcagcacgtacgcgccgccctggaagcagcgctgccggtactgcgtacgcagctggccgaaagtggcattcagttagggcaaagcaacatcagtggcgaaagctttagtggtcagcagcaggccgcttcccagcaacagcaaagccaacgcacagcaaaccatgaacctctggcgggggaagacgacgatacgcttccggttcccgtctctttacaagggcgtgtaacaggtaacagcggcgttgatattttcgcctaacgtcagaggtagcaccgtaatccgcgtcttttccccgctttgttgcgctcaagacgcaggataattagccgataagcagtagcgacacaggaagaccgcaacacatgactgattacgcgataagcaagaaaagcaagcgatcgctttggatcccgattctggtattcattaccctcgcggcctgtgccagcgcaggttacagctactggcattcgcatcaggttgccgctgacgacaaagcgcagcaacgcgtcgtgccctccccggtcttctatgcgctggatacctttacggtcaatttgggcgatgcggatcgcgtgctttatatcggcataaccctgcgactgaaagatgaagctacccgctcgcggctgagtgagtatttgccggaagtccgtagccgtttgctgttactgttttcgcgtcaggatgctgccgtactggcgacagaagaaggcaagaaaaacctgattgccgagattaaaaccacactttccaccccgcttgttgccgggcaaccgaaacaggatgtcaccgacgtgctgtataccgcttttattctgcgataacgacatgggcgatagtattctttctcaagctgaaattgatgcgctgttgaatggcgacagcgaagtcaaagacgaaccgacagccagtgttagcggcgaaagtgacattcgtccgtacgatccgaatacccaacgacgggttgtgcgcgaacgtttgcaggcgctggaaatcattaatgagcgctttgctcgccattttcgtatggggctgttcaacctgctgcgccgtagcccggatattaccgtcggggccatccgcattcagccgtaccatgaatttgcccgcaacctgccggtgccgaccaacctgaaccttattcatctgaaaccgctgcgcggcacagggctggtggtgttctcgccgagtctggtgtttatcgccgtggataacctgtttggcggcgatggacgcttcccgaccaaagtggaaggccgcgagtttacccataccgaacagcgcgtcatcaaccgcatgttgaaactggcgcttgaaggctatagcgacgcatggaaggcgattaatccgctggaagttgagtacgtgcgttcggaaatgcaggtgaaatttaccaatatcaccacctcgccaaacgacattgtggttaacacgccgttccatgtggagattggcaacctgaccggcgaatttaatatctgcctgccattcagcatgatcgagccgctacgggaattgttggttaacccgccgctggaaaactcgcgtaatgaagatcagaactggcgcgataacctggtgcgccaggtgcagcattcacagctggaactggtggccaactttgccgatatctcgctacgcctgtcgcagattttaaaactgaaacccggcgacgtcctgccgatagaaaaacccgatcgcatcatcgcccatgttgacggcgtcccggttctgaccagtcagtacggcactctcaacggtcagtatgcgttacggatagaacatttgattaacccgattttaaattctctgaacgaggaacagcccaaatgagtgacatgaataatccggccgatgacaacaacggcgcaatggacgatctgtgggctgaagcgttgagcgagcaaaaatcaaccagcggaaaaagcgctgccgacgcggtgttccagcaatttggcggtggtgatgtcagcggggcgttgcaggatatcgacctgattatggatattccggtcaagctgaccgtcgagctgggccgtacgcggatgaccatcaaagagctgttgcgtctgacgcaagggtcagtcgtggcgctggacggtctggcgggcgaaccgctggatattctgatcaacggttatttaatcgcccagggcgaagtggtggttgttgccgataaatatggcgtgcggatcaccgatatcattaccccgtccgagcggatgcgccgcctgagccgttagtgatgaataaccacgctactgtgcaatcttccgcgccggtatctgctgcgccactgctgcaggtgagcggcgcactcatcgccattattgccctgatcctcgctgctgcctggctggtaaaacggctgggatttgcccctaaacgcactggcgttaacggtctgaaaattagcgccagtgcttcactgggcgcgcgtgaacgggttgtggtggtcgatgtggaagatgcacggctggtgctcggcgttaccgcagggcaaatcaatctgctgcataaacttcccccttcagcaccaacggaagagataccgcagaccgattttcagtcggttatgaaaaacttgcttaagcgtagcgggagatcctgatgcgtcgtttgttgtctgtcgcacctgtccttctctggctggttacgcccctcgccttcgcgcaac

SEQ ID NO: 10034 - DNA, 31822 bp, Escherichia coli
ttcacagaacgacagatagcataacccgccttatgtatacctggtgcatccagacaggaatatgccgggataccaacaccaacggcaagatattcacttgaagtggaaatatattcccgagtttcaccatcatagttataaacggtaatatcccctgcctttgtagcaacaagtccactatttaatattgctttatccattatgctgctctcacgatatagttaaatgcaatgttgcgtggacgggtatcgacggggttaacggccactgtacccgacacggactggtcattaccgttgctaacggtaatgttactactggttgatccaatccctactgaatcggtaaatttagcacctgagccgctcaaagttcccgagatgatagctagctccacataaaaagtacctacagttggctcttgtgttgacagcaccgcacgccttgaatcaacgccgcgcccatcatcccagccacgaataaactcaccacgtaaatcaggcaatttatttgtcggataagcctttgccagttccgggtattcttcagcagaaaaagccgcaccgttgcatttcagccagcctgttggcggtgtggctgaaggccatggaacaggcacaccaacaggtaatgcagagccttctcccaaaccaacgtttatgaaaatgcagaaataacgagcaaatggcatcattcctgcttttgtcagggagatctaccatgcttattggctatgtacgtgtgtcaacaaatgaccagaacacagatctacaacgtaatgcgctgaactgtgcaggatgcgagctgatttttgaagacaagataagcggtacaaagtccgagacctagggctgacactgctgttcttgatgcaaattaaagtatttaatagtgagtagcggccttactaatgtaaggccactataatcattttattaattgcattaatcgtgttttggccatactttcaatgcaatttcccccaactttttaccccgctccaggatttcatcctcatcccatttatccttaactataagtggaatgttcagtcgtagattggtgtggacgatgagagcatcacgttttttcagaaatacagcattctgaacagaacggtttacgctaaggttaagcaaagttagatttcccaaagtagatatcgcttgttgccgtttccttaccagtagctgttcaggggtaagatcggttccagacagaacaatttggttcaataccgtagcatctgaatttgtcaccatacgaccattttcgagaggccaacaggaataccaactttgaggcataagatgatcgatatcgagattagaaagatttggaacatcaggcttttctgtctttacttggcgacaaagttctctttcaagttccgttaacattgagcgcattttcggtgcgtcgagcctgccaggataaagtggagcattgatgcaagcgttgagaaattctgagtcaccaggccaacgtgaggcttcgccatttaagttattgaggatattacgtaactcaacactggaaatttccgttttagccaagtgccgcaatacattcataaatacattgttgtaattctttggcgtcaggccacatacggctcttcgtactacgtaggagacaagatcattatacatggctgctttctcatcatcagcgatgttagctatcgaaatgaacaaagcaagcggataaagtgtcgtcacatcatagtctgcgatgcgatatccaaagtgtgagatgggggttgtgccaaaaccatcaaccaattctttatattgtgatgcatattgtttgaggcgctttacttgcagatctgctcgttgtgaagacaagtccttacttacataatcacgatactcattgtaaaggcgagacagatcaatttcacgttgcctttctgattgcaatgtcgcatgtactagccactccatgcgtggtttattaatacgtccacggcgttgtttttccgaccagtatttatcttcaaagctcttccactcattttcatataattcaatagcattaatattttcatgctcagcgcacataaagatatagttgcgaataagatccgtagcatgaagttccgcccctcgcccatttaatgtttcaaaaattatttgggcatcatcttcagcttcgagaaatatgcttaccagtttcagatctgttaagacagcctcaattagagctacagcattttcttgtggtgagtggttttctattttaatccattttataaaggcttcagtaaaaaaacataatgcttctagtgatggcgggtgattaaaatgcttacgcaacgtaccatgctgcgtgaaactatcagagaatacgtcccggagatcgtcaatattttcaacattaaaactttgaataaaatgagtttgatcccgaaaagttggccacagtttgaagcgttctacttctttatttcgcattgtgtcttcgtttgagtttttcaggcaaggcgaaatgagagcctctaagctggaaagatccgtagcacgtaatgctaatcggatggatgccagaacatattgaagagtggtcaatcgttgctgaccatcaataatatgtatggaatctacacctaataatcctttttttgattgaggttccagtacaaccgcaccaaggaaatggggagttggttttgtacccgagagccgggattgtactttctctaggatatcctccagtagagctgaccactggtcttgctgagtccatacataggcacgttgatagaatggaacacagtattgtcggcggtcttgaaaaagttgttggacagttagcgtctcggatttcatggtatacctgtaagcgacattgtacaaaagtgaggagttaatctgatttagaacaatcattttattttgctatgatacaacgtatttgttaccgattaagtaaaaaacgcgtctgaacgctgacgttttagggctttactggttattctttcttatctcttcatcatcccatcggcatcctgtcgaggttgttgacttgttgttatttattttgtctaggcgctgtttaattattattgatagaattgatggtgagaggtgattgaaaccgtaggcacgtcgtttgcaaggacgtgctacgactggctggtgaacttccgatagtgcgagtattgaatgatttcctacgtgctaactagtgaacaaacaactcttcagtagactctcaggtatcattcagagtttcctgaacgaaagttttagctcaatctttatctgcagtatgtctaactgaaaaactatcgttgctggtggcttttacgatcatctccacatcgtcataacgcttgccaatgtgttgggttaattcttcctttaacgcgtccacagcgccgtttggcatttggtcattttgtctttggctatggagatctcaatacgcataacacttcttttgtactgcgtttgtagacagtattattcttatctgtgtaaataaacagtatcaagacttcgttttagctgcataagaaaaaagagatggatacattcggaaagattttgatggtggtaggctaagtgaatagcctaaaggtgttttaccccaattattccccggtatttctccgcataaaaaacaatcataaaaaaaccagccataataggctggttcttaagggatttttggtcggcacgagaggatttgaacctccgccccccgacaccccatgatggcgagctacgatcttaagggctgttatgtgccagaaacagagatttttatattcctcactctggaaatcataatgctaactagtagggattataagttgtcaattgacagtattgtgcatattttgtgacttataagttaaattataggcgttgtgatatggatattaatgaatttccatctggagtaatcgaacatcttggctggtatgtataccgcctaattgacccgagggatggcagtacgttctatgtaggtaaaggcaaaggtaatcgtgtctttgctcatatgcgtggtgaggttgcagcagtggatgatgatgagttactgaataataaactcaggcaacttcgagagatcagacttgctggtcttgatgtgatccatgttattcatcgacacggtatggccgaagaaaagaccgcttacgaggttgaagcagcgctcatagacgcttatcccggcttaactaacatcatgaacggtgctggcagtaatgagttcggtgctgcacacataaaagaattaatcgctacgtaccagcctgaaactattacgttccaacataaggccctaatgatatcggttaataggagttcaaaggatattgacctctatgatgctgtacgttttagctggcgtgtcagcgttgaccgcgctcgtaaggctgagatcatactggcaacagtaagaggtatcgtgaggggggtatacatcgctgatgagtggctcaagtctacccgtgagaatttcccagagatgacttcatgggaggcagacgatgagtttgaagcgactcaatgttcccgctttggtttccggggtagggtggcatctcctgaaatcacacaactttatataggtaagaaaattcctgatgatctcagaaagaaaggtgctatgtctcctgtgagatattctcccggtttttgatttcggaatggaactggatttcatattgtggtcaattttcgcacatgatgagagagagcccgcgatagttggctcttttgtgcaaagtctgaccaatatttattcccctcactggacgttacactcagactatccactgctgacatgccagtgatttaaaaggaatgctgctgatttaaatagcgaaaacttcactaaagaggatgtaaaatgacactacccaagttcaggaatgacctacaagttgaagctaattactctatcaatcaagcccgtgaaatggttgggaaaacggtgaaatctgtccagattggttttcagaaaactggagtacaggttcatcagactgaaatgctaatcatcacgtttacagatgacactcaacttgccatctcaacaggttcaaacgttgtaaacataacgtcgttaattgggcgtggtggcagttgcgagcttaagcctgcggattttcacgtagattttgatttgacctggcaaagatgacaaatccggccgtgccagcggcctttttcatgctcgtcctgctggcacggccgcaaacctaatcctgtaaggtgacacttaagcgtgtcagaactgcgcaataacaaccttcacttttccttccgcgtctttagattccagatcggttttcacgcccaaaggattatttatgtagcaatccgggtcatatacaaacaagatcaacgtatcgcagtcttggtgagcgcggtagcgcgccatatcaataagcaactctccaccaactttacccgctcccagagattcacgggttttcttcacctctatcacaattttctcttttttcaaaagaaagtcctgtcttgaggccgcgcccgcaaagctgggggtatactcttccgccctaatatcattaaaatgaagcgtcagcagtgcataaatcaaatcctgtacgtcatactcatcattaacttcaagcggcgcacggccgttgtaccgcctctttaactggcgaacaaaggtcggaaacctgttaagaatattaagtacgaggctcagcggcgaaccttcttgaggagtattagtactgacagcagagtgcgcaagatcatctctcgccgcatcaaacaacggtttataacttttgatcagtgtattgtaattagaagaccacctgctgtttacagtattgaagtcattgtaataatcagactcttttccgtagctgtcctctattaactttttcactctggcgatccagtttttatatttaccagaatcaacataggtttccatagtgtgagtgagaacgttctgcgcagtatattttgtggaaatgagcgcatcgtaatctttctcaagcgccctaaatctttcttccagttgtagatttgtcatagtgccttccaggctgtatagtcggataacaaggtctgtgcgtatggaaattctaccatacttagccttcttttcttcacactgggcgtaacagccattctgtccagcccccctagcgtgatcttacctgctgcggcattcggttgtcttagctccggaataatattcggagatgcataactgtccagtgccatacgcgccccaatcctatatatctacttcatagcttttcagtaaggaatgaatatattaatttctgtgatgattagtatcggagggtacgaatgactatatatcgctcatagcaaacgctcacatctgttatggttagaaagcaggaagagggggacaggctacggtataagaaaagtgggttgttgtttatggccgcattgagagtgtcgaatcaggctaaagagaagaagcaaaaaagcccgcatcagcgggctttcatttcacttcggagccgcggctcctttgcgtatccttttatgtctcctcaccgtctggtcggtgtcctgctgagacttctaacttcctgtttttgttggtgttgtccttacaccgtccaatcatgattggtggagctggcgggagttgaacccgcgtccgaaattcctacatcctcggtactacatgcttagtcagtctttacattcgcttgccagctgcggacggacacgccactaacaaactagcctgattaagttttaacgcttcaaccccaggcagggcttccacgcgatctcttttgggtttgacctctcttgatccccgtcctaagagcggaggctagggagagagggctctaagcaggttattaagctgctaaagcgtagttttcgtcgtttgcgactattttttgcggctttttacgaggccaaccgcccctcggcatgcaccttgggtttcgcaaatcccgtcgaatccagaatcagccccaatgtgtaacggtaagtataccagatttatgagcagcatgactagcccaaaaggcgttatcatcctggaattagcgcctgcatagtatgattttttttcgattaagcaatgggatggctacatctgtgtcagatttgacagtcgataagatgttcattcgcgccaccggatagggaggcgcggtgaggatttgattagtatcgcttatataggtttaacggtgggcatttttcatgatacgcgctttatccacctgccattcgcgttctttgatatctgaacgtttatcgtgctgtttcttacctttggcgacgccgattttcactttgcaccaggcatttttccagtacagggagagcgccactacggtatagccttctcgattgacgcgaccgtacaatgagtccagttcgcgctggttgagaagtaacttgcgggtacgggtaggatcgcacaccacatgcgtggaggccacagccattggcgtgatgttagcgccaaacagaaatgcctctccgtcgcgcagaaggacatagctgtcgctgatattggcttttcctgcgcgcagggatttaacctcccagccttgcagggcaagtcccgcttcgaactcttcttcgataaagtattcgtgacgggcgcgcttgttaagcgcgatggtcgctgaaccaggtttatgtgcttttttcttcgtcataagcgtcgtgaatcatcggtaatctgaaatcgaaaacaccccatatcaatcctgcgggggacaaggctctatcttagcatgaacccgatgttacccagcgccgggatagcgttttttttacagcaggataaatgatattatttgttggatttttgttgatggaaattgttatgcctcagattagccggaccgcactggtgccctacagcgcggagcaaatgtatcagttagtgaatgacgttcagtcttatcctcagtttttgccgggttgtaccggaagtcggattctggagtccactcctgggcagatgactgctgcggtagatgtgtctaaggctgggatcagcaaaacgtttacaacccgcaaccagttgaccagtaatcaaagtattctcatgagtctggttgatggaccgtttaagaaattgatcggcggttggaagtttacgccgttgagccaggacgcgtgccgtattgagtttcatctcgactttgagtttaccaataagttgattgaactcgcctttggtcgtgtgtttaaagagctggcagctaatatggtgcaggcttttactgttcgtgcaaaagaggtctacagtgccaggtaaaattgccgttgaggtggcttatgcgctacctgagaagcagtacctgcagcgcgtgacgttgcaggagggcgcgacggttgaagaagctattcgcgccagtggtttgctggaattgcgtaccgatatcgatttaactaaaaacaaagtcggcatttacagccgtccggcaaaactcagcgatattgtgcatgatggcgatcgggtggagatttatcgtcctctcattgccgatccgaaagagcttcgcaggcaacgagcagaaaaatcagcgaataaataacagacagaaaaaaggtgctcattgagcaccttttttaacgtctttgagagcaactttattattagttaccactcagcgcaggtttgttatcaatgttggtcaacacaccgctactgttaaaggtcagcgtcagcgtttgctgcgttacaccttcatgaccaggttgctggcggaagacatagaaccaggtatttgtaccaaatggatcggacatcagcggtgtacccaatgcgtacgcaacttgttgttgcgtcatgccaacacgtattttggatacgtcgttagcggtcagatagttcccctggttgatgtcaggacggtaaaccactcgctccagagtggaacagcctgcggtcaacatcaatagtactgctgctgcagcagtcagcgttttacagcgcatagtgatttgattccttttcgggcccgagcagtacgtggctcatctgtaatatgccgatgataatagacctttcatcactttaaaaccttttgctttccggtcttacggcgttttgctgtttactctgaccgtgaagcaggaaaaaagtttacgccgcaagcagttctttcgcattcgccagtgtgttacgtgtgacttcactgccaccaagcaggcgcgccaactcttgtaaccgcgcttttttatccagggattgcatatgcgtttctgtcatcgcaccatcggtttctttgctgacaaaatagtgttgatgaccacatcccgcgacttgtggcaggtgggtaacacacatcacctgagttgattcgccaagttgacgtagcagtttgccgacaactgccgctgttgggccgctaatccctacatccacttcatcaaaaatcagtgccggggtttccattttacgcgcggtaatgacctggattgccaatgcgatgcgggacaactcaccaccggatgcgactttggcaataggctgcattggctgacctgggttggtggttacccgaaactcaatacgatcagcgccgtcagcgcccaggtgatgctcgtcaaatttaacatcgatcgtaaactgcccatgtggcatagagagtgcatgcatactatcggtgatcagctgtgccaactcatttgcataatgctggcgttgctggtgtaacgcgcgcgccgtttccagtgcctgctgatgatgtttcgttaccgccagcgcgagcgtttcttgtgagtcggcctgatcgtccagttgctgctgttcttccagtagcgactggtaatactgtggcaatgcctcagggctgacgtgatgtttacgtgccagcgaaatctgttttgagatgcgctgttcaagttcaaacagtcggttgggatcgagatccagacgatcgcagtagtggcgtagttcatcactggcttcagcaatctggatggtagcctcttccagcatatcaagtacgccggacagtttgctgtccatgccaatcaattcgctcaccagttgtttagccgtgtaaagttgactttgcagatttgcgtcttcaccgtcagccattaatgccaatgcattctggctggtggtcagcaattgaccgctgttcgccagacgtttgtactcttcgtcgatttgctcaaactctccaggctgcggattaaattcgttaagttcttttaattggtattgcagcagctccgcacgggcggcgcgttcctgacttaactgctgatgatgcgcgaggtcacggcagctttgatgccacaactgataacgtgcggtcatttcctggagctgagaggtttcattggcatagccatcaagcaggaatttttggtgctcgggtttggtgagtaactgatgagcgtgctgaccatggatctgaatcagcaactgacccagttcgcgcagttgtgacagaggaacagctgtaccgttgatgaaaccacgggagcgaccatcgctgctgattacgcgacgaagcaaacattcatgcccgtcttcaagctggttttcttccagccaacgcagggccgctggcgtatctttcagagaaaaacgggcgcacaggtcggcacgagcagcgccggtacgcaccatgtcggcttcagcgcgaccaccgagacaaaggccgagggcatctattgcaatagatttacccgcgccggtctcgccagttattacggtcatgccgctatgaaaatcaatctcaagctcacgaacgatagcaaagttgctgatggtcagttgtgccaacatagttgttttcctgtatgaaaaaccattactgttattgtgtacagtataaactggttttatatacagtaaagaggctggcgtaaaattagaataatttttttgaccagccgagcttggtgcttaatgtattgaaataactgtaatctttcggatgaatcagattcagatggtaatcacagcgacgaatcaggacatcttcaccttcctgaatcggcagtgctatctggctgtcgcaactgatttccaggtcgttacggcgatgcgaaaaacgtagacggatcgtgctgctgctgtttatgaccagtggtcgtgctgacaacgtatgcgggaacatgggcaccagggtaatcgcatccagagagggtgtcagaataggaccgcccgcagagagggaatatgcggtggagcctgttggcgtcgaaataatcagtccatcggaacgctgcgaaaacgcaaagatctcgtcgatatacacttcgaactcaatcatatgcgccactttgccagggtgaagtaccacttcgttaatcgccgtgctgatgcgtttctggcaatcttgctgacagacttgcgcttccagcaaaaaacgtttctcgctgatgtagtggccttccagcacatcggctaattgttgctgggcgttatcgggatcaaggtcagtcaggaaacccaggttgccacggttgattccaataactttaatatcatagcgcgcgagcgtgcgcgccgcgcccagcatattaccgtcgccgccaacgacaaccgcgagatcagcctgttgcccaatctccgcgagcgtgccagttttcacattcttcagttgcagttcgtgagcgatttgttgctcaacgatgacctcgtaaccttttgtgcacagccagcggtagagcatttcatgtgttgtcagtgcagtggggtgccgtgggtgtcccacaatgccaatacacttgaaatgattattcatttttccgaggtccttgttgcgaagattgatgacaatgtgagtgcttcccttgaaaccctgaaactgatccccataataagcgaagttagcgagatgaatgcgaaaaaaacgcggagaaattcatgagtagtaaagaacagaaaacgcctgaggggcaagccccggaagaaattatcatggatcagcacgaagagattgaggcagttgagccagaagcttctgctgagcaggtggatccgcgcgatgaaaaaattgcgaatctcgaagctcagctggctgaagcccagacccgtgaacgtgacggcattttgcgcgtaaaagccgaaatggaaaacctgcgtcgtcgtactgaactggatattgaaaaagctcacaaattcgcgctggagaaattcatcaacgaattgctgccggtgattgatagcctggatcgggcgctggaagtggctgataaagctaacccggatatgtccgcgatggttgaaggtattgagctgacgctgaagtcgatgctggatgttgtgcgtaagtttggcgttgaagtgatcgccgaaaccaacgtcccactggacccaaatgtgcatcaggccatcgcaatggtggaatctgatgacgttgcgccaggtaacgtactgggcattatgcagaaaggttatacgctgaacggtcgtacgattcgtgcggcgatggttactgtagcgaaagcaaaagattaatttctgctttcgtaataaatcacggcccagcatgcgaatgccgggccgttttcgttactccgccacactctcgcgcagcggttttacaggaaaaacttttacctgcttaatcatattgtcctgtacgtcgagaatatcgatatcgtactcgcctatacgcacgcgggtgcctgctaccgggatctcctccagcgcttccagaatgacgccgttaacagtacgagcatcatcttccggtagatgccagttaaaggctttgttaatttctcgcacgttggcggtgccatcgataatcaccgacccgtcgttttgcggcgtgacctcttcggcaagtgttggcgacatcgacgtggtgaaatcgccgacaatctcttcgagaatatcttcgaccgtcaccagtccctgaatgtctccatactcgttgacgaccaggccgactttctttttgttgcgctgaaacttcaccaactgtgtgctgagcggcgtaccctccgggacaaaatagatctcgtccgcggcgcgtagcatggtttctttggtgaactcttttttctccgacatgagtcgccaggcttcacgcacacgcagcatactgatggcgtcgtccagcgaatcacggtagagcacgatgcgcccgtgaggtgagtgggagagttggcgcagaatcgatttccagtcatcgttgatatcaataccgataatttcactgcgcggcaccatgatgtcatcgacggtcatcttttccagatcgagcaccgacagcagcatatcctgattgcgacgggaaatttgtgagcgtgattcgtgcacgatggtacgcaactcttctttgcttaaagagccgctaaccacgatatcggttttgatgcccatcatgcgcattaacatgcgggtaatagcattcagcaaccagaccagcggcatcatcaaaatttgcagcggagccagtagaaaactactcggataagcgactttttccgggtacagcgcggcaatggttttcggcaatacttcagcaaaaaccagcactacgaaggtcagcacgccagtcgcaattgccacgccagcatcgccatacaagcgcatcccgacaatagtgccgagtgcggaagcaaggatattgaccagattattgccgattaacaccaggcttatcaggcggtctggcttgcgcagtaatttttcgacgcgttttgccgagcgattaccttgcttcgccatgtgtctcaggcgatagcggttgagtgtcatcattccagtttctgaaccggaaaaataggctgaaatgaccaccatgatgatcagaataatgatcaacgtagtagtagaaatgtgttccaggggaaactccttttctggggttagctgattaactgctggacaattcggctgccgaagtaggccagtgtcagaatgactgcacccgcaacgttaaaccagacgacgcggcgtccacgccatccttcatgataatgtccccacagcagcacaatatagacaaaccacgccacgatagagagcacggccttgtcgatattttccatgctaaataagttgtgcatgtagaacaggccagtgcaaagagtgagcgttagcagcaccacgccaatctgcgtgatatggaacattttacgctcgatactcatcaatggaggcatttcctggttaaacgccagcttcttgttcttcagttggtaatcaatccacgccagttgcagcgcgtacagggcagcgataattagcgtggcataggaaaaaagcgataagccaatgtgcaccagcatccccggcgttgcttccagatgggtgatgtattcattgggcatgaaggtcgccagcgccaggttgataagcgcaaaggcatagacaatgggtagcaacaaccagccacgattgcgagaagccacaatggtcattaccgtacagatcatcaaactgaccaatgaaccaacgttcagcaggctgaggttttgtccgctatcaccgtcgggcaggatgcgggcttccagagcgattgcgtggcagaccagcgcgatgaccgcagaaataatagccatgcgccgccagccgccgtttttttgcagcagaccgggaacaatcagcgcaagactgacggagtaggcgacaagcgcgagcagagcaaaaacgggcatagtaatgtcgacagtttgagcaataagaaagagaagcagtatagcgtcaggtgaacgctgctccaaccgttgcataacaacaaagacgccttcatgttatactgcggcaaaatactgatgatgtgtcgcgattgcggccaaccgtttccaccccaggcgagagacaatgtttgataatttaaccgatcgtttgtcgcgcacgctgcgcaatatcagtggccgtggacgcctcactgaagacaacgtaaaagatacgctgcgcgaagtgcgcatggcgctgctggaggcggacgtcgctctgccggtagtgcgtgagtttatcaatcgcgtaaaagagaaagcggttggtcatgaagttaataagagcctgacgccggggcaggagttcgtcaaaattgtccgtaacgaactggttgcggcgatgggcgaagagaaccagaccctgaacctggctgcgcaaccgcctgcggtcgtgctgatggcgggcctgcaaggtgccggtaaaacaaccagcgttggtaaactcggtaagttcctgcgcgagaagcacaagaagaaagtgctggtggtttctgccgacgtctatcgcccggcggcaatcaaacagcttgagacgctggcagagcaggtgggcgttgatttcttcccttctgatgttggtcagaagccggtagatatcgttaacgcggcgctgaaagaagccaaactgaaattctacgacgtgctgctggtggatactgccggtcgtctgcacgttgacgaagcgatgatggacgagatcaaacaagtccatgcgtcgattaatccggttgaaaccctgtttgtggtcgatgccatgaccggtcaggatgcggccaatacggcaaaagcattcaatgaagcgttaccgcttaccggtgtagtgttgaccaaagtggacggcgatgcccgcggcggtgcggcgctctctattcgtcacatcactggcaaaccgatcaagttcctcggtgttggcgagaaaaccgaggcgctggagccattccatccggaccgtattgcctcccgtattctcggcatgggcgacgtactgtcactgatcgaagatatcgaaagcaaggttgaccgcgcgcaggcagagaaattagccagcaagctgaaaaaaggcgacggcttcgatctcaacgactttcttgagcagctgcgccagatgaaaaatatgggcggcatggctagcctgatgggcaagctgccgggcatggggcagatcccggataacgtcaagtcacagatggacgataaagtgctggtgcgtatggaagccatcatcaactcgatgacgatgaaagagcgcgctaagccagaaatcatcaaaggttcgcgtaagcgtcgtatcgctgccggttgcggtatgcaggtgcaggacgttaaccgtcttctgaaacagttcgacgacatgcagcgcatgatgaagaaaatgaaaaagggcgggatggcgaagatgatgagaagcatgaaagggatgatgccgccgggatttcctggtcgctaaatgaccttatgcgatagagttattaactgctgattgcattttctccagaaatcagtaaaattttcgggcttttaatatgacaccggactccgttcctcgatggggtccggttgttttattcacacaagaggatgttatggtaactattcgtttagcacgtcacggcgctaaaaagcgtccgttctaccaggttgttgtcgctgacagccgtaatgcacgcaacggtcgcttcatcgagcgcgttggtttcttcaacccaatcgctagcgaaaaagaagaaggcactcgcctggatctggatcgcatcgctcactgggttggccagggcgcaactatttctgatcgcgttgctgcgctgatcaaagaagtaaacaaagcagcttaatctgtcacggtggtcatgatgagcaaacaactcaccgcgcaagcacctgttgatcccatcgttttgggaaaaatggggtcgtcttacggtattcgtgggtggctcagagtgttttcttccaccgaagacgccgaaagcatttttgactatcagccctggtttatccagaaggcgggtcagtggcagcaagtccagctggaaagctggaagcaccacaatcaggacatgatcatcaagctgaaaggcgttgacgatcgtgatgcggcgaacctgctgacgaattgtgaaattgtcgtggattcatcgcagttgcctcagcttgaagagggggactactactggaaagacctgatgggctgccaggtagtaaccactgaaggctacgatctcggtaaagtcgtagatatgatggaaaccggatctaatgacgttctcgtcattaaggcaaacctgaaagatgcgtttggtatcaaggaacgtctcgtaccgttcctcgatgggcaggttatcaagaaagtcgatctcactacacgttcaatcgaagtagattgggatcctggtttttaaaccaccggataaacggtaaaagacggcgctatgtggattggcataattagcctgtttcctgaaatgttccgcgcaattaccgattacggggtaactggccgggcagttaaaaatggcctgctgagcatccagagctggagtcctcgcgacttcacgcatgaccggcaccgtaccgtggacgatcgtccttacggcggcggaccggggatgttaatgatggtgcaacccttgcgggacgccattcatgcagcaaaagccgcggcgggtgaaggcgcaaaggtgatttatctgtcaccacagggacgcaagcttgatcaagcgggcgtcagcgaactggcaacgaatcaaaaattgattctggtgtgtggtcgctacgaaggtatagatgagcgcgtgatccaaaccgaaattgacgaagaatggtcaatcggcgattacgttctcagtggtggtgagttaccagcaatgacgctgattgactccgtttcccggtttattccgggagtactgggacatgaagcctcggcaacggaagattcctttgctgaaggattgctggattgcccgcactatacgcggcctgaggtgttagaagggatggaagttccgccagtgttactgtcgggtaaccatgccgagatacgtcgctggcgtttgaaacagtcgctgggccgtacctggcttagaagacctgaacttctggaaaacctggctctgactgaagagcaagcaaggttgctggcggagttcaaaacggaacacgcacaacagcaacataaacatgatgggatggcgtaagcccccgagatatcagtttacccaggataagagattaaattatgagcaacattattaagcaacttgaacaagagcagatgaagcaggacgtaccttccttccgtccgggtgataccgtggaagtgaaagtatgggttgttgaaggttccaaaaaacgtctgcaggcattcgagggcgtggttatcgctattcgtaaccgcggtctgcactctgcattcactgttcgtaaaatttccaacggcgaaggcgttgagcgtgtcttccagactcactctccggtagttgacagcatttctgtcaaacgtcgtggtgctgttcgtaaagctaaactgtactacctgcgtgagcgtactggtaaggctgctcgtatcaaagagcgtcttaactaagatttcgcttaagcgacatcctgttaagaagggctggccaattggctggccctttttttgtctgtttgctcgtgttttaaggggttgtaatcaccactgcgacgcggcggttctcggcgcggccctgggcggtcttgttactggctatgggatatttttttcctaaaccctgtgtggtgagattgctgcgcggaatttgtccacccatagcccatgcatcggccacgacattcgcccgtttcaatgataagacttcgttgtaactgtcttcaccatagttgtcggtgtgtccatccatacgggcatgtgttagccctgtcgaggccaatttggctgccatggtttggatctgttgctggctttccgggagcaatttgtagtcattttttgcaaacagaatggcatctgataagcccagcgaccagtcgccggcggattcagtaaatccataagattgcatagcggcgacttgctcaggagtaaactttccctgaggggactggcagccagtaagtattagcgaggtgaaaatcaggggtgctagcaggtgctttatcatatcgatatatccttgttatctcaccagcttttcggcacgctggtgtttggcctgatacatattgtgatcggcaagctcttgtaaattttccgcagaggcgtgctcaatagtcatcgcgtaaccaatgcttaatgtcatggtagtttgatggccattatgaagatcaaacgggagattaaaaatttgtgtcagtgctgagcatatctgctgcacttcagattccgactgtacatcatagagcaccatagcgaattcatcgccgcccaggcggtatgctttatgtcgcagcccgccaaattcagctaaccgttttgctatttcaatcaagactctatcgcccgtcgcatgaccccaggtatcattgatatatttgaaattatcgccatcaagaaatagtaacgccgacgtttttcgggcatcggaattgttcatcaacgtgttgatgccgctacgaaacgctgcgcggttagccagcccggttaatgggtcatgtagcgcggtacgtagaagctgcgcatttttggcctgtaaacgaagctgccactcttccatttcatccagcagactgttgaagtcgagagcgaagcggtgaaactcagcgatacgttcttccgaaactcgtcgggaaaaattgcggttagaacgcacatcatgtacgacatcggtgatatttttcagcgcttccaccaggccattgtgcaaatggcgggtgagggtaattgcgatgcctgatgccagcagaatacaaccggtcaggacagcgagcgaaaaccagataaaatggctgattgaactgtcgcgagcagttaagcgtacttcgccaatagtttcaccattgtggcgaatcggctgaatgatgggggcagggaagagccagtggcttatgaaattgctgaaagtatcgcctggttccttatgggtgtaatgccaggatgccagaatattttgctgcttatcacgcacttctgcagttgaaaattggccttgctggcccagcgctgccagtgtttcagttgctgcagggccatcggcaaaaacgacagctgcttccagactgtaagtcattgttgctgctgtcagtgccaggtttttttgcgcgtactgtttcagggtcagcactgacgtcacggaaagcagcagccagatcagcatcatagtgataaatatgctggtcatactgatgttgcgtaatgctcttttaaacgtggggcgcttattaagagaattatcgttatccatcatttttcttccgtgcgagcattaagacatccgggttgacttttacaccgctacgagataaagcatccaggtttacggcaaatctgacgtcattattgtggatgatcagacaaaaggcgctaccaataatgcactcggtattttgttcggcaattaataataacgcctttgacggatattgttcggttaattccatctggaatgtcggtgactcgttgccaaaataaaaaccattgcagcctgaaattatcgcctcttgttgagtatgaatgatgacaggcagataaggcaaagatgtagcagcattttcttgtaaggcggtactaaaacgtgaagatgaaaagatacataactttggtggccctgatagcccaggccagcgggtgtaactgacaataccggaaaccatcatacgcacgtttttcgcaacgtcagaaggttcctgagcgagtattggtgctcccgtcagcaggagaatcagcagtaagaacagtcggtgagaaaaacgcattcagggatcctcaccatcttcgctcgaaatgcatcgatattttttcagaatgctcattaaaatatcatcctttcatgcggtcgtcatcaatgtgaaaaataaaacataatgagtaaaatctcatgcttaattgattttgggggggtaattaatttaatcgtattgtgctggcattttcatcagccccttttcgccatacttcatgcagttggctggcattttcaacattattgcagctggcaggaaagcttttaccagaaagtccccgggcataagtaaaatcggtctggcaagttttcttttgcccttcggcatatcctttaaggtatagaccgcgatccgcctgtgaatcgctaaatgcatcgtcatctttaatggcgctgcccgatatcgcatcttccataccaacatcataccagtcggtgctggtcaaggttggcgcgtgagtataaggatcaatctgacatccgctaaccagtaaagccaacaagggggcgataaattttttcatcatttctttctcctttttcaaagcatagcggattgtttttaaagctggtgtaaatttatttatacagaaataaggggaaaaagcgcgaataaattgcttatgtaaagaaatgtgtacgaaatatggattgaaaactttactttatgtgttatcgttacgtcatcctcgctgaggatcaactatcgcaaacgagcataaacaggatcgccatcatgcagaaagacgcgctgaataacgtacatattaccgccgaacaggttttaatgactccggaacaactgaaggccgcttttccattaagcctgcaacaagaagcccagattgctgactcgcgtaaaaccatttcagatattatcgccgggcgcgatcctcgtctgctggtagtatgtggtccttgttccattcatgatccggaaactgctctggaatatgctcgtcgatttaaagcccttgccgcagaggtcagcgatagcctctatctggtaatgcgcgtctattttgaaaaaccccgtaccactgtcggctggaaagggttaattaacgatccccatatggatggctcttttgatgtagaagccgggctgcagatcgcgcgtaaattgctgcttgagctggtgaatatgggactgccactggcgacggaagcgttagatccgaatagcccgcaatacctgggcgatctgtttagctggtcagcaattggtgctcgtacaacggaatcgcaaactcaccgtgaaatggcctccgggctttccatgccggttggttttaaaaacggcaccgatggcagtctggcaacggcaattaacgctatgcgtgccgccgcccagccgcaccgttttgttggcattaaccaggcagggcaggttgcgttgctacaaactcaggggaatccggacgggcatgtgatcctgcgcggtggtaaagcgccaaactatagccctgcggatgttgcgcaatgtgaaaaagagatggaacaggcgggactgcgcccgtctctgatggtagattgcagccacggtaattccaataaagattatcgccgtcagcctgcggtggcagaatccgtggttgctcaaatcaaagatggcaatcgctcaattattggtctgatgatcgaaagtaatatccacgagggcaatcagtcttccgagcaaccgcgcagtgaaatgaaatacggtgtatccgtaaccgatgcctgcattagctgggaaatgaccgatgccttgctgcgtgaaattcatcaggatctgaacgggcagctgacggctcgcgtggcttaagaggtttattatggttgctgaattgaccgcattacgcgatcaaattgatgaagtcgataaagcgctgctgaatttattagcgaagcgtctggaactggttgctgaagtgggcgaggtgaaaagccgctttggactgcctatttatgttccggagcgcgaggcatctatgttggcctcgcgtcgtgcagaggcggaagctctgggtgtaccgccagatctgattgaggatgttttgcgtcgggtgatgcgtgaatcttactccagtgaaaacgacaaaggatttaaaacgctttgtccgtcactgcgcccggtggttatcgtcggtggtggcggtcagatgggacgtctgttcgagaagatgctgacactctcgggttatcaggtgcggattctggagcaacatgactgggatcgagcggctgatattgtttccgatgccggaatggtgattgttagtgtgcccatccacgttactgagcaagttatcggcaaattaccgcctttaccgaaagattgtattctggttgatctggcatcggtgaaaaatggaccattacaggccatgctggcggcgcacgatggcccggtgctggggttacacccgatgttcggcccggacagcggtagcctggcaaagcaagttgtggtctggtgtgatggacgtaagccggaagcataccaatggtttctggagcaaattcaggtctggggcgctcggttgcatcgtattagcgctgtcgagcacgatcagaatatggcgtttattcaggctctgcgccactttgctacttttgcttatgggctgcacctggcagaagaaaatgttcagcttgagcaactactggcgctctcttcgccgatttaccgccttgagctggcgatggtcgggcgactgtttgctcaggatccgcagctttatgccgacattattatgtcgtcagagcgtaatctggcgttaatcaaacgttactataagcgtttcggcgaggcgattgagctgctggagcagggcgataagcaggcgtttattgacagtttccgcaaggtggagcactggttcggcgattacgcacagcgttttcagagtgaaagccgcgtgttattgcgtcaggcgaatgacaatcgccagtaataatccagtgccggatgattcacatcatccggcactttttcatcaggttggatcaacaggcactacgttctcacttgggtaacagcccaataccttcatcgaacgggtgatttcccctaactctttcaatgctttttgcatttccgctgattcaagattggcctgaatatccagataaaacatctcttcccacggattaccgtgaatcggacgtgattccagacgggtcataatcagactgtgattgcgcagtaccagcaacgcttcaaccagtgcaccagcttgttgtccggtcgccattaacaacgtcgttttcgccggaacctggtcagaaacgttaatggctttacgtgccaacaccacaaatcgggtgaagttttgtcgctgattcgcttcaatacgctccagtacctgcaaaccgtacaaagtgccgccagcttcgcttcccaacgcagcaacatgcggtgattttgcctgtgcaaccttttccattgccgcagacgtactttcggtatattcaatcttccagtgcggataacgattaaggaatttgctgcattgctggaatggctgcggatggctgtagaccgtattgatggcggataaatcagtagtgccggagaccaacaaacaatgatcgatagttaacgtcatctcgccaacaatcgacaaactggtatgttgcagcagatcgtaaacgtcgtttatggcaccggagctggtattttcaatcggtacgacggcatagtcggcctggccggtttccacctgattaaaaatatcggcaaatttggcgcagccactttcaatgaattgctcaaagtgacgggcagcatactggcgcgccgcaagatgggaataagaacctttggggccgagaaaagcgatgcgtgctgagtgcggattaattttattgagatgttgctggagcaaagcctgctgagttaatacggaatcttcaatgatgagctggaacaggcgagtaatgtaatgggcgtccagatggtgcgctttaccgagcgtaattaatctttccagcaaatcgcgttcacgatcaatatcacgtaccgggcgatgcgagagcagtttggcttttcccacctcgacggccagttcgcgtcgctctgccagtaatgctaataatttttcatccagcgcgctgattttctctcgcagcgccagtaacgggttttccgatgtcatagtgttgcctttttgttatcaataaaaaaggccccccgatttgggaggccttattgttcgtcttcgcattctgtttcacacgacgaaacgcctcccattcaggggaaggtaaaaaagaatgcgaagaaaaacggtgtgtgtttcatgtttgtttccttaagtgactttagtacagtacccgtactgttttcacgctgtcaacaaaaaacgcgcccgaaggcgcgttggcgatacactcaatataaaggactactcttcttcaacttcttcgacgaagttggcgtctttcaccgatgttgcggcacgacgtgcttcgcctttgtgctgcagtttattgagctgccgttccagcttgttgatcaattcgttaattgcggtgtacatatcttcatgtttaccactggcaaccagaacgccgttaggtgtattgattgtggcgtcagcaacaaacccttgtggctctttggacagaatgatatgtggattaatcagatgtgtttgccatttttccagtttggcgagacggtctgcgacatgttggcggatggccggagtaatttccatttgtttgctggtaatgttcattgtcataaattttacctcttgtcttcccgtcttggtgaatttagcataacgttcctgatgtcaaaatgtgtgatggaaatctcataattttgtcactttttgtcaacgaatcttttttgtgagaaatcgcaggaagaggtgtttttttacttgaggaatatctcaaagcgagccatatttgatgagatcgatagtgactaaatcgcttcagtttcacaactaacagaataaaaaaacggcagctcaaggctgccgttttgtgtttcaggtttctgttatgtattgctgctgtttgcggcgatgattttcgctactttttcagcttgcgcattcatctgcatctgacggtatgcattttccatcagcggcagcgcatcacgcgtagcctgggtatccggatagtcgcgcaacatgccttctacgcggttaacgacagcaacccatgcaccacgttctgtataatactcggcaacggagtattcatatttcgccagacgatctttcaggaataccagacgtttggtggcatcggtggtgtactgactgttcggatagccgcgcaccagtttggaaaagtcactaaacgcagctcgtgcatgttgaggatcgcgatcgctacggtcaacgccaaagaacccttgcagcgcactgtcatccagcgccatattggtcaggccacgcatgtacatgacataatcgatattcggatgggtcgggttaaggcgaataaaacgatcgatggcagcctgtgctaacggcaaatcggcgtttttatagtaggcgtagatgagatccagctgcacctgctgcgaatacggaccaaacggatagcgattatctaacgcttccagttgcgttattgcctgtctccagttaccgtcctgcagcttttgttgtgcagtcgcgtaaatttcatttggcggattatcaggtacttcttcctttgaccccgagcaacccgccaaaaacaggcttagtgtggcggctgccaccagatatttcatgcgcgtcatgacgttttgactttcctcaaaatgtaatacgggagattctctgttcctgctcccggttaagaccagctacaatagcacactatattaaacggcaaagccgtaaaaccccaacgataaacgaagaagcagtatatatggcacaacgagtacagctcactgcaacggtgtccgaaaaccaactcggtcaacgcttagatcaggctttggccgaaatgttcccggattattcacgttcgcgaataaaagaatggatcctcgaccagcgcgtgctggttaacggcaaagtttgtgataagccgaaagaaaaagtattgggtggcgagcaggtggccatcaacgctgagattgaagaagaagcgcgttttgaaccgcaggatatcccgctggatatcgtctatgaagatgaagatatcatcgtcattaataaaccacgcgacctggtggtacatcctggcgcgggtaacccggatggtacggtactgaatgcgttgcttcattactatccgcccattgccgatgtaccgcgtgcgggcatcgtccatcgtctggataaagacaccaccggcctgatggttgtggcaaaaaccgttccggctcagacgcgtttagtcgaatctttgcaacggcgtgaaattactcgtgagtatgaagcggtggcaattggtcatatgaccgctggcggtacagtagatgaaccaatcagccgccacccgaccaaacgtactcacatggcggtgcatccgatgggtaaaccggcggtcactcactatcgcatcatggaacacttccgtgtgcacacgcgtctgcggttgcgtctggaaactggacgtacgcaccagatccgcgtgcatatggcccatatcactcatccgctggtgggcgatccggtttatggtggccgtccgcgtccgccaaaaggtgcttcggaagcgtttatctccacgctgcgtaagtttgaccgccagtcgcttcatgcaaccatgctgcgtctttatcacccgatctccggtatcgaaatggaatggcatgcgcctattccacaagatatggtggagctgattgaggtgatgcgcgccgatttcgaagagcataaggatgaagtggactggttatgagtaagctgattgtcccgcagtggccgctgccaaaaggtgttgcggcctgtagctctacccgtatcggcggcgtgagcttacccccgtatgactcgctcaacctcggtgcccattgtggcgataacccggatcacgttgaggagaatcgcaagcgactttttgctgcgggcaatttgccttctaaaccggtctggcttgagcaggtacacggcaaagacgtgcttaagcttattggcgaaccttatgcctcaaaacgagcagatgcctcttatagcaatacgcctggcacggtttgcgctgtgatgactgccgactgcctgcccgtgctgttttgcaatcgtgcgggaacggaagtcgccgccgctcatgctggctggcgtggactgtgcgcaggcgtgctggaagagacagtttcctgttttgctgataatccagaaaatattctcgcctggttagggccggcaattggtccacgcgcgtttgaagtgggggcggaggttcgcgaggcgtttatggcagtagacgccgaagcgagtacagctttcattcagcatggtgataagtatctggcggatatttatcagcttgcccggcagcgtctggcgagcgttggtgttgaacaaattttcggcggcgaccgttgtacatatacggaaaatgagactttcttctcttatcgtcgcgacaagaccaccggtcgtatggcaagtttcatttggctgatataacctaaagaatcaagacgatccggtacgcgtgattttcttttcacattaatctggtcaataaccttgaataattgagggatgacctcatttaatctccagtagcaactttgatccgttatgggaggagttatgcgtctggatcgtcttactaataaattccagcttgctcttgccgatgcccaatcacttgcactcgggcacgacaaccaattcatcgaaccacttcatttaatgagcgccctgctgaatcaggaagggggttcggttagtcctttattaacatccgctggcataaatgctggccagttgcgcacagatatcaatcaggcattaaatcgtttaccgcaggttgaaggtactggtggtgatgtccagccatcacaggatctggtgcgcgttcttaatctttgcgacaagctggcgcaaaaacgtggtgataactttatctcgtcagaactgttcgttctggcggcacttgagtctcgcggcacgctggccgacatcctgaaagcagcaggggcgaccaccgccaacattactcaagcgattgaacaaatgcgtggaggtgaaagcgtgaacgatcaaggtgctgaagaccaacgtcaggctttgaaaaaatataccatcgaccttaccgaacgagccgaacagggtaaactcgatccggtgattggtcgtgatgaagaaattcgccgtaccattcaggtgctgcaacgtcgtactaaaaataacccggtactgattggtgaaccaggcgtcggtaagactgccatcgttgaaggtctggcgcagcgtattatcaacggcgaagtgcccgaagggttgaaaggccgccgcgtactggcgctggatatgggcgcgctggtggctggggcgaaatatcgcggtgagtttgaagaacgtttaaaaggcgtacttaacgatcttgccaaacaggaaggcaacgtcatcctgtttatcgacgaattacataccatggtcggcgcgggtaaagccgatggcgcaatggacgccggaaacatgctgaaaccggcgctggcgcgtggtgaattgcactgcgtaggtgccacgacgcttgacgaatatcgccagtacatcgaaaaagatgctgcgctggaacgtcgtttccagaaagtgtttgttgccgagccttctgttgaagataccattgcgattctgcgtggcctgaaagaacgttacgagctgcaccaccatgtgcaaattactgacccggcaattgttgcagcggcgacgttgtctcatcgctacattgctgaccgtcagctgccggataaagccatcgacctgatcgatgaagcagcatccagcattcgtatgcagattgactcaaaaccagaagaactcgaccgactcgatcgtcgtatcatccagctcaaactggaacaacaggcgttaatgaaagagtctgatgaagccagtaaaaaacgcctggatatgctcaacgaagaactgagcgacaaagaacgtcagtactccgagttagaagaagagtggaaagcagagaaagcctcgctttctggtacgcagaccattaaagcggaactggaacaggcgaaaatcgctattgaacaggctcgccgtgtgggtgacctggcgcggatgtctgaactgcaatacggcaaaatcccggaactggaaaagcaactggaagccgcaacgcagctcgaaggcaaaactatgcgtctgttgcgtaataaagtgaccgatgccgaaattgctgaagtgctggcgcgttggacgggaattccggtttctcgcatgatggaaagcgagcgcgaaaaactgctgcgtatggagcaagaactgcatcatcgcgttattggtcagaacgaagcggttgatgcggtatctaacgctattcgtcgtagccgtgcggggctggcggatccaaatcgcccgattggttcattcctgttcctcggcccaacgggtgtggggaaaacagagctttgtaaggcgctggcgaactttatgtttgatagcgacgaggcgatggtccgtattgatatgtccgagtttatggagaaacactcggtgtctcgtctggttggtgcgcctccgggatatgttggttatgaagaaggtggctatctgaccgaagcggtgcgtcgtcgtccgtattccgtcatcctgctggatgaagtggaaaaagcgcatccggatgtcttcaacattctgttgcaggtactggatgatgggcgtctgactgacgggcaggggagaacggtcgacttccgtaatacggtcgtcattatgacctctaacctcggttctgatctgattcaggaacgttttggtgaactggattatgcgcacatgaaagagctggtgctcggtgtggtaagccataacttccgtccggaattcattaaccgtatcgatgaagtcgtcgtcttccatccgctgggtgaacaacacattgcgtcgattgcgcagattcagttgaaacgtctgtacaaacgtctggaagaacgtggttatgaaatccacatttctgacgaggtgctgaaactgctgagcgagaacggttacgatccggtctatggtgcacgtcctctgaagcgtgctatccagcagcagatcgaaaacccgctggcacagcaaatactgtctggtgaattggttccgggtaaagttattcgcctggaagttaatgaagaccggatcgtcgccgtccagtaatgataaaacgagccttcggggctcgtttttgtctataagttagacggaaaagactatattaaagatgttttgcctgaaaaatgagcgaacaataaagtttttatattttttgcttgtcaggccggaataactccctataatgcgccaccactgacacggaacaacggcaaacacgccgccgggtcagcggggttctcctgagaacttcggcagagaaagcaaaaataaatgcttgactctgtagcgggaaagcgtatcatgcacacccccgcgccgctgagaaaaagcgaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgcccgatggagggggataactactggaaacggtagctaataccgcataacgtcgcaagaccaaagagggggaccttagggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaataagcaccggctaactccgtgcc

SEQ ID NO: 10035 - DNA, 30872 bp, Escherichia coli
gcatcgaccgatccggtgaccattgaagccgaggatctgtttatcacgtcgccggaaggtaaaacgctggccggaccgctgaattttactttgccagcaggccaacgagcagtgttggttggtcgcagcggttcaggtaaaagttcactgttgaacgcgctttctggttttctctcatatcagggatcgctacgaatcaacgggatagaattacgcgatttatcaccggaatcatggcgtaaacatctctcctgggttgggcaaaacccacaattaccggcagcaacattacgggataacgtactactggcgcgacctgatgccagcgaacaagagttacaaacagcgctggataacgcctgggtcagtgagtttctaccgctcctgccgcaaggcattgattcgcctgttggtgaccaggctgcccgcctttccgtggggcaggcgcagcgcgtggcggtggcccgtgcgttactaaatccctgttcgctattactgttggatgaacccgctgccagccttgatgctcacagtgaacagcgcgtaatggaggcgctgaataccgcctctctgcgccagacaacgttaatggtcacccaccagttagaagatcttgctgactgggatgtcatttgggtaatgcaggatggtcagattattgagcaaggacgttacgcggaattaagtgtggctggcggcccattcgccacattactggcccatcgtcaggaggagatttaaatgcgcgctttgctaccctatctggcactgtataaacgtcataaatggatgttaagtcttggtatcgtgctggcaattgtcacgctgctcgccagtatcggtctgttgaccctttccggctggttcctctccgcctcagcggtagcgggggttgccggactgtacagcttcaactatatgctacccgctgcgggcgtgcgtggcgcagcaatcacccgtactgccgggcgttattttgaacgtctggtaagtcacgacgcgactttccgcgtgttgcagcatctgcgcatatacaccttcagcaaattgctgcccctctcccctgccggactggcgcgctatcgtcagggtgaattactcaaccgcgtggtggcggatgttgatacgctcgatcatctttacctgcgcgttatctcgccgctggtaggtgcttttgtggtgattatggtggtgacaatcgggttaagtttccttgatttcaccctcgcctttacgctgggcggcattatgttactgacgcttttcctgatgccaccactgttttatcgtgcgggaaaaagcaccgggcaaaatctgactcatcttcgcgggcagtatcgccaacaactgacggcctggctgcaagggcaagctgagctgaccatttttggtgccagcgatcgttatcgcacgcaattagagaatacagaaattcagtggctggaagcgcaacgccgtcaatctgaactgaccgcattgtcgcaagcgataatgctgctcattggcgcgttagcggtgatcctgatgctgtggatggcgtccggtggcgttggcggcaatgctcaacccggcgcgttaattgccctgtttgtcttctgcgcgttagccgcgtttgaagcgctggcaccagtaacgggtgcatttcagcatctggggcaagtcattgcctctgccgtacggatcactgatttaacggatcaaaaaccggaagtcaccttccctgatacccaaactcgtgttgccgatcgcgtttcgctgacattacgggatgttcagttcacttatccggagcaatcccaacaggcacttaaagggatttatcttcaggtaaacgccggggaacatattgcgattctcgggcgaaccggatgcggcaaatcaacactgttacaactgctgacccgcgcatgggacccgcaacagggcgagattttgcttaacgatagtcccatagccagcctgaatgaagcggctctacgacagaccatcagcgttgttccccagcgagtgcatctgtttagcgccacgctgcgtgataatctgttactcgcctcgcctggtagtagtgatgaggctctggcggagatcttgcgtcgcgttggtctggagaagctgctcgaggatgcaggtctcaacagttggttaggtgaaggcggacgccagctctccggtggtgaactgcgccgtctggctatcgcccgtgcgctgttacatgatgcgccgctggtattgctggatgaacctacagaaggcttagatgccacaaccgaaagtcagatccttgaattgcttgcagaaatgatgtgcgagaaaacggtgttaatggtcacccatcgacttcgcggactctctcgtttccaacaaataatagtgatggacaacgggcaaattattgagcaaggtactcacgcagaactgcttgccagacaggggcgttattaccagtttaagcagggtttgtaagctattattgaacgatccgacttgcgtggagttttgcggtcatgcgcctggttcagctttctcgccattcaatagccttcccttccccggaaggcgcattacgtgagcctaacggcctgctggcactggggggcgatcttagccctgcgcgcctattaatggcttatcagcgtggtattttcccgtggttttctcctggcgaccccatcctctggtggtcgcccgatccccgcgcggtgttatggccagaatcactgcatatcagccgtagtatgaagcgatttcataaacgctcaccctatcgtgtcacgatgaattacgcttttggtcaggtcatcgaaggctgtgccagcgatcgcgaagaaggaacctggatcacgcgtggcgtggtcgaagcctaccatcgccttcacgaactcggtcatgcccactccattgaagtctggcgtgaagatgagcttgtcggcggtatgtacggcgtggcccagggaacactattttgtggcgagtccatgttcagccggatggaaaatgcgtccaaaacggcgcttctggtcttctgtgatgaatttatccgtcatggcggtaaacttatcgactgccaggtccttaacgatcacacagcatcgcttggtgcctgcgaaattccccgccgggattaccttaattatctcaatcaaatgcgcctcggacgattgccgaataatttctgggtacctcgatgcttgttttcaccacaagaatgaatgttttcggcacatttctccccagagtgttataattgcggtcgcagagttggttacgctcattaccccgctgccgataaggaatttttcgcgtcaggtaacgcccatcgtttatctcaccgctcccttatacgttgcgcttttggtgcggcttagccgtgtgttttcggagtaatgtgccgaacctgtttgttgcgatttagcgcgcaaatctttacttatttacagaacttcggcattatcttgccggttcaaattacggtagtgataccccagaggattagatggccaaagaagacaatattgaaatgcaaggtaccgttcttgaaacgttgcctaataccatgttccgcgtagagttagaaaacggtcacgtggttactgcacacatctccggtaaaatgcgcaaaaactacatccgcatcctgacgggcgacaaagtgactgttgaactgaccccgtacgacctgagcaaaggccgcattgtcttccgtagtcgctgattgttttaccgcctgatgggcgaagagaaagaatgagtaaaaggtcggtttaaccggccttttttgcgtctatgagttatggggaataaatattagaggatggagtgttgagtttgaagactgcctgtacggcagtgaaccccggattgatagctatttttccaaaatattctttctaagctgcctgtacggcagtgaacatgagcaaaattgattatcaggcactgcgcgctttctaagctgcctgtacggcagtgaacgtacaaagacgcccagacgcatcagcgccacatttctaagctgcctgtacggcagtgaacccgcgttcgtcggccagcccattgcgcaaccctttctaagctgcctgtacggcagtgaacgggggtattcagtgactaaattcgatcgtatctttctaagctgcctgtacggcagtgaacacctgtttttgttggtgggcggtttggaatccatttctaagctgcctgtacggcagtgaactggaataatagcagactatccgattgatttactgttaaaacttacaaaatcgcagattcaaaccctttttccagacttcaaaatagcaataagaaaatcaatgagttacattacaacctagaaaaagggtcggtttggtatttcttcaatctcatattttctgcatagcttttgataaacaattgaccagaacacatacggtcataatctccgtcccgcgaacagcgtgttcattgcgtaaccaaacaaatcaatctatataaattcttcttgaccgtttcactccaactccctatagtagcgccccgttgccacctatgaggtctggcagcaaaacaatttggtgaggtgtccgagtggctgaaggagcacgcctggaaagtgtgtatacggcaacgtatccggggttcgaatccccgcctcaccgccatctttaaagaagagctcgtacgaaagtacgggctttttttgtatgcggtgggcatggcgcgcataaaaaggcccaaccacatggccaggcctgttaaaaattgcaaagcatcaaaaccagggaatagtggcggttgcgcttaatccataactactaaattcccctttaaccggttctttgagcaaatcaccatgacggataaacaacttgaacagttgctgactcgacaaactcttcatattgagaaaaggtaaatcagtccgctgttcagcctgcgtcgccagtcgttcaattgcctgttcttcagttagccagccttttttcactgaacgccttaacagacgctgagggttacttttaacctgcacgcggcttactactcgccagccttttatttctggaacgggagtgacaggtgaacattggcaatagtccgttagtcctttacgccacgttgaggcttcaagcgcctgcaatgcctgggcgctaccatgcaagcgtaaacgcgctccaggcataacatttacgtcagggaaactcacgccgatatcgccttgccctcttgcacctaatacccgatgcagttttgcaaataacgccgccatcaacatttcgctcgaaaattcaggatctggcagaacgcggatctcaaggtagtgatccattggcagctccttattccgatttctcaccaaagacaccgccacggatcagcacagccatcacgtagtgctgctgctcaacgtctggtttcatccctttagtcacccaattgtccagtaaggtataaaagtcgagtttttctttcggttgacggcaggccacaccgcgactggttacagaaccgtaaggttccacggctatagcccccaattcatcaacctttggatgccaggtatcaatggtacgtaaagcattgccaatcttctgagagtgaataccggcaatgccagccacctggtataacacgcgacttttactactgttgctgtcgagtaccagctcctgcgacggaaaaacttcttgcccggcaccaagacgaacctgcgcttcaacggtaagcatcacccactcttttgcgcttaatccttgctctataatggccgccagctgcgtgaccgctgcctgtccctggtcaaattgacgtaaagagaagtcatggctgttaaaagtccatgacgtctcgttagcagtcactttcacctggatctgttcggcaccaatgcggttgcgccacagaaaacgaccatttgccagattcagcgcatagcgaagcgccagctctttaaagccatgttcgctgatgtaaccttcaatgaccccggaaagcgcctcctggtaagccatatcattacatactgacggtgtggataaattacccagcacacgcagcgtaaacaccacctttaacgtatccgtatctaccggaagcgaagccacatccacccgttgcaggttggctttttggatttcagcatccagttttgtgggatcgctgacaatggcatttttcaggcgattagagatggttccgcggaccgctttctcctgaatctcaatgggttgccattcatttccttgccagttacctgcgtacattaccgcgtcagaggttgccagtttgcgctcaaatgccagtaccgacgccgtttttattgctacaggagcctttgccataattatgtccttattctaaatcgtcatattcattaaaggtaaaatcatcaacaactggcgttgccgaacaatagtagccagtgtccgttgtgcggtaacgccacatcagcgcttgcaagtctgtagtgcgatgtaatccgcgccattcgccaatgccatataccgcttcggcaaaggcaaatggcgtcacggtgtcgcgcgcattttcaacttcaccgggtgcgtaaacaggagaaatgcgttggtagccacacattaacggtaccaggaaaccaggtattggcttcggctggtatacccattttgcgctgttgtcttcagccggagattcggcctgatatttaatcgcggcgaaatcaagccaggcatccagcaacgagatgtcgggatgttgttggtgatgttcagccagccattcactgcgatcgtaaagcgcataacccggcattaaccgccagacgattttacgcagttgcttttcatcttcaggcgcatgaaaaagctgcggatcgcgcatactgacaatgctgccgcccgccagtttgtggctctggcaaagcattttcagatagtcacaaagaacttttctgccatattcaccattggtgatttcgccattacattcaatcagtagagaaaccgtcaagtgcatgcggccctcttcattgaacgaggcggttttaccttctctggttaatgggttacgggtgagagcgaactaaaaatcgcgcccagagctgtacgcctgaatatgctgttcatggcttactaccgcacaaccatcaaaacttacgccaaattcatccacgactttgcgagaaagcgcatggacataaccgagaaaatgggtcatcgacgggaatccccaggtcaacccggagacagcgttagcgttttcgatgcgtatatggggtaacaagagcagataactcatttcagcgcctcctgcaaaacagcttccatttcacgcatccgttgagcgaacagagactggctgcgccactctttttgttcgacagcgcctacgtcaaaactggattttttcaggcgatagttcagccagcgtgcgaaatcatcggcgacagttacttgccagtcgtttttctcacgctcctgtttgaaagtctcatctgagaggcttcgccacgggtccagccaaagttgttggtggcgaggtaagtctggtgattgtgcggaccatccctgccatttttcttgctgaaaagcggatgcctgcatgaacagcaaatcgatcaactcatcaatatatttcgcccgcacagttcggatatggacattatttatgtcaaccttcagtaagtaggtcatctgggcgacaatgcctgaagccgcccgattgaaatcgccgcgtagggaaaaaatactgcgcatgttttgtggcgcgcgatccagcgtcgcccaggtgggcggcattgacggcaacagccagacacggccaccccgcacactattgagcaaagaaatattctgcggttttgtgccgccaaaatgcatttcggcaagattaggaaaccagatatctggctgggagtgccattttcctgctttgcgggcatcgcgaatggctttcgactcctcactaaagcgcacggcggttagcttttcatacatcgcctgcgccagtgaactggaaaacagtgggcataacaggtgataaccatccgcaacagggaaatagatttgtttcgccagtttatggctggaaggccgtccagtagtccatgcctggctaaacccagctacccacagctccagttgcactttatcctctgcaaacgtacttaatgcctgataatcaccacgcttcaggctggcaagcagtgaatctccgttcacatcggtttgtagcaactttgctacgtcaagtgcagcggcgttaccaatcgcgtcagtagcgacattcgccaacgatgctgtgtttaaatagctttcgttagcggaggtttccagataaaagctactggctttagaatcaccatgactgaatttagcgccatgagtgactaatttgatttgcccggcacgctttgccgcatccgttaaccagttacgtggcaagtagcgtgcttcgagttcctgccgctcctgagcgataacgctggcgtcctcgccctgttccactcgctttgcggcttctttttcaaaggcatcgattttgggttgccttcgcgaagcgatgtattcagtaataaattgtattagcgccgttttttccatatcggctccttttcgttaatccatcaagtcgaagttgctccctgatttcactgaaaaatctccgtagcccaacatggcttcagtacaactgacatacacagcaaaagggacaacaccagtggtgatcacacaaacaaactctcctagagatatcttctaaaagatattattaaatctcatgtaatcaccatatgtgatattaaagcaacttaatatttgccacgcaatagttgaagcactaacatacccaaactgccttgagcagcttagaaatagaggtatctccggatacggacttgtaaactgccgtacaggcagctcgcgccccatcacatgttgcgaaacacacctaaccaggggtgataacgccagtcatcgaccgcatcttcttcactgacgggtactctcacctccgcaaacttttccccaacgtttgctatctcacaactttgcttatcagctaaattcaacaaaacgtgttggtaatccatcacgccccagcaagcgacgccgctggcgcatctcacctcttctcgcctgaaattcccttgcgctttacgctcgttgtcgcccgtgcgggaatagaaacgcgcttcgctttcttcatcatccatatgcagaaaaaacaccgcctccggcaaaggggaataacgaaatggcgtctggcgctgcatccagccgttccagcttagcggtgcacgccaccattgcgccgccaccacatgtttgcttttactgctcatcaattcggcggataaacgactatgttctagctccgccagtttgttggcattattggcagacaggatccgcggcaaggcgttaatcgtccggtagtccgcgatcggaatcagttcgcaaatatcgtggctattcagcaagtgttcttttgtttcgaaaccaggcttacaaaatgcgggggcttttttctgcaatgatttgatattgctacgcaaaataaccagattctcactggtcggcacatttctacggtggcgctgaatacgtccggcaaattgaattatcgaacgcatggagcttggttcgataattccccagtccgcatcccagtcacgccccacttctataaccgatgtccccaacaccacaaacagatggtgcgattccggacggttatgtaaggcatctgcgatatcttcgttgttccagaaatcgagttcgttatgacgagtaaaagcgcgatccagtcgcttctcaatatctgaacgcaccgccagcggatgtcgggagtggtaaacacagtaatgaatgcagacatcttctggtgaaggaatggcaatcagggctttggtcaccgcaaccagtggattgatattcgcgaagcgcaccaggcccagcgaaacggttttaccgctttcgtgtcgctggcgatgcgcctgatgcaacttcagcatttgcgtatgcaccgtctgggccacactttcggtaacatcttgtatcgcgcctgatgctgatgaaaccgaagctacacgcccgaaatgcagtcgttctttttcagccagcattaccgctcgtcgtgcaacaaatttggcatgagcatcacgaaacccaggtccgtcgtaaatttgcgtggcatcagcatctttttcatcaaaccaggcgcagcatatattgacaggcctgccgttgataccacaagacgcctgccacatttttcgcccagcaagataagccgcgaacagcgcctgaatcaaacctggcggtaacgtcgcggaagaaagtaatacccgcgttcccagcatcccggcccagttcatcaatcgacataccgcatgaagatcagcaatatcaaagtcatcaggttcgtcgagcactaaatcgctggttaacaggcgcaacatcgccggaagctgtttcccgcctcgcacgccctcggtcgcggaaataagatgatcaatcgtcgagaccagaatcggcgcgcttactaactccttaagtttgctgtcatccttcaaccatttttccagcgccccggtatgcaggctgccttcgtacttaacgaactgttgctcctctgccggcgactcttgcgaagcacttccgcaatcattgtctattttttcctgttgccacagttgattaactgccgccgaaccaatcagtaccgccagctcatcctcacccagcccaagccgactgcgcagagcatcgccggtttgtaaagtcagcgtgcgcaatcccagcgcaacggtaaagcggcacccttctcgctcgtcggcaagtgcatacataatgcgggcgttcgcaaaggttttaccacaccccgtcgaggccatattgacgccgaaaaatccctcttcacgacttcgttcacgtaacgctcgcgccacatcccaggctttatcttgccagcgataattcacatctgtagcccgctggctaaaacctttatgtcgggcaattgccggaagcgatgcccgtgtgtgcatcagttgccgcccaagcagatacgcatgatgcgcgacgcccacaaggtgttcgtctacccgttgtttgagcgtgccgctttggcgatcgctatttgcccagacgatataatccgggtcctgccatttttgctgcgcatcgcttgaggaatagtaatgatcggcaagcatcagacaaaaacgcgccatatgtaaggggaacaactgttccatctgcccatatgtctttaaaccgagcgcgttgcttgcccggcgggctatctgacgcgctttttcccgccagctcgcgctttgaagcggcgttcctgatggaaactgccagacgtgcgcaaaatcctgttgtgaccagtcatctctgcggtggttaacggcattccagtcagcattaagttgcttctccagccaactttcacaccctttacatgattgttccgactgtggagaaagattctccggcattcgatgatgggaaaggatcagccagcctaccgttttggctaatggttgcagcgaactgaacgggctatttgaaaattgaggagtgtctttttgcaggcgctcaagaatcgcagattcatcatctgccgtgagttcgccaagcttcgccagccacacatcgtcgggccgctcaccgacaaacgtctgaaagagccgcagtgaaatccattcatgtcggtaaggttgataactgcgggtattcttttgagtcaggctttgctgaaagctgcgtcctgatttaccaaaatcatgaaatagcccagcgatagccgccagcagtgcaatactttccgcgcactgccagcgattttcttctttgttcaccaggctgatttgcgttgttcgatttgtgggaacgcggccttgagcattaaagcgacgaatattgccgacaatccacatcagctccgtttgcccattcttcttcagccagtgacaagccactgcggtatttcgcctggcggttttgcgcagtaaacggcggagtgtattaacgccttccagagtaatcaccgtttgccatgctgcgtcaccagtgcgttcggcaaactgatcaataatacggcagctttccacgcgagcatttttcgtacagcgtgagataattaggacattcattggtcagccttagccagtgcctgggccgtttcctgcagagaggtgatcatgacatccagcgcatccgcttgttgaaagatattaacacagcgttgacgaaactcctgagcatcttctcccgccattgcggcaataaatgcttgcggcataacaagagcatctttaatcagatcggcaaggtcaaaaacaagcccgccgcgacgtgtcttaccatgcattacagctaaaccgtgcgggatacctgttacccacgccgccactgctgccagtccataagccagataattcccttgatcgaggaagcggttggccatatcgataccaccgccccgttttgcgcgagtgaaatcgccataccccacggtttgactgaccattttgtataacgctttagtcaatttggcctcaacgagcataagctgcgtatggttttctgccgcgtctatttcttcacaagtacgattcaggagggtatgcagcgcattaacatcaggttgaaatgcgtgttcacgcagcattttcgagctggaccagtgcttatcgatatgtgtcaggcggattaactgaaaacgtttcgcggcagcaagtcgtttgtcttcaacaaaccagaaagaaacccactgctggagatactctgtagggcgatattcactttgtgggctgagccaggagacatcaacatccacttcatttgctgaatacagcggcgtgccatccgtaccacaaaagcctaccatcaccccggcatgagcaaattcacgcatcgccgcctgggtaacggaagttcccattcccagcatcaacgccgtggtattcgcaatggggatattccagtagtacgactctttaccttcgctggtaacatactccacccgcccaccattcacctgtacccggcatttttccagataataaatattggcgcgtttggagtggagaatggttttgagatcggaaggcgtaaggtaattcgaagacataaacacatcctgtgattattttatatttgaaggtattgggcttagtacagcattgatttatgtgctgaaaattgatttccatcgcaattattacgattgttattgcgtgctaacgctaatggtttgaagttgagagtgtcattgcacgaccaaacgtctaacactatcgtagtgtgaatactgcctgtacggcagtgaacaaggagagacggtcgcactcttcaacgttcagtttctaagctgcctgtacggcagtgaactggcggcaggagggaggactgctgcgccatcatttctaagctgcctgtacggcagtgaacgcagagattgagccattccccgcagccgtgcttttctaagctgcctgtacggcagtgaacccgcgcggctgaaattgagagcctccggctgatttctaagctgcctgtacggcagtgaaccaataaaatatcaaaggcggttttatgctggctttctaagctgcctgtacggcagtgaacttgtgcctgttttatgcgggcgctctggtttctttctaagctgcctgtacggcagtgaacacgctgcgcagtaccctgaccggtgcgaacgttttctaagctgcctgtacggcagtgaacggtttcgcctcaatgatctgcatatggcgtcatttctaagctgcctgtacggcagtgaactcaaatactacacgtttagcccgttgttaataaagcaaaaccatctcaatctcctgctgccacccttttttatccttacctacccgcagcactaattatcaataacttagcatcatcattaaaaaaagggtctgaacctcctccccccataaataaaaagtccgtaacccctgacgagatcacggacttaaccaacctacctgacaatcagattaatgcgctgcttccgccttgtgcttttgtgcactctggaatccgtaagtcagctcatttttctctttatccagcgcgacggtgacctgaccgccgtccaccagcgaaccaaacagcagttcgttggcgagcggttttttcaggttgtcctggatgacacgcgccatcggacgtgcgcccattgcccggtcgtaacctttctcggccagccagttacgcgcttcctggctcacttccagagaaacacctttctgatccaactgaacctgcaactcgacgatgaatttatccaccacctgatggatcacgtcggttgacagatgatcgaaccagataatgttgtcgagacggttacggaattccggtgtaaagatcttcttgatctcttccatcgcatcggtgctgttatcctggtggataagaccaatggatttgcgctcggtttcacgtacccccgcgttagtggtcatcaccagcaccacgttacggaagtccgctttgcgtccgttgttatcggtcagtgtaccgttgtccatcacctgcaagaggatgttgaacacgtccgggtgcgctttctcgatttcgtccagcagcagcaccgcatgtggatgcttgatgaccgcatcagtcagcaaaccgccctgatcaaaaccaacgtatcccggaggcgcaccaatcagacggctgacggtatggcgttccatatactcggacatatcaaagcgcagaagctcaatgcccaacgctttcgaaagctgtaccgtcacctctgttttcccgaccccagtagggccggcaaacaggaacgaaccgaccggtttatgttcgtgacctaaacctgcacgcgccatcttaatggcttcagtcagcgcctcaatggctttatcctgaccgaagaccagcattttcaggcgatcgccgaggtttttcagggtatcgcggtcactctgagaaacactcttctctggaatgcgtgcaatacgggccaccacggattcaatatccgccacattaacggttttcttgcgtttgcttaccggcatcagacgtgcgcgagcgcccgcttcgtcgataacatcaatcgctttatccggcagatgacgatcgttaatgtatttcaccgccagctctaccgccgcacgcaccgcttttgcggtataacgcacgtcgtggtgcgcttcatacttcggtttcaggccattgatgatttgaacagtttcttcgattgacggttcagtaatatcaattttctggaagcgacgcgccagagcacggtctttctcaaaaatgttgctgaactcctgataggttgtcgaaccaattacgcggattttaccgctggagagcaacggtttgatcaggttagccgcatcgacctggccaccagacgctgcacccgcaccgataatggtgtggatctcatcaataaacaggatgctattagtgtcttgctccagctgcttgagcaacgctttaaaacgtttttcaaagtcgccgcgatattttgtgcccgctaacagagaaccgatatcgagagagtaaatcgtacagtcagccatcacttccggcacatcgccctgaacaattcgccatgcaagcccctccgcaatcgcggttttaccgacaccagactcccccaccagcagcgggttgtttttacggcgacggcagagaacctgaatagcacgctccagctccttctcacgaccaatcagtgggtcgattccgcccactcgcgcaagctgattcaggttcgtcgtgaaattctccatacgttcctccccaccagcttgttcttcgctgtttggctggctgccaggatcagaagactgtgtcggctcgtctttactctttacgcgtgccatgagagataaagttcaccacatcaagacggctgacttcatgtttgcgcaacagatatgccgcctgcgactcctgttcgctaaagatagcgaccagaacgtttgcaccggtaacctcattgcgaccggaggactggacatggaagaccgcacgttgcagtacacgctgaaaactcagcgtcggctgtgtgtcgcgctcctcttcactggcaggcagaacgggtgtggtttgttcaataaaggcttccagttcctgacggagcgcaaccaaatccacagaacacgcttccagcgcctcccgggcagatgggttactgagcagcgccagtaacaagtgctcgacggtcataaactcatgacggtgctcgcgcgctctggcgaaagccatatttaaactgagttccagttcttgattgagcataggcacctcccccaatttttatgcctgcattcaggctttttctagcgtacacagcaatggatgctcattctccctcgcgtacttgttcaccatcgccactttggtttctgcaacctcagcggtaaagactccgcaaatggccttcccctggtagtgaacagcgagcatcaattgcgttgcacgttctacatcataagaaaagaatttttgtaacacgtcaataacaaactccatcggagtataatcatcattgactaatatcactttatacatagatggcggttttagcgcgtcgcgaactttttcttccgccagttgatcaaagtccagccagtcgttcgttttacccattgtcagttatcatcttcggttacggttatcggcagaacgccctgccgctgacaagagcttatttgcctgaccaatttactccacatgatagataactatcatttatatcatttagttaattagtctttatttttcattatgttgcaaataacaagcctgtcaaaaacagtgatattaactacaccattaactacaccgcttcacgaacaatatcgaacaaccgcgaacaaagatcaacacgctttaatcattatcattttccggctatccgtcatgaagctagtggatgatctgcgtggtgatttccaccattcagagcaggggcggtcatcatgcccatgccataacaaaaaccccatattcgtggtttttctgtgttgtggctattctgccgttgccgtgctggtggatatttccgttatggggatcaccatatcggcatcatgcccaccagccagcgcaattttgcgcttttctttaagttcagcaagttaccgcgccggattacgccaatggctgtttccgaaagaatcaacgggttaggccttaatgggctgcgtggtaattatcagcatccagaatatgacgggttatgtttccgacctcctcaatttgaggttcccgaaaatatcaacgggttaggctggtttccccgatgttcgccgctggcgaatttcgaaaatatcaaccagttaccgccgcaaccgctccggcttcttccagtggtacgtaattttctccgtttcccgatacagtgccacgcggcgattgtaggccagcatttcaagaacgcggatccgtatgttgcgcatatccacatcattaagctggataccatcacggcgcatcacctcagcaacaacacgcgcataattttcggctgtcacgctgtccggctgcgtggcctgttcgtcagtctgctggctgattccaccagcacggcggattaatcccagtatttcggcttctgtcattgtgcacccatcgttctgattgtctggtgtcgtcgggtccttcctggaattatggacccgttacggggcggcgacctcgcggtttttatctgtttatgaaaatttttctggaaaaagcatgtcggtacttctcgaacataactatttgtttttaaatagatacacaataaaaagaaacgacacggtaatcatctaaaatggcgatttatgacgctttcatgtcgtttctcagttttgttcaataattgcgcgtctgttactcgcctttcttctgtagcaacttttccggtacgtttccggttgtttctttcaagtaatcagccagtatctgtgggaggttgtcggcaactctggcactggcattacaggctttaaccacttcccttttaagcctatccagcatggcgggggtaatctgtgggaagctcctttgcatagtaagcgggaggctgtccatgattgatgaaatctgactcgccagctttgaaagcgcgtacaggcaaaactcagtatcaatcacgtcaccgcgatcgcgctcgtttttaagttcctgcgcctccgcctgtgctgtcagtaatctgatcctgactcgtaagagttcatcatcatcaatatcgcctttgtcgtttgtaagctggctaattgcattgttaaccctattgtctatcacgctggcaacatcgtaaaacgcctcacggcctttacgttcaacgggagtcactccccacttgtcgaacgctgtcgcacttacacggcagcttttcgccatgttttttttgttcatcaggtgcgatttcattaatacaccaacttaattactgcttcaggttggtgtattgtttgcatctttcccttttcattcataaagatagagcaaacaacaaaaccaccaccacccccctgaaaaggctcataaatagcgaaaaaccgcgaggtcgccgccccgtaacgggtccatatgccggaaaggacccataaaaaaaagccggatttctccggccttgtctcagatggttttcagtatgcgatcgatgtcgccgtcatcgccctggtttctgccatcgtatgccatgccagctgatacggcttgcgggctgtgcatgtccataaagttttcaaaggctgcggtaagttccggcgcaaccttcggacgttcctgctctatggtcatgctaaggatgcttttagccgtaccaacatcgatacaaggcacgtttgccattgcacgtaacagcggctgatagtcgccagattcatcaagcgccataatcgcatcagcgcgcggcttgtcctgctcttccagtttgttaagttgatatatggcctcgtaggttgataaccctctgtcagccattgcccgcgcttcggctttaaatttactcgccagcggtagcgtcatgatgctttcattcgttgccatcgttccccctgcttatcgggccagcggctgaacggatacgccagaacccgcaaaggcggcgcattttttcgcatcggtgtcgacgctctcaggccagttaacggcggcaatattgaatatccccgtcttgtaacactgtgctgatttctgctttgacgtgtccacaggatacgaagtcagataaacagccttgccagattcctgaccatcccacggcttaaactcgccattgtccgccagcatcagcggggtaaattcctgaataacgccagcatcagcggcaaaatgtaccagcgtcgtggcgacctgctgactgcctgcaaataactcaatgtatggagtgtccatagaatcccccgttaagcaattttgacggtaacaaatttgcgaatatctgccggaaccggctgcggtgcgctgtgcgtctgcacgtactcaatcgccggatcgccgtcctcaatccagtttttcgggtaaaacatgttttgcgttgcgcccgttcttactgcgtcctgatccataatcgcaccataggccaccagccctttattgttggtgttgcccaggacaagcaaatcaggctcaaggaaatatttttctgtgccgtcgctgtcggcgtatttgccggaatagacgataagggcaatatcgcccagatagcctttaaagctcaccacttcgcccaggtttttacaggccagctctacggcggactctgaaccacgggaaagatcgtacagctcacggaattttttaaagctgcgtaacgtgcgccatacctcagcgcccataatcatgacgtttgcggggcaaccagcctgatcagcataaagctcgatgtcatagattggatcgtgtgtttccttatctgcctctgaccactttttacccggtccctgtctggcgatgtttttacttgggatcttccagtctatttcatagcgttctatgccttcgccctcaatgatgttttttccggtcgttatcgcattcaccgccagccattccacgcgcgctttaatggcgtttatctggcggcgcatgttgccagtaatcaggcgcatacggcggtaggtagggtcgttaagctgtgctggatcttctccagccatgcgcatgatggtttttgttggatcgatttcgtgctttggcttcatgtagccaggtttgattgtgctggtttcgtaccctttatcgcgctgaacctggctacccaccataggcgaacaaaacgccgacatggtgacttcttcaatgtccagggtatccagcatgatgttttgcgtgttgaatgtcgccacgttcgggaaaaacagcgtagtaaacagagggctgaatttaaaatccgcaatatccccgcgattcaggtacatgaaaagctggttagtgttaagtgccgttgctttgcctgccattattcacccccataatttttatgcatcccaagcgccgcaagtaaataagagcgtacaagtgaacctatcgacggctccggcgtcatcagcggatccagtccagccgctacgccagcctcatagttttttttgtggcgctgcttgagcacctccacgatttcggggcttatgtacaccgaaacaccaccttttttctcttcagccatagtaagaaattcctcttcgacttaaaaaatcataactggatgttcatccagctctgattataatcaggattgcattttgtgcaatgatattgagttgtgttgcaaattatgaaatgatgatcccgatcatgtgtgtcagtgcaccaaaaagcctcatatgcaaaagcccgataagccacctctgaccttatcgggcttttttatctgcctgcaaagatgtcgaacaaaaattaaccacaaccatcatcttttttgcatcaaaacaattaaaaacaataaattacgctcatgatgatgatgacgataaaatcacaaaaatgcgcttttttccgcgcctcccgccccgtgttcaggcccaccccgccaggaggacccgtaaaaaagccggattgctccggcttctgtcactcgtcgcttaaaacggtatgttatccccgtacggatcatcattccccgcctgttgttttgccctgttcagcgcgtcagtagcctggccctgttgaccttttttgccgcccagtcgcgccgttcgcgcactgattacactgtctgcgataacctgccagccctgccgcgtttctccgttctgcccagtccactggctgatctgcatgttacccgccacgctcaggagttcacccttgcggtgcctttccagtgcttcggcctgtctgccaaatgccaggacggataaccacatcgtcgccgttccgtcatctgcctggctgcacggaagggggaccgccatacgcgccagcgtcatcggtgtgcccttgctggtctgttttacctgcgggtcgtccaccagccgcccgtaagcggctatctgtgctgtcatgattccacctctccggttttaacgttgatggttgttacctgttccgcttcggcaatctcccattctgtcagcgtggcaaagtttgccgccgctgtggtcatgaatgcgcttatcaggtcgggatgtgctttcgcgtatccttcccccgtgttgcggtcgatgatttttatcgccactctcagccagtgctctgtaaggtcaatggcgcggttatgctgcttcttctgattattaagttttcctgatgtgcgcatttttatttttaccccctcgtttaaaaagttttgagttgtgcctccccttgtctaccttatcaaccttactggccaccatgccagtaatggcgcggctttcagtggggtagagtgcttttatccactatctaccccgtatctacctccctgtctgattcaggtaaaatcaggtagagagggtagatagtaggtagacagtaaaaaaaggctgtctacccaagttaatgtactgaattaaatgtatttttctttactctggtagacagggtagacagccattgcaacaaattataaaaacgcgtcgcaatcgtctgttgttattgcgttagtctgcgttactcctttaactttccgcgtaatatattcatgtccgtaaactttcgcggctggcttcatagccttgccaaagtcatttacgtttagcggtttgctcctgcctgcgtacgccataaacgccagatagacgcggtaaaggctgtttctggtcgtgtacttcactgaatcgccaccgccgcccatcatcaggccgcgtgcttcctccagaaaattcaggaactggcaaaactcaataaccggatccgtctgttgctttattgccagtgcttcatcaccgtcacgctgttcaatgagtaaagcccgtgccttttcagggtcggcaaagttcgccagcaagcggcggataatgacagggatttcagccgcgatcttttccggtagctccctgtctttttctgcctcgcttacgatgttatcgaaccggaatatcacccgacgacgtgccacacctccggcccgttcggtgaatatcatcggattgttattggttgccagcaccaccgccctgattaccgccgtaaaacgcttttcatatttcgggttaatttccacggggtcgccgcccgtgattttcttgatgcccgttccttcgcctgtatatttcggctggtctgccaggacgataagacgactcccgacaacctgcgcacgcccaccagcatcatcaagcgatgtcatttcagcgcttaccgtgttttgtttccctgccagaaggctggctatgtgtgtgaatgtacttttaccgctcccgccgtctccggtggcctcaataaacatctgccagtcgtaccggttcgccataatcatgtacagcgcggcacatatacgcatcatcttgcgcgggtcttttccggctgcgtgctcaagccatttatgaaagtttggcgcgttatcgcggatgttctccccgggtgctggtggcgtgtactcaatgccgttgtgcgtggtgatccagttctccggcgtgtgcggggaaaattcccccgttttcaggtcaagcgcaccattggcgaacggcagcaaatcgccggacggctcgcccattggttcggcaataacttttaacgcttccacggcgttattgattacgcgcttgctgaaagtggccctgtgctctgaatagatcgccaccatttcgcggctcagctccattgtgctgaccggacaccataccccgccgcgccatacgtgaacgatttcactttcaggatgcacacaaacgccatcaaagcgctcggcaagcagctgcgcacgctcactgtctgccatttgtgccagttgcgtatttttctgctccggcatggtaagccctgcggcaatattttcacgctcagcattcagatagcgccgccagttttcacacttctggacgtgcattccttcggggtaaaaatttgcgtcctgaatatctgccgccgccagcttctgaccaatctttttggtctccaccaaatccagttctccggcctggtacagccttacgcgctttttcccatccggaacaattttcagtgcatcaagttcggcaagctgatttggcccaagccacacaggcggcacattatcgccggatgcggggccatcctgctcctgccattgtttcgcgtgcgaccaggcatcactacccgcgaaaataattacctctgtgtctttgtgttttattccgcgtggctgtttttttacgttcggtgccagtttcattttttacccctgaatacgttaagcatcttttttatttcctgaatattggcgcgtgctttctccctgctggttggtttactgcggggcgctgcctgtaccagagaaaaatcacgccgaaactgataaacaggcatcacgcaatcatattcgtagccttcacgacggtaggtgatgcgccgttctgccacgcctttaatcgttaccatgccgccatatttatcgcggtaaatatcgccgttcataaattcaggacgagcggggccgctggcagtaacgccagaatttttatttttcatgttttttattctccggtgtgctgcgctttattattctcgtgaattgccatcactgtatttaattcattaataacaggcgttaatagcgtacgcacggcagaaaacatcattgaatcagattcatcgccactttccggcacatcaattaacttaagtagtaatgcgtccatttcctttgcgcggattaatgcgttttcagaatgaacaagaacatcaaagggtattttatgcatgactcaccccctggcgaatacgggcagcgaataccatcacgcagccatcaggagattgctgacgcgcttcctgttcgctggtggcctcaatggtaatcacgcgcggttgtgcagtgctcagggtgataaaacgccagatgtatttattcaggttgtgcgagtcccgcccttgcgggtgtgtggtatgatttctcatagctacctcgatactttcgctatcgttggtggttagaagcccggttagtgttagcgcactgccgggtttcgtcgtttctgcaccttgcgccaacaaggtgttgaacaccaatttaaacccaggtgttaaacacgtcaagtgttgaacacttattttttttcctgcatactgcatttgttttttatgaggggtacaccacatggcgacaaaagcagtaaacgcaaaatcacaaaccgttgcggcaagggttccgcatgaagttatgaacaatgttgaggcggtaaaaatgcctggcgaaagtacggggcaatttgttactgcggcattaaaacgagaagttgaatatcgccagcggcgcaaggccaaagaaccagagtaatcaccatcagcgccgtggtgtaaggtattacggcgcattgctatgcaggacaacacaatgaccgataaagaattgaccaaaacattatcaccggcacggaaaagacggcgcagaaagatagagcatgaatcagaaagattcgcgccatgtgcttttgcccttgagcaattccttaaagagtacagggaaaagcgctcattgcaggtatggcaacgaactgaaccagactgattgcattgcccaccagccgcaaatgtggcattgttggtgatgcgttcaagtttagtgtgtatccattggcgaccgcccccggtcgcctttgttttatatgtcatatgctcccctttacgctgccttacctgaattaatgcgatcccggcttttaacccattccataacctcggacagcagccaacctacagaacgcccaccaagattacggcgagacggaaagctcccttttttctccagttcgtagcgtgtagtgcgacacactccagttaacttacgacattcatcctcacggattacgcgatcttcatttatttcacgcatacaaaaacctacataaaaattacgtatataaacttttctcttagctgtagatatatgagatcggatattacttagattctttttcacctattaaattaaaaacacaaccatgctaaaggctttgttcgctaaggttcgtagaagctcgttagtgtttaaaatcgtgtcacgagtttttaagcgacgcaacaaaaaatgtcgtcatttggcatgacacctgaattacctcattaaaaacaaatagataaaacatcaggtgttggaacaatcaagaaacagagaataagaactcagaagaagacatttcaatttttttcgatagttgacacatataaagagaagatatttgcagatattccccgatattctaagatctattcacggctgtaatctcttaaagaaaaaacagccgtaatttgtcaagaattttgggggtaaattcgcggggtcataacaacgattttttcatcattgttctggagaagctcgagacggtctacccatagattaagagcatcacgttttgcatcaaggtagcgggagtggttatagactcgttgcatccctggcatctggtgggctgtaagctgctcgacaatatgcggatccacgcctaaatcgttcagtatggttgtaaatgtgtgccggatatcgtgtaacgtccagggggcttgattaattcgtctgtgcgctgttcttccgtactctgctaccgaagattgtcctttcagttcaccaagcaataagcctgtgtgtctgttctgctccaccagttgcgtgacgaacggcaaaatgctttccggtattggcctgaatatggcgaccttcgttttgctgtgctccttcggtactgtccagagcatttctttaaaatcccactcctgcacctcagagcgccttagctcagtggtacggcatccaaaaacaatcaggaggcgaattagggcgctgtagtatggcgggaatattttgtcatccagggcgcggagtaattccccaagctccttatttgttagtacgcgctcgctcacttctgctttttttcccacatcaccgacaaccatatcatcaagaacgttgctgattgcgtatcgtcgttttcggcagtacttaagcgcctgtttgcatacctgtagcaaaaatccggcagatactgggcttcgctttgccatctggtcaaaacatgccaaccagtgccgtagctcgcatttttccaacggcaaagcgccaatctggctgattatgtgtttattgatccggcttttcagtgattcgtagtcagtgcgcttttcctttgcatacgattcaagccagtaagtgagcgcttccttaactgtcacgggggctaacgcatcctgtacagcacgattaagctcatagcgcggatttttcccctcagccagccaggcgcgacactgtgctgctttttccctggctgctttcaggctcagatcgggataattgcccagtctcagacgttccggtgatacctgcctaccagttccggccctgtaagtgaaataccaggttaacaggccgctggtggaatgtcttacgctaagattgccaccgtcattaaaaaaggcgttttttgtggttggtgatccgcttaattttcgtaaaagagtgtcgctaagtctatgaattgcgctgctcatgtttcgcgtttccggtcatcaaaattaactacaccattgactacaccgtgcatcgtacaagggcaaaccgtgacgaacaagagcgaacaaggaaaacaaaattttcctttataatcatagcaatgaatgcacacaaaacactaccacgaacacccgcgaacactagatgataaataactatcatctatcgttagcatcagcgacatctgtcacattcctgtcaatagcgttaactgcttcaaatttttgattcatacctgccccctggcccctgtcaaatgcttgacggctcgccctaattctctaaattgtatttctagagttggcgaggttttgaacagccccctctctgaccccggtttattccatcttacttgtataagatttgcgaaggatgtcgaagcatggaaaagggtactgttaagtggttcaacaatgccaaagggtttggtttcatctgccctgaaggcggcggcgaagatattttcgctcattattccaccattcagatggatggttacagaacgctaaaagctggacaatccgttcagtttgatgtccaccaggggccaaaaggcaatcacgccagtgttattgtgcccgtcgaagtagaagcggcagtcgcatagctcttctgtctcattgtgtacatcctaaaggcaaaatgccagcccgatcggctggcatttttatctcaaaaattactctcgtgccagagcatctactggatccagtcgtgccgcatttcgtgcgggtaaccagccaaataaaatcccggtgaccgtcgagcagagaaacgccagcagcagcgctaacggtgaaaaaccaatctcccagccgggtaagaaaagctgcaaggtgaaagcaattaacagtgacagtgttattcccaacgcgccaccaaccaggcaaaccagtacggcttcgatcaaaaactgttgcaaaacatcgcttgctcgcgcacctacagccatgcgaatgccaatttcccgcgtccgctcggtcactgacaccagcataatattcattacaccaataccgcccaccaccagcgaaatcaccgccaccagcgtcagaaacagttgtaaagtacgtgtggtcttttcaacggttttcaagacgccatccatgttccaggtaaagaaatccttcttaccgtggcgcagtgaaagtaaacgcgtgagttgctgttccgcctcagcgctgtcaaagccttctttcaccctgacagtaatggagttcagccacgactgccccataactcgcccggacatcgtgctgtatggcagccagacacgcagcactttactgctaccaaacatcgactgtttttcttccgccacaccaatgactctggcgggcatattgccgaccagaatcacctcgccaaccacatctgctttatgggggaaaagctggcggcgagtattactgtcgagaaccacgacctgcgcacgaccgttcagctgctcctgattaaaggtgttcccttcactgaaggtcatgccatagacattaaaataatcgccgctcacgccattggcactggcagccacatcaacattgttataacgcaggcgcaggttttgcgagacggcgggcgtggcagaggcaacccacggttgtttttggatggcgattaagtcgtcgtacttcagcgcctgctgatattgcggatcgtcatcgccaaaatctttcccgggatagacatcaatagtattcgtaccaatagaacgaatatccgccagcaccatttgtttagcggcgtcgcccaccacgacaatggaaaccaccgacgcaataccgataataatccccagcatggtcagtaaagtacgcattttattcgctgccagcgcccgccatgccatcgtcagcgcctcgttaaaaccgctgacaaactgccgccagccagacgccgtgttgacaacaggttccgttccgccagtagcattcactttttcaacggcgggaggattgcgcacaatttcgccgtcgcgaatttcgatcacccgctcggcctgagcagcaacctgcggatcgtgggtgacgataatcaccgtatgcccgcgatcgcgcagctgatgcaggatcgccatcacctcttcgccagaatggctgtccagtgcgccggtcggttcatcggcaagaattacctgaccgccgttcatcaatgcccgcgcgatgctgacgcgctgttgctggccacccgaaagctgtgccgggtaatactctgtacggtcttccagccccagtcgttgcagtaactcctgggcgcgaagcagccgctgtttccgctcaagaccggcatagacggcgggtacttcaacgttctgctcggcggttaaatgcgaaagcaaatggtaacgctggaaaataaagccgaaatgctcgcggcgcagttgcgccagcgcatcggcgtccagcgtggcaacatcctgaccggctacgcgataggtgccgctggtggccttatccaggcagccgagaatattcatcagggtcgatttaccggaacccgaagcgccgacaatcgccaccatctcaccagcataaatatcgaggctgatgcccttcagcacctcaacctgctcatcaccggcaggatagctgcgacgaatatcctttaattcgagcaagggtgtcattgcgcagctcctggtttggcctcaccaatcaccacttcatcgcccgcttccagccctttgacaatctcaacatcggtatcgttacgtgcgccaatcgtcacttcacgctcgcgtgtttcaccattacgcaacaatttgactttataacgattatcgccaaccggatcgcctaacgccgacagagggatcgtcagcacatttttcacatcggtgagctgaatatgcacttgcgcggtcatatccagccgcagtaaaccattggggttgggtacttcaaaacgggcgtaatagaaaatagcgtcgttaatcttttccggcgtcggtagcacatccttgatttgcccctcgtagcgcgtcagtggatcgccaagcaccgtaaaccaggctttttgccccggcttcaggtggattacatccgcttcagaaacctgcgcttttaccagcatggtgctcatatctgccagcgtcagaatgttcggtgcttgttgtgcggcaatcaccgtctggccttgcagagtggtgatttgcgtgacttccccggccatcggggcaacgatgcgggtgtaatcgagattggttttagccgtatcgagagaggcctgattgcgcttgatttgcgcgtcaatggtgccaatttgcgcctgtttcacagccatctccgtcgcggcgttatcgagatcctgctgtgaaaccgcttgcgtttgtgcaagacgttgctgacgggaatacgtcacccgcgccagtttcagctccgcttccgcctgctgccgctgcgcgcgtagctccatcagcattgcttccacctccttgatctggttttcagcctgttcaggatcaataacccctaaaagctggtctttttttactttatcgccaatcgccaccgacagcgttttcaactgaccgctgacctgcgcgcccacgtcaaccttacgcagcgcgtccagctttccggtcgccagcacgctttgctgtaaatcaccggggcgcacaatcagcgtctgataagtcggcacgggtgcgttaagaattctccataacgtaatcagcccggcgatgactatcaccatcgcaataacgtaacgcttcttcacggttttccgctttttcataaatattctgaatactccatatg

SEQ ID NO: 10036 - DNA, 29397 bp, Escherichia coli
tgtcggtatcaacctgccgggcatgccagcaccggcaaagcgtgaagcctacgctgctgacatcacttacggtacgaacaacgaatacggctttgactacctgcgtgacaacatggcgttcagtcctgaagaacgtgtacagcgtaaactgcactatgcgctggtggacgaagtggactccatcctgatcgatgaagcgcgtacaccgctgatcatttccggcccggcagaagacagctcggaaatgtataaacgcgtgaataaaattattccgcacctgatccgtcaggaaaaagaagactccgaaaccttccagggcgaaggccacttctcggtggatgaaaaatctcgccaggtgaacctgaccgaacgtggtctggtcctgattgaagaactgctggttaaagaaggcatcatggatgaaggagagtctctgtactctccggccaacatcatgctgatgcaccacgtaacggcggcgctgcgcgctcatgcgctgtttacccgtgacgtcgactacatcgttaaagatggtgaagttatcatcgttgacgaacacaccggtcgtaccatgcagggccgtcgctggtccgatggtctgcaccaggctgtggaagcgaaagaaggtgtgcagatccagaacgaaaaccaaacgctggcttcgatcaccttccagaactacttccgtctgtatgaaaaactggcggggatgactggtactgctgataccgaagctttcgaattcagctccatctataagctggatactgtcgttgttccgaccaaccgcccaatgattcgtaaagatctgccggacctggtctacatgactgaagcggaaaaaattcaggcgatcattgaagatatcaaagaacgtactgcgaaaggccagccggtgctggtgggtacaatctccatcgaaaaatcggagctggtgtcaaatgaactgaccaaagccggtattaagcacaacgtcctgaacgccaaattccatgccaacgaagcggcgattgttgctcaggcaggttacccggctgcggtgactatcgcgaccaacatggcgggtcgtggtaccgatattgtgctcggtggtagctggcaggcagaagttgccgcgctggaaaatccgactgcagagcaaattgaaaaaattaaagccgactggcaggtacgtcacgatgcggtactggcagcaggtggcctgcatatcatcggtactgaacgtcacgaatcccgtcgtatcgataaccagctgcgcggtcgttctggtcgtcagggggatgctggttcttcccgtttctacctgtcgatggaagatgcgctgatgcgtatttttgcttccgaccgagtatccggcatgatgcgtaaactgggtatgaagccaggcgaagccattgagcacccgtgggtgaccaaagcgattgccaacgcccagcgtaaagttgaaagccgtaacttcgacattcgtaagcaactgctggaatatgatgacgtggctaacgatcagcgtcgcgccatttactcccagcgtaacgaactgctggatgtcagcgatgtgagcgaaaccatcaacagcattcgtgaagatgtgttcaaagcgaccattgatgcctacattccgccacagtcgctggaagaaatgtgggatattccggggctgcaggaacgtctgaagaacgatttcgacctcgatttaccaattgccgagtggctggataaagaaccagaactgcatgaagagacgctgcgtgagcgcattctggcgcagtccatcgaagtgtatcagcgtaaagaagaagtggttggtgctgagatgatgcgtcacttcgagaaaggcgtcatgctgcaaactctcgactctctgtggaaagagcacctggcagcgatggactatctgcgtcagggtatccacctgcgtggctatgcacagaaagatccgaagcaggaatacaaacgtgaatcgttctccatgtttgcagcgatgctggagtcgttgaaatatgaagttatcagtacgctgagcaaagttcaggtacgtatgcctgaagaggttgaggagctggaacaacagcgtcgtatggaagccgagcgtttagcgcaaatgcagcagcttagctatcaggatgacgactctgcagccgcagctgcactggcggcacaaaccggtgaacgcaaagtaggacgtaacgatccttgcccgtgtggttctggtaaaaaatacaagcagtgccatggccgcctgcaataaaagctaacagttgaagtaaaaggcgcaggattctgcgccttttttataggtttaagacaatgaaaaagctgcaaattgcggtaggtattattcgcaacgagaacaatgaaatctttataacgcgtcgcgcagcagatgcgcacatggcgaataaactggagtttcccggcggtaaagttgaaatgggcgaaacgccggaacaggcggtggtgcgtgaacttcaggaagaagtcgggattaccccacaacatttttcgctatttgaaaaactggaatatgaattcccggacaggcatataactctgtggttctggctggtcgaaagctgggaaggggagccgtggggtaaagaagggcaacccggtgagtggatgtcgctggtcggtcttaatgccgatgattttccgccagccaatgaaccggtaattgcgaaacttaagcgtgtgtatgccggataaggcgtcacgctgcatccgacatttgcatatgatgcctgatgcgacgctggcgcgttttatcaggccagcgtcgcactctcagatagaatgtcactgctttggctcttcgctccagtcatcgctttcggaaagatcgccactgctggggattcgtttttcttcagcagcccattctccgaggtcgatcagctgacaacgtttggagcaaaatggccgaaacgggctgatttcaccccacaccaccgttttcccgcaggttgggcaattcaccgtaatagtttctgacatttttactccttagcaacaggccagttcgaaatccagacgttctggtacctgtccgttttcactgtccagcggcataaaacgaatggcaaaacggctcttatgaccggaaatttgcggataaagctgtgaatcgagcgacagattcaggcgcagcaagtcggcatcgccaccgttatcctgataaaaaccattcaggctggtttgtttacggaagggggccgactggcgaattaaatccagcaccatggtaagtgcctgggtaagcgggttcaggctggcaatccaggtttctacctggctgtcgcgctgcgcctggggtagatgcagccaaatgtgcaatgtaggtaaatcaaagctgcaacagccgcccgggatgctcagtcgctgacgcaccagagcaatcaaacgatcttcacgtagaaattgcccgatacgcggcgcggagattaatacgctccccgccgcttttaactgctgaattaatgcttcaatacggctctggtccacgccgggcacgccaatccaggtctggagtttacgttgctgccggtcaagttctttcaacagctcagtgcggacttcgccgcgctcgaaaacatccagtaattcgctgacattacggaagaaatgcagcgcgccagcgtggtcaacgatgggtaaattaacggtgagttgctgaatcaaaaactcaatgcgcagccatgtacgcattttttcatttagtggatgttcaaaaaggacctgggtctgcattacggtttttcctgtgagacaaactgcgacgcaagctgcaaatagtgtgcgtgcaggcgggcaacatccgatgcgatagcatccggtgcgccgttattatcaatgacgtcatctgccacggcaaggcgagcttcgcgcgttgcctgagcagcaaggatttgttcgacatgctcgcgagttacatcgtcgcgctgcatggtgcgcttaagttgcgtttctgggctgacatccaccaccagcactcgattcgcttttttatacagtgagttttctaccagcaatggcacaacccatagtacatagggggaagtagcttgctggatctggtgttgcgtctcttgctgaatcagcggatgcagcagggcgttaagccagtttttctcttccgggttggcgaagatccgttcgcgcaaggcccggcgctgcaatgttccatcagcagcaatcatgttagcgccaaagtgatcagcaatggcatgtagcgcaggtgcacctggttcaaccacctgacgcgcaataatatcggcatcaatgacgttaattccgagattagcaaacgcattggcaacggtactcttgccactgccaatgcctcccgttaaggcaactatatacctcataatttatattcccgggaattcatcatgattatcaaaacgttaaaaatgagcgcacgaaagcgaaattgatgaaacgttcgctcactatttaccaggtaaatttatgggattgtagcgtaaaaaaagacaatttcgcagtcttgcgccgcattgattagtgcgtatgataacgtcactggagttgcgctcttacccttatagccattaaccccaggaatccgcacatgcgtattgaagaagatctgaagttaggttttaaagacgttctcatccgccctaaacgctccactcttaaaagccgttccgatgttgaactggaacgtcaattcaccttcaaacattcaggtcagagttggtccggcgtgccgattattgccgcaaatatggacaccgtaggcacattttctatggcctctgcgctggcttcttttgatattctgactgctgtgcataaacactattctgtcgaagagtggcaagcgtttatcaacaattcttccgctgatgtgctgaaacatgtgatggtttctaccggcacgtctgatgcggatttcgaaaaaactaaacagattctcgacctgaacccggcattaaatttcgtttgtattgacgtggcgaatggttattccgaacacttcgtgcagttcgttgcgaaagcgcgtgaagcgtggccgaccaaaaccatttgtgcaggcaacgtagtgactggtgaaatgtgtgaggagcttatcctctccggtgccgatatcgttaaagttggcattggcccaggttctgtttgtacaactcgcgtcaaaacaggcgtcggttatccgcaactttctgcggtgatcgaatgcgccgatgctgcgcacggtctgggcggaatgatcgtcagcgatggcggctgcaccacgccgggcgatgtcgcgaaagcctttggcggcggtgccgatttcgtaatgcttggcggcatgctggcgggccacgaagagagcggcggtcgcatcgttgaggagaacggcgagaaatttatgttgttctacggcatgagctcagagtctgcgatgaaacgtcacgttggcggcgttgcggaatatcgcgcagcagaaggtaaaaccgttaagctgccgctgcgaggcccggttgaaaataccgcgcgtgatattttgggcggcctgcgttcagcttgtacatacgttggggcttcacgcctgaaagaactgaccaagcgcaccacgtttatccgtgtgcaggaacaagaaaaccgcatcttcaacaacctgtaatataccaacgctggcgtggagcaacacgccagcgttatcccattccactcatcgcatcgcctaaatggaaaattggcagatacattgccaccaccagcgtaccgataattcctcccgttatgatcagcaacgccggttccagtaaggctgcgaggttatccgccagcgccattgtgttatcccgatgatgatgggcgaggttgtctaacatgagatccagcgagccggatgcctctcctgttctcactaattgcaaacagagcgggctaaactcaccggcattttttagcgccagccagatggggtgaccgttactgatatcgtgctggatttgtgtcagaagttgcacccagtacgggcagcgcattgtttctctgacgctctcaacgccctgtaaaaaagaaatgcctgcactttgtgtcagtgtcagaatcgtaaagatctgcgtgagtttttgtccccgcatcagtgaacccataatcgggatgcgtaacagcaatttctgccgtgcgataagcctggttgggtggcgcatcagcagcttattggctatcgccagcagaaagccgaatagcaccagcaaccaaccccattcgccactaaaacttgccagcgtcatgatcccctgcgttagcgccggtagcggagtgttaaaggtcttatagatagcggcaaactccggcagtacaaaatgcagcattgccacaaccaccatgattgccatcgctaaaatgataatgggataacgtaacgctgatttcactttgtcggtcaactgacgctgggctttttgctgacgcgccagttcaaagcagcattcatccagcttaccggtcagttcacccgtgcggatcatcgcctgatagagcggcggaaatacctctgaccagggtaataaggcattggaaaaggcaacgccctgttcaagatcgtgcgccagtgattgcagcaacgcttgccactgcttactgggatgctgttccgccagcagagccagcccttcagaaagcgttaacccggctttgagtagcgtcgccagttgatgaatgacttccgcgcttatatctcctcgccactgcgtagaattgatggtgattcgcttcaggcttagtggggtaaccatctgttgctgtagtgccatgagcagcaaagcacggctctctgcccatagcatcccatcttgcgcattgccgtcgccggttatgccatgccagcgccagagttgcttactcgccatgcggcatccctaatacgcggattaactcttcaaaggtggttaagccttgctccacggctaggcagccgttttcaaaaagcgttcgcatacccgcctgtcgggcgtgcgtttccagcgattcaacgtcggtattagcggaaataagctgacgtatgaccggtgttatgggcagaacttcaaataaggccgtgcgaccataaaaaccgtggtagcaatgtacacaaccgggtgcctgccagtggggcagcggcgacggccatacattgtctggaatatggatgggctccccttgctgccggcgacaatgcgggcaaagtttgcgtaccagacgctgggctattaccagcgtaagcgccgatgatagcatccagcgggcgactcccatttgctgtaaacgtaccagcgtttcgcaggtggagttagtgtgtagggtagacaacaccaggtgaccggtttgcgcggctttaatggcaatttctgccgtttcgccatcgcggatctctccgatcatgatgacgtcaggatcctggcgcaataacgcacgcaaaacgccctgaaaggtgagtccggcacgcgaatggatttgcgtctggtttagtccggctatggggatctcaaccggatcttcgacgctacaaatattaatgtcagcggtattcagcatttgcagggcactataaagcgtgaccgttttgccgctgcctgtagggccagttaccagcaccagtccctgtggttgttgcaaggcatgagcaaagtccaccagttgtgacggctgcattccaagcgtgttaacatccagtgcctggttcacctgctgtaacaaccttaataccaccttttcaccacctcgacatgctaaggtcgcaatacgaaatgagacggcgtttcctgccagttcgacagtgaattgcccgtcctgcggcaggcgatgttccgcaatatccaggtttcccagcacttttaatctggcggttaatgcgactccggcatccggtgaaacgtccggtaaaggatgcaatacgccgtcgatacgcaagcggatgcggtaggcattgtccgctggttcgatatgaatatcagacgcgcgttgttctagcgcagattgtaacgttcgagtcagcaactctgctttgggctgatgcttctcctgaacagctacgggcaatgtctgttgtgtgcgactggcgtgaccttccatttgttggcgtgtccagcaggtgatctcaatacgtttggtggtagcgaaatgcaatgcgtccagtagctcatgcgaaggtgcatcgactaccgcaacatgaaccacctcttcgctggcatccagcaagactccctgataacgcagacacagggcagtgagctgtggaatattcattgccgctccttagttggcgtcatcaaagcggaagacatcttcgcaggcttgctgcaatgcgctgtcactttgaatattgcagttacgcgtccagccggtgacgccgtttgcgttatcccaacccggcgtcatgacgacgcttagtccattgagactttcttgcccggtcagcgacaccacgccctttgccacactcatggctgaaacatagcgggtggtggtaggcgagggaatgccattgctgccaccgtcgcaggtatttaatccaccatgttccagcgcgcacaactctacggcggtacggtaaggcacaaaggtttgtagcatgtcggtgagtgcggctttgcgcaggtagttttgataagcgggaataccaatggcgcttaaaatggcaatgatgccaataaccaccatcagttcgataagtgtaaaaccgcgttgcttgtccatctgtttcgctccttgatttggttggcgctactttggcaaacgccatcagcacaagcgaggggcaaaaaacgaaacgggaaagcagcttccgaggttttttatttcgttgcagcgaaagacaagaaatttgcgaggcgttacgaagaaagttggggaaggggagatttatccgcccgcgatggagcggataaatctgttagcaattagcgaaaacgcattgaaaggtcgagtgcctgtacgtgtttagtcagcgcaccaacggagataaagtccacgcccgtttcggcaaattcgcgcagtgttttgtcagtgacgttgccagacacttccagtagcgccttgccgttggtgcgtttgacggcttcgcgcatctgttctgtttcgaagttatccagcatgatgatatcggcacctgctttcagggcttcatcaagttcttccagattctctacttcgacttctactggcgcatccgggtgcaaccaggacgctttttcgaccgcctggcgcactgagccggaggcaataatatggttttctttgatcaggaaggcatcagaaagccccagacggtgattcgctccgccgccgcaaagtaccgcgtatttcagagctgaacgcaggccgggtaaggttttgcgcgtatccaacagctgcgtgttggtgccttccagtaattcgacatagtggcgtaccttactggcaactcctgaaagggtttgcacaaaattaagcgcagtgcgttcgcccgttaacagcacgcgagatgggccttcgagttcgaacaagggttgattggcgttgatgacatcgccgtcatccacatgccagattatggtgacatcgtcgcctgccagttgaataaacacctcttcaacccagcgtttgccgcaaaatacgccattctcgcgggtgatcactgtggcatgagagcgagagttttccggtaaaagttttgccgtaatgtcattgttggcatcgactgttccgcctaaatcttcccgtagcgcctgggccaccgcgccggggatatcgagattaatgcgttccagcagctcgtcacgtcgggtgtcagggttatagcggcgaggcggcatgttaaaactccagatagctaacgaatcataaggtagaaacatgctactctgaaccgggtattagcaccacatataaggagatcctgcatgttgttagaacaggggtggctggctggcgcgcgccgcgttccctcaccacattacgattgccgcccggatgacgaaacacccactctgctggtggtgcacaatattagcctgccgccaggcgagtttggcggcccgtggatcgacgcattattcactggaactattgatccgcaggcgcatcctttctttgctgagatcgcccatttgcgcgtctccgctcactgtttgattcgccgtgatggtgaaatagtccagtatgttcctttcgataaacgagcctggcatgcgggagtctctcagtatcaggggcgtgaacgctgcaatgatttttctattgggattgagctggaaggcaccgatacgctggcgtataccgatgcgcagtatcaacagcttgcggcggttacacgggcactgattgatcgctatccggatatcgctaataacatgacgggccattgtgatattgcgccggatcggaaaaccgatcccggtcctgcatttgattgggcacggtttcgtgcgctggtcagcaaggagacaacatgacgctatttacaaccttactggtgttaattttcgagcgcctgtttaagttgggcgagcactggcagcttgatcatcgtcttgaagcgttctttcggcgggtgaaacatttttctctcgggcgcacgttatgcatgaccattattgcgatgggcgtgacttttttactgttacgcgcattgcagggagtattgttcaacgttcccacgctgctggtgtggctgctgattggtttgctgtgtattggcgcaggtaaagttcgtcttcattatcatgcttatctgacagctgcttcacgtaatgatagccatgcccgtgccacgatggctggcgaactcaccatgattcacggcgtcccggcaggctgcgatgaacgtgagtatttgcgtgagctgcaaaatgcattgctgtggattaactttcgtttttatcttgcaccgctgttctggctgattgtggggggaacctggggacccgttacgctgatggggtatgcgtttttgcgtgcatggcaatactggctggcgcgataccagacgccgcatcatcgtttacagtccggcattgatgccgtgcttcatgtacttgattgggtgccggttcgtcttgcgggtgtggtatatgccttgatcggtcatggtgagaaagcgttaccggcctggtttgcttcgctgggtgatttccatacttcgcaatatcaggtattaacgcgtctggcacagttctctctggcgcgtgaaccgcatgtcgataaggtggagacgccaaaggcagcggtttcaatggcgaagaaaacctcgttcgtggtcgtggtggttattgcgctactgacgatttacggggcgttggtgtaaagattattgccctcaccctgcacgggtgagggcgtagagagattaatgcgcttttacggctttggcggttttctctttaaacagatagcctatacctaacacgatcagccataccgggatcaggtataccgaaatcgccattcctggggtcatcagcataatcaccagtaccgccgccataaacagcaggcagatccagttacccagcggataaagcagggcagggaagcgagttaccacgccttgttcttgtttggcacgacggaatttcatatgcgccagactgatcatcgcccagttgatgaccagtgcagataccaccagcgccattaacagtccgaaagcggactctggggcaaggtagttaatcagtacgcacaatgccgtaaccagcgcagacaccagaatagtgttaaccggtacgccgcgtttatcgacagacgccagcgcttttggcgcgttcccttgttgtgccagaccgaacagcatacggctgttgcaatatacgcagctgttgtacacggagagcgcagcggtcagtaccacgatattcagcgcattcgctacaaaggtatcgcctaactcgtggaagatcagcacaaacggactggtatcagcggtaacgcgggtccacggcattagtgagagcagaacggctaacgagccaatatagaaaatcaggatgcggtagataacctggttagttgctttcgggatactttgctccgggttatcagcttctgctgcggtgatccccaccagttccagaccaccgaaagagaacatgataatcgccatcatcatcaccagaccggtgaagccgtgtggcaggaaaccaccctgatcccacaggttgctaacgctcgcctgcgggccgccgttgccgctgaatagcagccaggcgccgaagatgatcatcgctaccaccgcgataactttgataatggcaaaccagaactccatctcgccaaacacttttacgtttgtcaggttgatggcgttgatcaccacaaagaacacggcggcagaaacccaggttgggatttccggataccagaactgaatgtatttacccacggcagtcagctctgccatggcaactaaaacgtacagtacccagtagttccagccagaggcgaaaccggcaaaactgccccagtatttataagcaaagtggctaaaggagcctgcgacaggttcttcgaccaccatttcacctagctgacgcatgatcagaaaggcgataaaaccagcaatggcgtaacccaggataatccctggccctgcggattgtattacggaggcgctacccaggaatagccctgtccctatcgcgccacccagcgcgataagctgaatatggcggtttttaaggccgcgctttagctgctcgccgtgctgttgaccttccattatgaaacctcgtgttgtgttgtttttttgaactacgcagcaatgcgtgtgtaattttgtaattccgtttgttgtattggtttctttacattttatgtaactgaattatgatgatagtactttcaactatcacaagataatggtatatgcgcgagaatgcacctgctttatgtagatgtgttgattttctggataaaaaaaaagcaattgtaagtttttcatcacatttaatagatactttaagtctgataacatactgttttaactagctatatgtcggatttgtctgcctgctgaacaccatgccttagccaccagcacaataatcttacaaaaggtcatataagaataaatagatgttaataatacaatggggttgtaacgcgagtatttaaatataatattgcgagctaagtgaaaacgttaagtaattgaaataatttttcattaaaagcgtttcttattgatcgagaaataagttttctatttaatgcaaaaaagttaaggataaacgggaatgaaataaagtgggcgatattgtttacctgagaataatcggtgagaagcagggcgatatttcttcaggctgtgggacgtatgcgtcggttggtaatcgctggcaggttggccatgaagatgaaatttttgcctttgcactcaccaacgccattaccagtactggtaaaggcgttaatctacaggggctacaattttgcaaactcattgataaaagctcaccgctactgtctaatgccatcaatcagaatgagcggttatttattgaaatcgatttgtatcgtataaataaaagcgggcgctgggaacggtattattatattcagctaagaaatgcttcattaactgctattcatgtaaacatttctgacaataatcttcctaccgaatgtgtaaatgttaattatgactacatattatgcaaacatctaatagccaatacggaatttgactggttggcctttcctgctggctataatagcttatttattccacctaaaaacccacctgccagtaatcttaaccctgagccactaccagttgttaaccttccactctctccaccagcggttaaaccggtctatgccaaatcctgtctgaaggagaagggatgtacagatgccggaacggcagaagaacccgctgaaaacttcgggcaagtagcgatttttgctctgccagtggttgatgactgctgtggataccaccatccggaggctaacgatgttgggcaacccgcagaagctcaaaccatgctactgtttccgggtagtgtgttggcggctcaaatatggggaaaatggtcgctcagtggcatactcagtgcaacctgcggctcttacatcggtgcgttggcatctgctttgtatattccctctgcgggcgagggcagtgctcgcgtgcccggacgtgatgagttctggtatgaggaagaactgcggcagaaagcactagcaggcagtaccgccaccacccgggtacgttttttctggggaactgacattcacggcaagcctcaggtgtatggtgttcatacgggtgaaggtacgccgtatgaaaacgtccgcgtggcgaacatgcagtggaacgagcagacgcagcgttatgaatttacccccgctcacgatgtcgatggccccctgattacctggacgccggaaaatccggaacatgggtatgttccgggccataccggtaacgacaggccgccgctggagcagcccaccattctggtgacgccgattccggacggcaccgatacctataccacgccgccattcccggttcctgatccgaaagaattcaacgattatattctggtttttccggcgggatccggtattaagcccatctatgtttacctgaaggaggatccgcgaaagctgcctggtgttgtaacagggcgcggcgtcccgctttcaccaggaactcgctggctggatatgtcggtatccaataacggcaacggcgcaccaatcccggcgcatattgctgataaattgcgcggacgggagtttaaaacctttgatgagtttcgcgaggcgctgtggctggaggtgagtcaggatccggagttgatagcgcagttttcaagtggtaaccaaacacgtataaaacaaggattaaccgcaaaagcacctattgacggttggtattatggccctaaagaaatagttaaaaaattccagatacatcatcgtgttgcagttgaatatggcggcagcgtatacgatattgataatttacgaattgttacccccagactacacgatgagattcactacaggagataaatatgtttaaagaaaagctccaggattataccgaggatgaatttcttaattttttaggcggattgagatcatctatgaaagatggaaaatccttaaaaggtaaggagctagaaatgtactgggattcattagtagatcattttattgaaattacacagcatccgtcagggagcgatctaattttctaccctaaaagtcaaggagatgataagcctgaaaacatcctgaaaattgtcaaagaatggcggcgttcacaggggttacccttgtttaaagactctaaataaagtagataataaaactatatatggaacatcatcgcatctggctaatgcgatgatattaatgacataaaataataatgtgattgctcttaaaaaacaggtaaaaatactgaagcctcattaggttattttatcattttcccgcttttaccgataccctttggctggaggtgagtcagtatccggagttgatagcgcagttttcaagcggtaatcaaacacgtataaaacaaggattaatcgcaaaagcaccacttgaaggttggcattatggcactaaagaaatcgttaaaaaattccacatgtatcatcgtgttgcgattgaatatagtggcggaatttacgatattgataatttaaggagggcacacctcatttgcatgatgaaatttattacaggagatagttaaatgtataattttaaagatgaaatagaagattacacagagcgggaattcattgagttgcttggcgagtttacaaatccaaccggggataacgctcaattaaaaggggaagagcttgacaaatattgggatgatctagaagaacatcttaccagaattacacaacatccgttgatgagcgatcttatctactatcctgcaaagaagggagatgatgaacctgaaaacatcctgaaaattgtcaaagaatggcggcgttcacaggggctacccttgtttaaagactctaaataaagtagataataaaactatatatggaacatcatcgcgtctggctaatgcgatgatgttaataacataaaataataatgtgggtgctcttaaaaaacaggtaaaatactgaaatttcattaggttattttatcaatttcccgctttcaccgataccctttggctggaggtgagtcagtatccggagttgatagcgcagttttcaactggtaaccaaacacgtataaaacaaggattaatcgcaaaagcgcctcttgaaggttggcattatggctctaaggaaattgttaaagaattccatatatatcatagtgttgcgattgaatgtggtggcgaaatttatgatattgataattaaaggattgttacgcctcgactacatgatgaaattcactacaggagataatgtatatgcatgatttaaaatataaaatatatttttacacagaaggtgaatttcttgaaatgcttgaggagatagtaaatgcaactagcaaagataaatccctaaaagggaaaaaattagaaaaatatctcgataccttagtggatcatttcattaaaattactgaacatcctaaaaagggagatctcattttctatcctaattccccagaagatggtaaacctgaaaacatcctgaaaatcgtcaaagaatggcggcgttcgcaaggattgcctttgttcaaagattcagaatgaactctaaacagaatctgtcacctgaaaatcatcacgttctggttaagtgatgattttcgctacgagaaggttacggtggcgattgcagtgataataagcaatgtaaaaagaaaacataggtaaatactacctttctctccttccctgaacattcattttacatattaattcacataattgaattgttatgcgttttgttgcttggtgaatcggttcagaggaaatattttttcgtttcaattctgttaaggtcaccccttgatgggtaaatttaacatttgtgcatagttacaactttgaaacgttatatatgtcaagttgttaaaatgtgcacagtttcatgatttcaatcaaaacctgtatggacataaggtgaatactttgttactttagcgtcacagacatgaaattggtaagaccaattgacttcggcaagtggcttaagacaggaactcatggcctacagcaaaatccgccaaccaaaactctccgatgtgattgagcagcaactggagtttttgatcctcgaaggcactctccgcccgggcgaaaaactcccaccggaacgcgaactggcaaaacagtttgacgtctcccgtccctcattgcgtgaggcgattcaacgtctcgaagcgaagggcttgttgcttcgtcgccagggtggcggcacttttgtccagagcagcctatggcaaagcttcagcgatccgctggtggagctgctctccgaccatcctgaatcacagtatgacttgctcgaaacacgacacgccctggaaggtatcgccgcttattacgccgcgctgcgtagtaccgatgaagacaaggaacgcatccgtgaactccaccacgctatagagctggcgcagcagtctggcgatctggacgcggaatcaaacgccgtactccagtatcagattgccgtcaccgaagcggcccacaatgtggttctgcttcatctgctaaggtgtatggagccgatgttggcccagaatgtccgccagaacttcgaattgctctattcgcgtcgcgagatgctgccgctggtgagtagtcaccgcacccgcatatttgaagcgattatggccggtaagccggaagaagcgcgcgaagcatcgcatcgccatctggcctttatcgaagaaattttgctcgacagaagccgtgaagagagccgccgtgagcgttctctgcgtcgtctggagcaacgaaagaattagtgatttttctggtaaaaattatccagaagatgttgtaaatcaagcgcatataaaagcgcggcaactaaacgtagaacctgtcttattgagctttccggcgagagttcaatgggacaggttccagaaaactcaacgttattagatagataaggaataacccatgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtcaacgtagccgcaggcaccggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccacatggcgtccttccagtcttccgcaaccatttatgatgtgtgctttaaccacttcttccgtgcacgcaacgagcaggatggcggcgacctggtttacttccagggccacatctccccaggcgtttacgctcgtgctttcctggaaggtcgtctgactcaggagcagctggataacttccgtcaggaagttcacggcaatggcctctcttcctatccgcacccgaaactgatgccggaattctggcagttcccgaccgtatctatggggctgggtccgattggtgctatttaccaggctaagttcctgaaatatctggaacaccgtggcctgaaagatacctctaaacaaaccgtttacgcgttcctcggcgacggtgaaatggacgaaccggaatccaaaggtgcgatcaccatcgctacccgtgaaaaactggataatctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggacgaactgctgcgtaaagataccagcggtaaactgatccagctgatgaacgaaaccgttgacggcgattaccagaccttcaaatcgaaagatggtgcgtatgttcgcgaacactttttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacggtaatccttgctcataccattaaaggttacggcatgggcgacgcggctgaaggtaaaaacatcgcgcaccaggttaagaaaatgaacatggacggtgtgcgtcacatccgcgaccgtttcaatgtgccggtgtctgatgcagatatcgaaaaactgccgtacatcaccttcccggaaggttctgaagagcatacctatctgcacgctcaacgtcagaaactgcacggttatctgccaagccgccagccgaacttcaccgagaagctggagctgccgagcctgcaagatttcggcgcgctgctggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggtttccagcgtatcggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgatccggcttacgcttacgaagttgctgtcatcatgcatgacggtctggagcgtatgtacggtgaaaaacaagagaacgtttactactacatcactacgctgaacgaaaactaccatatgccggcaatgccggaaggtgctgaggaaggtatccgtaaaggtatctacaaactcgaaacccttgaaggtagcaaaggtaaagttcagctgctgggctccggttctatcctgcgtcacgtccgtgaagcggcagagatcctggcgaaagattacggcgtaggttctgacgtttatagcgtgacttccttcaccgaattggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccactttgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaagaggtaaaagaataatggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagtaccatctccgcaggcgggtatcgttaaagagatcaaagtctctgttggcgataaaacccagaccggcgcactgattatgattttcgattccgccgacggtgcagctgacgctgcacctgctcaggcagaagagaagaaagaagcagctccggcagcagcaccagcggctgccgcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggtagctccggcagctaaacaggaagcagctccggcagcggcccctgcatcagcagctggcgtgaaagaagttaacgttccggatatcggcggtgacgaagttgaagtgaccgaagtgatggtgaaagtgggcgacaaagttgccgctgaacagtcactgatcaccgtagaaggcgataaagcttctatggaagttccggctccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggctccggcagcaaaagctgaagctccagcagcagctccggctgcgaaagccgaaggcaaatctgaatttgctgaaaacgacgcttacgttcacgcgactccgctgatccgccgtctggcacgcgaatttggcgttaacctggcgaaagtgaagggcactggccgtaaaggtcgtatcctgcgcgaagacgttcaggcttacgtgaaagaagctatcaaacgtgcagaagcggctccggcggcgactggcggcggtatcccaggcatgctgccgtggccgaaggtggacttcagcaagtttggtgaaatcgaagaagtggaactgggccgtatccagaaaatctctggtgcgaacctgagccgtaactgggtgatgatcccgcatgttacccacttcgacaaaaccgatatcaccgagctggaagcgttccgtaaacagcagaacgaagaagcggcgaaacgtaagctggatgtgaagataaccccagttgtcttcatcatgaaagccgttgctgcagctcttgagcagatgcctcgcttcaacagttcgttgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctggggactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaagtaaaagagccggcccaacggccggcttttttctggtaatctcatgaatgtattgaggttattagcgaatagacaaatcggttgccgtttgttgtttaaaaattgttaacaattttgtaagataccgacggatagaacgacccggtggataatgggcgtcataaaaaaaacgtcagacccgccggagataaatatatagaggtcatgatgagtactgaaatcaaaactcaggtcgtggtacttggggcaggccccgcaggttactccgctgccttccgttgcgctgatttaggtctggaaaccgtaatcgtagaacgctacaacacccttggcggtgtttgcctgaacgtcggctgtatcccttctaaagcactgctgcacgtagcaaaagttatcgaagaagccaaagcgctggctgaacacggtatcgtctttggcgaaccgaaaaccgatatcgacaagattcgtacctggaaagagaaagtgatcaatcagctgaccggtggtctggctggtatggcgaaaggccgcaaagtcaaagtggtcaacggtctgggtaaatttaccggggctaacaccctggaagttgaaggtgagaacggtaaaaccgtgatcaacttcgacaacgcgatcattgcagcgggttctcgcccgattcaactgccgtttattccgcatgaagatccgcgtatctgggactccactgacgcgctggaactgaaagaagtaccagaacgcctgctggtaatgggtggcggtatcatcggtctggaaatgggcaccgtataccacgcgctgggttcacagattgacgtggttgaaatgttcgaccaggtcatcccggcagctgataaagacatcgttaaagtctttaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagctggcgtggaagttgacgaccgtggtttcatccgcgttgacaaacagctgcgtaccaacgtaccgcacatctttgctatcggtgatatcgtcggtcagccaatgctggcacacaaaggtgttcacgaaggtcacgttgccgctgaagttatcgccggtaaaaaacattacttcgatccgaaagttatcccgtccatcgcctataccgaaccagaagttgcatgggtaggtctgactgagaaagaagcgaaagagaaaggcatcagctacgaaaccgccaccttcccgtgggctgcttctggtcgtgctatcgcttccgactgcgcagacggtatgaccaagctgattttcgacaaagaatctcaccgtgtgatcggtggtgcaattgtcggtactaacggcggtgagctgctgggtgaaatcggcctggcaatcgaaatgggttgtgacgctgaagacatcgcactgaccatccatgcgcacccgactctgcacgagtctgtgggcctggcggcagaagtgttcgaaggtagcattaccgacctgccgaacccgaaagcgaagaagaagtaatttttcgtttgccggaacatcctgcaaattaagaagcggctattctggccgcttcagattgttgataaagtgctcgtggttgatgccggatgcggcgtaaacgccttatccgacctacaaaatcatgcaaattcaatatattgcatggcttgtgtaggcccgataagcttgcgcatcgggcgattcgatgtttgtcatcagtcttaagcggctaacaacgccgcttttttacgcctgcaatttacctttccagtctccttgctccacgctcagacaaccgttcgcgtaccgctgaccgttgctcattattcaatcgggcagtatggttactgtcgtttagacgctgcgggcggctctcctgaactttctctcgaaaaacctgacgctgctcaggcgaggcagactggatacgctgacgtgctgcatctctttgctgttgattctgcgggttagtctgcattttctcgcgaaccgcctggcgctgctcaggcgacgcggactgaatacgctgacgtgccgcttctcttctctgctgattctgcgggttagcctgaattttctcgcggactgcctggcgctgctcaggagaagccgactgataacgctgacgagcggcgtccttttgttgctgggtcagtggctggcgacggctgaagtcgcggaagtcgtcatagctcccatagtgttcagcttcattaaaccgctgtgccgctgcctgacgttgggtatctcgcgtaatgacgggggcggcgtgtgttcgttgctgaaactgacttgctgccgcatgacgctggctgtcgcgtgttggagcaggtaactgcgtggcgctcattccgccgttgacatcggtttgatgaaaccgctttgccatatcctgatcatgataggtcacaccattacggtagtttggattgtgccgccatgccatattcttatcagtaagatgctcaccggtgatacggttgaaattgttgacgtcgatattgatgttgtcgccgttgtgttgccagtcattaccgtcacgatgaccgccatcgtggtgatgataatcatcatcgtcatgatgatgatggtcatgatcgtcgtcgtcccagtcgatgctgctgaatagtgcgtatgtggtagcaacgcccatgctatagccgaatccgcgcacaaagctgtcaacaaacggttctccggctggcggcggcagataaactggcggataagcggtattggcccaactgccgtaaaccacgtttgggttgtagttcggaatataaaccacatccggattggctggctcaatggttattacggtcggtgcaggttctgcgacgacggggctggacgtagaaacggtatttgattgtgtggcaggggcgttggcgggctgatttaccggtacgacttttttcgttgtcgcgatgatcttttgttcagttgatgacttcagcgagccggtttgttgcgccagttgccgcaatcgctgtaccgagtccatcacgtcctgcggctgcgccagaaaagcatcgcccaggttttgcacccattgcgggttttcgcccatcaatgccatcaactgtggaaaggccaccagtgatttgacgctggcgtcccagggctggtcagatacagcctgaatagcagcatcgccttgtttaagtggattatcgtgcgaccattgcactgcttgagcaacgtttgccggataggttgatgccattaacacttgtgaaagcagagagtcggggtatagcgcgacaggtgcaacccattgatctatttgagcagtgctgaatgcggatttgacgacggcaggcgttacgggaggcgcggaaaccgttgcaggaagcgtaactgcggagatgtcaggcgcagtctgttgtgtcgattgcgcttccacaggcgcttccactgtgcggctttttatatatagcccggcagaggcggcacaaagcccggcactgcaaattagcgccagcacatggggtttaaacggcaaagtcattttcataattcggatctcaaggaaatcgcaatggtcggcgaactgccacccgcaggtgctgtgaatccgagtataaagaggccgtagtttaaattttgactaatcttgggattcgttgagaaaggtgattatcaccatgcgaattaacgaagtttttacggagggaaacattctctagactatccttaacgattcagccacttttttatgttgcttttttgtaaacagattaacacatcgtcaaaatcctgctattctgcccgttgcggtactgggcatttaccctacaaactgctgtctcacaggagcgtgaagagaatcgcctgccgcactatgacaatgagagcgaggagaaccgtcgtgctagaagaataccgtaagcacgtagctgagcgtgccgctgaggggattgcgcccaaacccctggatgcaaaccaaatggccgcacttgtagagctgctgaaaaacccgcccgcgggcgaagaagaattcctgttagatctgttaaccaaccgtgttccccctggcgtcgatgaagccgcctatgtcaaagcaggcttcctggctgctgtcgccaaaggcgaagctaaatccccgctgctgactccggaaaaagccattgaactgctgggcactatgcagggtggttacaacattcatccgctgatcgacgcgctggatgatgccaaactggcaccgatcgctgccaaagcactttctcacacgctgctgatgttcgataacttctatgacgtagaagagaaagccaaagcaggcaacgaatatgcgaagcaggtaatgcagtcctgggcggatgccgaatggttcctgaatcgcccggcgctggctgaaaaactgaccgttaccgtcttcaaagtcactggcgaaaccaacaccgatgacctctctccggcaccagatgcgtggtcacgcccggatatcccactgcacgcgctggcgatgctgaaaaacgcccgtgaaggtattgagccagatcagcctggtgttgttggcccgatcaaacagattgaagctctgcaacagaaaggtttcccgctggcgtacgtcggtgacgttgtgggtacgggttcatcgcgtaaatccgccacgaactccgttctgtggtttatgggcgatgatattccacatgtgccgaacaaacgcggcggtggtttgtgcctcggcggtaaaattgcaccaatcttttttaacacgatggaagacgcgggtgcactgccaatcgaagtcgacgtctctaacctgaacatgggcgacgtaattgacgtttacccgtacaaaggtgaagtgcgtaaccacgaaaccggcgaactgctggcaaccttcgaactgaaaaccgacgtgctgattgatgaagtgcgtgctggcggccgtattccgctgattatcgggcgtggcctgaccaccaaagcgcgtgaagcacttggcctgccgcacagcgatgtgttccgtcaggcgaaagatgtcgctgagagcgaccgtggcttctcgctggcgcagaaaatggtgggccgagcctgtggcgtgaaaggcattcgtccgggcgcgtactgtgaaccgaaaatgacttctgtaggttcccaggacaccaccggcccgatgacccgtgatgaactgaaagacctggcgtgcctgggcttctcggctgacctggtgatgcagtctttctgccacaccgcggcgtatccgaagccagttgacgtgaacacgcaccacacgctgccggacttcattatgaaccgtggcggtgtgtcgctgcgtccgggtgacggcgtaatccactcctggctgaaccgtatgctgctgccggataccgtcggtaccggtggtgactcccatacccgtttcccgatcggtatctctttcccggcgggttctggtctggtggcatttgcagccgcaacaggcgtaatgccgctggatatgccagaatccgttctggtgcgcttcaaaggcaaaatgcagccgggtatcaccctgcgcgatctggtacacgcgatcccgctgtatgcaatcaaacaaggtctgctgaccgttgagaagaaaggtaagaaaaacatcttctctggccgcattctggaaattgaaggtctgccggatctgaaagttgagcaggcatttgagctgaccgatgcgtctgccgagcgttctgctgccggttgtaccatcaagctgaacaaagaaccgatcattgaatacctgaactctaacatcgtcctgctgaagtggatgatcgcggaaggttacggcgatcgtcgtaccctggagcgtcgtattcagggcatggaaaaatggctggcgaatcctgagctgctggaagccgatgcagatgcggaatacgcggcagtgatcgacatcgatctggcggatatcaaagagccaatcctctgtgcaccgaatgacccggacgacgcacgtccgctgtctgcggtacagggcgagaagatcgacgaagtatttatcggttcttgcatgactaacatcggtcacttccgtgctgctggtaaactgctggatgcgcacaaaggtcagttgccgacccgcctgtgggtggcaccgccaacgcgtatggacgctgcgcagctgaccgaagaaggctactacagcgtcttcggtaagagtggtgctcgtatcgagatccctggctgttccctgtgtatgggtaaccaggcgcgtgtagcagacggtgcgacggtggtttccacctctacccgtaacttcccgaaccgtttgggtactggcgcgaatgtcttcctggcttctgcggaactggctgctgttgcggcgctgattggcaaactgccgacgccggaagagtaccagacctacgtggcgcaggtagataaaacagccgttgatacttaccgttatctgaacttcgaccagctttctcagtacaccgaaaaagcggacggggtgattttccagactgcggtttaataagtaagcgcacgcgctgcgcataaacgacacaatgcccggtgaatgagattcccgggcattttttatttctaaaccatcgccgttccgctgtttttctccggtaaggctgcgataattacatcaatggcgcaatgcgatttcggcgcattgccgggagcagaggaacacac

SEQ ID NO: 10037 - DNA, 25568 bp, Escherichia coli
tgttctgccactggcagatgggtatgaccgtacaccagcacatcgttctggtttaaagcaggtagattttccgggccaaaaagatgaccatgcgtcaaaaacagacgttgtttttccagtaatacctgttgccacggcgcggttatcgggaaatgcagcagcatttgatccacttcgctgtcgcagttgccgcgcacagcgataaccttatgtgccacttcattaagccgttcagcgactttggctggcgcgtaaccctccggtaaagcattacgcgggccatgattcaacacgtcgccaaggatcaccagccactgggcaccgctttggacaaacaactccagaacacgttccgtcgccggtaacgacccatgaatgtccgatgcaaacatcagtttcatcactcactcctcgtcgaaaaaacgtaagctatgatactggattctgtcgttgctatcagccagattgcttcgccgaaagtgcaataaaacgctggacagacgctcgctgccactggaatgtcgcataatccaccaggcgttccggcacctcatcgccatgtagtaccaggcggttaatcattagcgccagatcagtatcagcaatgcaccattcaccaaataaattcggctgacccagtgctaacaaatgttctgccatcgcgaacagtttctctgcactggcttttccctcggccgttagtggcgcttttttcgcccccgcaaagacaacatccgtcgggcgttcttcgcggatgggcatcagatcgctgcgcagccaggcctgaatctgtcgtgctcgcgcacgattttctaaatcaagcggataaatacgttcccaggtcggtggcgcaaatcgatcttccagatactccgcaatggcagaagattcactcaactcaaaatcatcgatttgtaataacggcacacggcgtgtctgaccgtaaccttgccacgtcggctgcaaatgttcaccgctgtcgaggtcgatggtcttgatatgaaacgacaggcctttctcctgcaacgccacccaggcggataacacataaggggagaaaaaatgggcatctgaccaaagcgtgatagcgggtttactcattatgtcctcggcaataaagggggcttgctatcaaactatagagcctttttgtcactgtcacgtgacgaatactcacgcaagtcgccgcgctttctatacttgtggtgttcagatgattagacaaccggagctgcaatgatcgatctctatttcgccccgacacccaatggtcacaaaattacgctgtttctcgaagaagcagggctggattatcgcttaataaaggtagacctggggaaaggaggtcagtttcgcccggaatttttgcgcatttcgcctaacaacaaaattccggcaattgttgatcattctccagccgatggcggcgaaccgctaagcctctttgagtctggtgccattttgttgtatctggctgagaaaacgggactctttttgagtcatgaaacgcgtgaacgcgccgtcacattacagtggttattctggcaggtaggcggactggggccgatgcttgggcaaaatcatcattttaatcacgcagccccccaaaccattccttacgctattgaacgttatcaggttgaaactcagcgtctgtaccatgtactgaacaagcggctggaaaattcgccctggctgggaggcgagaactacagcattgcggatattgcctgctggccgtgggttaatgcctggactcgccagcgaattgacctcgcaatgtatccggcagtcaagaactggcatgagcggatccgttcacgccctgccaccgggctggcactgctaaaagcacaacacggtgatgagcgttcggatagttaacagaaacaggttctcgtgtattatttcattctaagtaaaacaacggagaacctgcaatggcacaacctgccgctattattcgtataaagaaccttcgtttacgtacgtttatcggaattaaggaagaagaaattaacaaccgtcaggatattgttatcaatgtgacgatccactaccccgccgataaagcgcgcactagcgaagatatcaacgatgcgctgaattatcgcaccgtaacgaaaaacattattcagcatgtagagaataaccgtttctctttgctggaaaaattaactcaggatgtgctcgatatcgcacgtgaacatcactgggtgacgtatgctgaagtggagatcgataaactgcacgcgctgcgctacgccgattcggtatccatgaccttaagctggcagcgttaaccgccatattgggaggctgcatgaacatagtgatcaccggagggacgggattaattggtcgctatttgattccacgtttgctggacctgggccatcaaatcacggtagtgacgcgtaacccgcagaaagccagttccgttctcggccctcgggtgacactatggcaagggcttgccggacaaagcaacctcaacggcgttgatgcggtaatcaacctggccggagaaccgattgctgataaacgctggactcacgagcaaaaagagcgtctctgccaaagccgctggaatatcacgcaaaaactggtcgatttgattaatgccagcgacacgccaccgtcggtactcatttccggctcggcaacgggctattatggcgacttaggtgaagtggtggttaccgaagaggaaccgccgcataacgaatttacccataaactctgcgcccgctgggaagaaattgcctgccgggcacaaagtgacaaaacgcgagtgtgcctgctgcgtaccggcgtagtgctggcaccggatggcggtattctcggtaaaatgctgccgccgtttcgtcttggcctgggcgggccgattggttccggtcggcagtatctggcctggattcatattgatgatatggtcaacggcattctctggctgctggataacgagctgcgcgggccatttaatatggtttcgccctacccggtgcgcaatgaacaatttgcccatgcactgggtcatgcgctgcatcgcccggccattttgcgcgtccctgcgaccgccattcggttgttaatgggcgaatcttcagttctggtattaggcggtcaacgcgcgctgccaaaaaagctggaagaagcgggttttgcgtttcgctggtacgatttagaagaggcgctggcggatgtcgttcgctgatgtggtttactgcaaacatccgccagttaactcccggtgttacagggttagtggcttggcgcgataagatcgtctggtgaaagtcgggtcagcgtcaggatgacttcgtggtcaaatcctttttccatcatctcctgagcaatgcgcagggcttcttcgtgtttgccctgcattgcgccttcttcacgtaatctgtcagcaatggtcatcagtttctccttttcttgtggtgcgcgttccgctatctcaccaataaatgcacggaaacgccgggcatcccccgtttgtaatacgtaattaaacagggcttttagctgtctgtcattagtgttccctgtaactagcagcgaaacaatttggtcgactaatcccaacagatcgcgctgacgaatatgtttctgaattaactccaacagcgccattttgcgatgttgcataatctcgtcatccggcaccacggtaatatccaccagcggaaaagccgatgaataaattttgcgggcaatcgcaggctcggcaaattcatcaagccagcagagtgaatatggataagggcttctgcaaccatgataaaacagcatcgggatcactaatggaagctctttataacccgcatcaagatggttttgcatcgccgcaatggaatagcgcatcatgcgaaaagccattaattcctctggcttactttggtgctctatcaccacataaatataacccgctccctcctgcgttttcacagaccacaagaggtcggaataatattgccgcaggtcttcatcaataaaactatttggttccagtttaagcgtcgttaaatcacacagtttgcgcagcggcgcgggaagatgaatatcaataaaatcccgcgcggtgtctggatggcgtaaaaaagatttaaataccgcatcatgcggcgtggaagttgtcgatattgtcatggcgttccgtcacccctcaaatttaagatgacgcgacaataaccacgatttacacccaatgcagcaggcagtttttatctttggacagcgaattcagaactatttttagcggactgcaacttttacatttcagcggaagcggactcgcaaattccccatgaaatactccggcagcgttaaccaccggagaggaaattatttcagcgaacctttaaggaactgttgcagacgagggctttgcgggttaccgaataactgctccggcgccccttcttcttctattttcccctgatggaggaaaatgacgtgagtagaaacatgacgagcaaagcccatttcgtgagtcactaccaccatggttttcccctcttctgccagttgctgcataatacgcaacacttcgcctaccagttcaggatcgagcgctgaagtaggttcatcaaacagtaaaacttccggttccatcgctagcgcccgcgcgatagaaacacgctgttgctgaccaccggacaggtgcaccgggtatttcccctgcgcacgttcgtctatcccgacttttgccagatatttcaccgcccgctcgcgcgcttcctgcttgctcaggcccaacacctgaatcggcgcttccatgacgttttccagcaccgtcatatggctccagagattgaagtgctgaaataccatcgtcaggcgtgtgcgcaataagcgcagctgatttttatcggcgactttgagttgaccatctttatcgcgcaccagattgatcgtctggccattgaccacgatcgatccttcgctcggtttttcgaggaagttaatgcagcgcagaaaggtacttttacccgatcccgacgatccgatgatgcttatgacatctccggcattcgcttgcaatgagacccctttcagcacttcgtgttcgccgtagcgtttgtgcaaatcgataacgtttaatttattctcggacatcgtattctcagtgcgttgaagaaggtttcacatgctgcaaccagcgtttttcagctctacgaaagaggctgatcaggacataagagatgattaaatagagcaccgcggcaatgccaaaagcggtaaaaggttgatatgtggcggcgttaatatcgcgggcaattttcagcagatccggcaccgtggcagtaaatgccagcgcagtagagtgcagcatcaggatcacttcgttgctgtatgccggtaacgcaatacgcagcgcagaaggcaaaataatgcagcgatacattttaaaggtcgagaagccataggctctggcggcttcaatttccccatgcggcactgaacggattgccccggcaaaaatctcggtagtgtaagcgcaggtgttaagcgtcagcgccagcacggtacagttcaggccactgcggaagaaagcgttaaggaattcggttcccttaacaatctcaagcgtgtacatgccggaatagaacaccagcaactgaacatacagcggcgtaccgcgaaaaatataggtaaataaccagattggaaactggatgtatttattactggagacacgaccaatcgccagaaacagcgccagaactccgcctatcactaccgacaaaataagcagccacagagtgattgccacgccagtaaagcgataaccgtcggtccacaacaacggtttccagtattcatgtaaaatttcgatcacaggtcagccctcttcacacccacggagtagcggcgctcaaggaacagcagcacaccattggaaacggtggtgaaaaccaggtaaatcacgccacagacgatggcgaaatagaacggttcccaggtacttttgcctgccagttgcgtggctttgaccacatcttccaggccgagtaacgaaaccaaagcggtagatttgagaatcacctgccagttgttgccaatgcctggcagggcgtaacgcatcatcgccggaaacatgatccgccgaaacacttgcccacgagtaaaaccgaacgccgtcgccgcctctatatgccctttcggcacagccataaacgcgccacggaacgtttcggtaaaataagcaccgtagataaaaccgagagtaataataccagcgaccatcggatcgatatcaatctgcccgacgcccatcgcctccgtcaccgtgtttagcgcaatctgcaaaccgtagaaaatcagcagcatcaatactaaatccggcacgcctcgaatcagcgtggtgtacccttcgaaaataaggcccgaaagccgattttgtgagagcttaccgccagcgccaattaaaccgatgattacagcgagcactacagagctgatagccagctccagcgtgacgagcgcaccctgtaaaataacacctgaaaacccatacaacatgctgcctgtcctgtcgtgtgtggtgaattaccgcctcttgtctccctccggatacccgaagggagcgggctttctttcaccgatggcgattaaccaccataaacatcaaaatcgaagtactttttcgctaatttctcgtaagtaccgtcagcgcgcatttcggcaaaggctttgttcagtgcctcgcgcagttcgttatcttctttacgcaggcccatgccggtccctacgccaaacagtttttcatctttaacagacgggccaccgaatttgtaatctttaccgacgggttgtttgaggaaaccttcgctggctgcgacctcatcctggaacgcggcatcaatacgtccggcagtcaggtcagaataaatattgtcctgcccctgataagaaacgatttcaatgccttttggtgcccagtgttcgttaccgaacgtctcctgggtggtgccctgcaatacgcctatccgtttgcctttcagcgattcgactgtcggctgaatgtcggaatttttcgccaccaccaaacgagaatcggcagcgtacagtttgtcggtgaaggctatttcttgctgacgtttttccgtaatggaaagcgatgacatgatggcgtcaatcttcttcgcttttaaggacgggattaacgcatcgagtgggttttcgacaaacgtacattgcgtattgatgcgtttgcacaactccttcgccagatcgatatcgaagccaaccagttcaccttgtgaattttttgattcaaatggcgcataggtcggatcggtaccgatgcggatgttttgcggaatcgcagcaaatgccgcagttgcgctggagaaggccagaaccagagagagcgatagcaccagttttttcataatgtcctcaactgacagtctttttatcgggaatatttacaggtttgttacacttatcgtgccataaaattgaccatcaaggcaaaatatcccgccccgccagacgtattatttttcattaaaaatgcttaagtatgcatttcaatgcaccacgatagtgcaacaaacctggcgtgcaccatgatgatcattccatcaggtacagcttccctgcgacgtatcagtcaccgtagacattaaagtcgaaatactttttcgccatcttgtcgtaggtgccgtcctgacgcagctcgttaagcgccttattgaaggccgccgtcagttcagcatcatctttacgcagccctacaccggtgccgtcaccgaagtattttttgtctttcactgatgggcctgcaaaggcgaaatctttaccggcgggttgcttaaggaaaccttcgctggcagcaacttcatcttgtaacgcagcatccagacgtcctgcagccagatcggaatagaccaaatcctggttggcataggccaccacatccacgcctttgctacgccaggtctcgttagcgtatgcttcctgggttgatccctgcagcacaccaacatgtttacctttcagtgaatccagcgttggctgaatcggtgaacctttggcggcaatcaaacgagaatctgcggcgtacagcttgtcagagaaggctatctcctgctgacgtttatcggtaatggagagcgacgaaataatggtgtcgatttttttcgctttcagtgaggggatcagcgcgtcaaagtcactggcaacccaggtacatttcacctgcatccgtttgcacatctcgttaccgagatcgatatcaaagccaacaaagtcacctttggcatctttcgatgagaacggtgcgtaggtggtatcggttccgatacgtaccgtctccggtagcgccgcatagctggaagccgctgcggagagaccgactaacaaagacagagcgagaatcgacttcttcatacataaccctcaagtgaaaatggcttttttatgttgtgtattgtgttgtgtgtttgcaggctctttcatgcaggtcttatgccatcttgacgacagcagtaacattcaacgttaaatatgttaataagacgttgcactattgtcctaaagttgaagatagcaggtatagcggttgaatcgcagcgtttcgattgaatggcagaaacaaaatgtcgaggatttgatcgcggttgcaaaattgccctgaaacagggcaacagcggagttatgcgccctgccagcgggcaaagagatcttcaggaagggttaccgcaaactggtcaagaacacgattaaccgtctgatttatcacatcatcaagggattgtgggcgatgataaaacgccggaacgggaggcataatcaccgcaccgatttctgccgcctgagtcattaaacgcagatggcctaagtgcagtggcgtttcacgcacgcagagcaccaacgggcgacgctctttcagcaccacatctgccgcacgggtcagtaagccatcagtatagctatggacaatgccggacagggttttgattgaacagggtaaaatcaccatccccaacgtctggaaagaaccggaagaaatgctggcagcaatatcgcgcgcatcgtgtgtcacatcagctaacgcctgcacttcgcgcagggaaaaatccgtttcgagggataaggtctggcgcgccgcctggctcattaccagatgcgtttcgatatctgtgacatcgcgcagaacctgtaataaacgcacgccataaatcgcgccgctggcaccgctgatgcctacaatgagtcgtttcataaatagttgccctgtcagacttgcaggctgactttgcaggatttcggcgggagttgcaagtcagggtgccagaccggcaccctgagcgaaggcatcatccttcgttatgcatttcgagattttccacttcgttctgacgttgcactgctttggcgtcgtcattacgtaaagtatcgaggaaatcgaggtagccctgatcaacgtctttggtgacgtagacgccgttgaacaccgagcattcaaactgctggatatccgggttttcagcgcgaacggcttcgatcagatcgttcagatcctggaaaatcaacccgtcagcaccgatgatctggcgaatttcatctacttcgcgaccgtgagcgatcagttccgtggcgctcggcatatcgataccgtaaacgttcgggaagcgaatttccggtgccgcagaagcgaggtacactttcttcgctccggcttcgcgtgccatctcaataatctgctcagaagtggtgccacggacgatagagtcgtcgaccagcaggacgtttttatcgcggaactcggcgcggttggcgttcagtttacggcgcacggacttacgacgcagctgctgacccggcatgatgaaggtgcggccaacatagcggtttttaacgaagccctggcggtacggtttgcccagaatacgcgcaatttccagcgcgatatcacacgaggtttccggaatagggatcaccacgtcgatatccagatcttcccattcgcgggcaattttttcgcccagtttggtgcccatattcacgcgcgcgctgtaaacggaaattttgtcgatgaacgagtccgggcgggcaaagtatacatactcaaacaggcacggattgctgaccggattgtcagcacattgacgggtaaacaactgtccttcttcagtgatgtaaatcgcttcgcccggcgcgacgtcacgcaggaaatcaaagcccagcgtatcgagcgcaacgctttcggaagcgaccatatattctgtgcggttctcgtcaatatcacgttttcccagtaccagcggacgaatcccgttaggatcgcggaaagcaaccataccgtggccgatgatcatcgccacacaggcatacgcgccgcggattaagcggtttgtagcagcgatggcggcgaaaatgttgtcggcttccagcgggtagtggcggaagttgtccagctcgctggcgaagatattaagcagaatttccgagtcggaagtggtgttgatgtggcggcgtttttcttcaaacagttttttacgcaactcgtgagcgttggtcagattgccgttgtgggcaagcgtaatgccatacggggagttaacgtaaaacggctgcgcttcagaggcgctggagctgccagccgtggggtaacgcacatgaccaatgcccatattgccctgcaaacgctgcatatggcgagcttcaaatacatcgctcaccagcccgttcgctttacgcaaacggaagcagttattggcatctatggtgatgatgccggcggcatcctgaccgcgatgctgaagcaccgttaaggcatcataaatcgactggttaaccggcataacaccggcgataccgacaataccgcacatacgtctttttcctcgttaagccacatctcagagcacttacgctctgggcaagaaacttgacgagctttgcagataatcaaaaaaccatctgatgataaaactgaactgcgggatcagctgtgatttgctccagtcttcgcttttcgacaccccggtaaaggagtcgagaaagaagagaatggcagcaacaatcaacacaccgcgcaacgcaccgaaacagacgcccaacacccgatcggtgcctgacaaccccgttttctccaccaactggcctatcacgaagttcacgatagcaccaacgatcagggtagcgataaacagtaccgcgatggcaatcccatttcgaaccagttcgtcttcaaagcccgtaaaccagactgacaggtaagtgtagtaatgactggcaacaaagaaagcacaaccccatgtcaccagcgataacacttcacgaacaaagccgcggatcaggctaaccagagaggaaaaagcaatcaccgcgattatggcgtaatcaatccagaccatatgtgtcccacgattttacgccctgtcatcctgttcggggcgcattctaacagaaaaagaaaacgtttgcgtagggatttccttcccgcgcatcaataaaaatggcgctgaaaaaatattcaacgccatcgactttttatgcctttgcggcatcgggcaatgcgtgtcggatgccgcatgaacgccttatccgacctacagttctgctccagcacaggcctgataagacgcgctggcgtcacatcaggcaacggctgtcggatgcggcgtgaacgccttatccgacctacggttctacccctgcacaggcctgataagacgcgctggcgtcacatcaggcaacggctgtcggatgcagcgtgaacgccttatccgacctacggttctactcctgcgtaggcctgataagacgcgctagcgtcgcatcaggcaacggctgtcggatgcagcgtgaacgccttatccgacctactgttctacccctgcacaggcctgataagatgcgccagcgtcgcatcaggcaagaccgtattaattcggtgtatagcccattaccacgccacttaagccagaaagctgcttgagctcacccagcgatcctttcagcttatctttcgaggcatctggcccaaccagaatacgggtaattttaccctgcactggcgtggatggcgacgtataaacccgataaccggcaccgcgcagcttaccgacaatctcattcactttatcggcatttttcagcgcgcccagttgcacaacataggctttacccgttggcgctgctttttcttccacgaccggcttcggttctggcttcggcgcaggtggtgcttcaaccttcggcttaggcggctccaccggtttcggcttcggtgggacgaccggtgcaggttccggttcaaactcggtgttattggctgcaatagtggccggatcgagcgacggtgctgcggcatcacctgcccgtacctcttccgctgcgccttccggcggctgcgtcggcaacgcctgggtggcggctggcatcatatcaggctcatcgcgatcgcccgcttttggcaccagcgggatagccgcgaactcatcctgataatgttttttctgcccgtccagcagccctggaagtacaatcacccccagcgctaccagcacgatcgtgcccactaaccgattctgaaacttacttgccaccgcttctcctcgcgtcaatcacttccatgacatgtgcgaccgtgtggaacgaaccacacaccagcacggtgtcttccgctttagcgtccgccattgcggcatcccatgcctgcgcaacgctatcaaatgatttgccgttacccaaatgctcaagcagttgttctgccgtggcaccgcgcggcccttccagtggcgcacaataccagtcatcaaccacgcttttcaaccaggccagagttccggcaatatctttatcatgtagcataccgataaccgccagcacgcgcccgtttttcggtagcgctttcatacgcccggtgagatattccgccgcatgtggattatgcgcgacatcaaaaataacgcgtggcgactcgctcacaatctggaaacgtcccggcaaaattgcgctggcaatcccgtcgcgaatggcattttcactgacctccagcccgctggcacgcagtgccgccagcgccgttgcggcattcggttgcgggacaagcggcaacggcagattttccagcgtgccgtgagcatcgctaaacgtccagtcatgatcggtgacggaatagttccactcaacgccccgacgttgtagcagtgcacctttttcctgcgccacatcagcaatggtagaaggcatctccggctcaccgacaattgccggtttttcgctgcgaaagatacctgctttctcgcgaccaatactttcacgatctggccccagccagtcggtatgatccagcgcaatactggttactaccgcgacatcggcatcgacaatattggttgcgtccagacgaccgcccagccctacttccagaatcactacgtcaagttgtgcctgcttgaacagccacaacgccgagagcgtaccgtactcgaaataggtcagggaaatatcaccgcgtgccgattcaatctccgcaaaagaagcggtgtgggccgatttcggcaattcctgaccctgcacacgtacgcgctcggtataacgcaccagatgcggcgaactgtagacgcccactttgtaccctgccgccatcagaatcgactccagcgtacggcaggtggtgcctttgccattagtacccgcaacggtaaacacaaatggcgctggtttcagaacgccaagacgcgccgcgacctggctcacgcgctcaaggccgagatcgatagttttactgtgcaggttttccagataagaaagccacgaagccagaggcgacgcggcttgaggagtgcgtttgataatcatggtatccgctgattcgttacggtgagaatagcaaaagggcagagccagtggccctgcccttatcagttatcaggcctcaggttcctgatccggtaccggtggcaccactacgccttcacgcggcgcttcaggattcggcgctggcagattcatcaacttcgccagaatgctcgccagtttcaggcgcatttccggacgacggacgatcatgtcgatcgcgcccttctcgatcaggaattcactgcgctggaatcctggcggcagtttttcgcgaacggtctgttcgataactcgcggaccggcaaagccaattaacgctttcggttcagcgatgttgagatcgcccagcatggcgaaacttgcagaaacaccgcccatggtcgggtcggtcagcacggagatgtacggcaagccgcgctcctgcatttttgccagtgccgcagaggttttcgccatctgcatcagcgacatcagtgcttcctgcatacgtgcgccaccagaggcggagaagcagatcagtgggcagttatcttccagcgcctgctcaacggcacgcacgaaacgcgcacctaccacagatcccatggaaccgcccataaaggcgaactcgaatgccgcagcgacaaccggcattccatacagagtgcctttcatcaccaccagcgcatctttttcgccggtttctttctgcgcagatgccagacggtctttatacttcttggagtcacgaaacttcagcacatctttcggctcaagctcgctacccagctccacaaggcttccttcatctaacaggctatgcaggcgattacgcgctgtcatacgcatgtgatggtcacacttcggacagacctcaagattacgttccagctcagcgcggtataaaacctgaccgcagctatcacacttagtccacaccccttcaggaatgctcgccttgcgggtgggagtaatgttgcttttaattcgttcaatccagctcattagggacctttctgtctgaacctggttcgatgccagttttatctttggggacgcataatgccatttttgcccccaacagaccatgaatgttgcacattaaaacataacagcccgaaactttggataaaaaagtggtcgaaccgcagagttactttttattttgcggcgcgtgccgctgcgcgtttgtggcgaataaattcgaaaacacctggcaatattgaaacaaaaataatgccaacaatcatcagtttaaggttgctctgaatgaaggggagcgtgccgaagaaatagcctgcgtaggtaaaaagcagtacccacaacagtgcgccaatcacgttataagcggcgaaatgacggtacgacatgtggcccattcccgcaacaaacggggcgaacgttctgacgatcggcacaaaacgggcgagaataatcgttttgccgccatgtttctcataaaactgatgggttttgtcgagataactgcgacggaaaattttcgaattgggattactgaataacttttcaccgaacaaccgcccgatagtgtaattgaccgcgtcacccacaatcgcggcgatcagcatcagcaccaccatcatatggacgttgagatcgttggtctccagtgatgccaacgctccggcaacaaacagcaatgaatcacccggtaaaaacggcgttaccaccagaccggtttcacagaacaaaattaagaacaaaatggcataaacccagacgccgtactccgcgaccagctctgccagatgcacgtcaatgtgcaggataaaatcgatgaggaaataaatcaggtccatatttgcctatgccttgtactcgtcatctatcaggctgtaactacgttggctacagcctgaaatgttccgagcattattctcgttagtccgccagaaatagcgggcccattggcggttttggaagatcatatcggtcagggtaatccaccgcgaccagatatagcccttccgcttttgccgttgctgccgccagcgttctgtcctttgccgccagcaactctgctatccagctctccggctggttgtgggcaccgacttccatcaggctgccgacaatattcctgaccatatgatgtacaaaggcattcgctttgatatctaccaccacataaggaccgtgacgcgtgacattaatatgcataacgttgcgccacggggtccgggactgacactgcaccgcacggaacgaggtgaaatcattctcgcccagcaagcattgcgcagcccgatgcatccgttcagcgtccagcggctcgtaaaaatgggttactcctttactcagtaccgccgggcgcagccgatgattgtagatgatgtagcgataacggcgagccgtggcgctaaatcgggcatgaaaatcatcaggtacagctttaacccaacgcacggcgatgtcaccaggtaaattcgcatttacgcctaacgtccacgcagcgtctttgcgctgcgcggtcgtttcgaaatgcaccacctgcccggtaccgtgtacccctgcgtcagtacgcccggcgcagaagacggtgatgggttcgttcgccacctgggagagcgccttttccagcttctcctgcacactgcggacttcattctgccgttgccagccgtaatacctactgccgtcgtactcaatgcccagcgcaattttataaactggcggttgttgctggtcggacattagtacagatactcctgcaccagtttctcggcgatttttactgccatcagcgcgccgccaaagcgaacgttatcggccaccgaccagaactggacttgctccggcataccgtagtcattacgtacgcagccaacagaaagatgcggactaccagaagcatctcctacctgagtcgggaattcgttctcttcagagagcacaatatcttcgccctgagcaaacgcatcacgcgcttcttctgccgccagcggacgcagtgcttcaaagttgaccatctgggcatgaccgtagaataccggtgcctggacgacgcttgccgaaatcatcagcccttcgtcctgcaggattttgcgtacttcgtcaacgatacgacgttcttcacgcacgctaccttcgctatccggcagtaacggcagcatgttgaacgccagctgacgcccgaagaaatcttcttcgtcaatcggaatgccattgagtaatttagcactctgccccgctaacgcatcgaccgcttttttaccctgggcggaggctgaaatcaggctggtaacgctgatacgcgacaaaccgccctgatcgattaacggtttcagtgccgccagcagttggctggtcagactgtctggtacggcgatgacattccggttgcggtaatcggtcagtacaaacgggtttacttccggcaccaccagcggtacgtcgggttcgagagcaaacaatccgctgctgtcgatcaccagacaacctgagttggttgcttcttcaacccaggtagcggtagcttctttgcctgcgacaaaaaacgccagctgcgcctgcgtccagtcgaattcagcggcatcctgcacggtgattgtcttaccaccaaagcgcagttgttcgcctgcgctttcgttacgtgccagtgcataaatttccccaaccgggaactgacgttcagccagcgtttcaagcagggcttcgcccacagcgccagttgcgcccaggacggcaatgttccagccttcagacatggtggtttactccagaaatagcaaagctccctgccaatgttacagcagagagcatgaagaagagattaacgtgccggatgatgaacggcgttaaaacccagtttacacagcaatgatgccgcactggcgtcatcacaaatcacatacagagatgaccattcacggcgctcaagatagtttttgcgcagtttatcgaactcacccggtatcccggcgactttacgcagcggtgcgtcatcgcggcgcacatcatacaccaaatgcaccagccttttcagcgtcggttgatcgagcgggccatgcagcgtaatgcgaccaaactctggcgcgggcagtaatgtatccagcgcaacgtgctgttcatgcccaataaacttgctataagcttcaaacacttgcgtagtaccgcgtgctttaccttccagggtatagcctgcgatatgcggcgtgccgatatccacttttttcagcaattccacgttaagttccggttcgccttcccagacatccagcactacgcttaacttctggccttcgctcaggcaggtcagcagggcggtattatcgacgactgcgccacggcaggcgttaatcaggatcgctcccggtttcaggctgcggatcagtttttcatccgccagatgcagcgttttgtacggaccatctttaaagagtggcgtatggaaagtcagaatatccgcatgctggactaactcatccagcgagcggaaatcaccctcatccccacggtcggcgcggggcggatcgcaaagtaaggttttgatccctaacgcttccagtcgcgcctgtaaacgacgaccaacgttaccaacgccaacgatccccacggtacgctcgtgcagtgaaaatccatcgcgttcggcaagcatcagcagggaggagaaaacatattccactaccgcaatcgcattacagccaggtgcagcggaaaaaccaattcccgcctgctttaaccaggcttcatcgacatggtcggtccccgcggtggcagtgccaacaaatttaatgggttttcctgccagcaaagattcattcactttcgtgaccgaacgcaccataagcgcatccgcgtctgccagttgagcgacgggaattggacgcccgggaaccgcggtcacctcacccaaacggctaaataagtcgcgggcataaggcatattttcatcaacaaggatttttaaccctttttcagtctctgacaatctaaggctcctttatcaacaaacgcccatttgcaaactgctgtttaatctgaaaaaacattaataatcatacagataacaacataaccatttagacgggcaatactgaaaaattgttattcagtatcgccctttaagccgtttcaggctatataaaattaatcccccgtggacactgcgtggacacttacgccacctttcagcggattaagggccaccgcatcctgcaggtaatccggtgcaaaatgcgcatatgccattgtttgctgaatggttgcgtgaccaagaatcttctgaagcgcaataatgtttcctccgttcatcacaaaatggctggcgaacgtatgccgcagcacatgtgcagcctggccttttggtaaatcgggcttaactcttttcagcgccaggcagaattcccggtacttcacctcaaacaagctgcctgtttctctggttttgatcgcctcacaaactgcctgcgaaattggcactgttctcttccggccatttttggtttcaagaaacgttacacggttatgaactatctgttcaccacgaagcttacaagcttcactccagcgcgcccctgtgcttaaacacaaaagcgcaacacgccagtagtcgccctccagtgtatcgagcaatagcgccacttccttctgtgacaggaacgccatttctcgtggagatacataaagaatagaaattccccttactggatgttctgcatcccaaagacctatttttttcagcacggtaaacattccggataaccgattcatgtacctgttagcagatgacggtttcaatccttcagctatcttttgagaacgccacgcgataattttcagcttatcaagatccacagcctgcatatcagcgccaagctcattaattatgttgcgcagttgttttcggtcttcttccgccttacgcctgtgctggccgtgatacatccaccacaactcaagcaaatcatttagcgttcgacgatcacggtagccctgtatatattcccgcttttcagcgttcgccatgatgtagcgttcagtggccaccgctaccgattttttgtcaaataccttacgcacgcgctttcccttgcgtccgttcggcctgatgtccagcaaataacgaccatcttcgagcttcttaatcgacattacgaagccctccaatgaaccgctctacaatttctccagcctctttccagcaataatcagaccagacaaaaagcaggtctaaccagttttctggcctcagcgggataatttttggattgtttcggttgaaacgcgatctccctccgaattgcaggaaccatcaagagagagagccggagaaatttgcccgacctccggcatcgtttcatctgttgataaccaataagcatacttcttaaatttagggtgtttcgtaaccttaagtaaggcaccctctgttacttgcttccccctcacctcatagttagttaccgtcccataaggcagcccaacacaatccgcaaactcctggcgggtcataccttctgcttcacgaatcaggcgaaatttttcacccatgcttgacaaagatgccatatcgggcatatcctccatcgcaacatgccacatcgggcacaaacataaaaacactcaaataagccgatataagccattttgagccattcgaacgaattagggagattaccacaatgagcgaatcagagcttggggggttcattcaggtagcaccatatccacttgaagcggtgccatatcaactattcgccaagatgatcggccgcaaggaatccacagtcagaaccatgattgacgcagcaaagctaccgacaattgactttgtgaaaccaggttcagtaaagacgcgtgcatcagaaaactgggtatatctgccagcatttaacgaaggcatgcgcaaagcgttttttgagcaaccgaaagaacgccgcgacgcatggttgttgtggctgggactttagtcataaatgaccagccatatcatcagcgccattctgacccttgtttttattgagataggcgtaatagagatctatttgtttcgcaagttaacgggacatgaagaacgctttattgaactcagcattgaatatatcgccgcttataccaaaggacttttcccggcagctattggggcgatgtttatagcgtttgttatctggtttatcgggtgagaaacctgacaacccacaactactgcaatgagggtaattatgtgtggcatggacaaattggaccttatgttaattgtaatactatcaattaacttcggttacctcttaagcggcgcaattctcatgtgcggaggcaaacgaaaatgaaccagcagtccgcaaaacgtgaaaacaatgcgatgcgatttaatcgcaaatattttgagttcggcctctatgccggaataattaaatctgtacagagtctttaacatgaaacagcaacgtaattcacgctttcgcaatggtgcagaacgccacgctaaccgttttgctaccagtgcatcacgcagcaacatccgctacagcctgagtgatacacacgcaacgccggatggctacccagtaaaacaaatcggcgagcatgcctggctgattgagaaagctggaatcgtgatccacaaatgcccacacaatccgtttaccggaaaccgcatttttactctaagcagtggcgacaatcagttcgggcaggatttcacattatacgaagcacttcgcacggttgatcgtctgcttcgcgggcaaagttttattaaacaggctgatttataacaggtgctttatgaccaaagaccatgcacaaggtgtatttatccgttttattgattttcgcggtgaactgttattacgtgcatccgctattgacggagtgactccggcgggtaaaaacggagccgacgaagccacttacgtttatctgaacggcacgcgactgcttctggaacttccgtaccagaccgtacgagaaatcattagcgaagctgaaaaggcacgccaggctaatggcgatgaaccctatatcgaaattatttgtatggattcagaagctgaaatacagaaagcagattaaagggcgttgtgatgggcaaagaatataaaactctcattaacaaagcacttgagcgtttttattttcgcttaagtgcatcaggcgctcatgctgaacgtgcggcccgtgactcattgaccagagcaatccgaagtctgtatgacgtggctttttacgctgatgatctggatgcacttaacgaactttccgagctgatctgtgccgcagaatgcggggaacatattgaaccgtataagctggggaatatcgcatgagtatatttatctcatggcttgttctgattatttcggtggcctgcgctattgggattatgcgaattattcattcaataaaaaagattgaacgttttttcactggcgaataacagagcaaataaaaccacagataaaataagaaaatgtaaaaacaatccgcattagcggaggtattcgcacacgccaaggaggcgtaatggcaattaagcattttcctgtcgttcgttttacctccagagggcgtgaatacgaagtcgacgaacgcctgattaccacaatcgacaaacaccgttcggaaaaggatgcacaccacatctacctcactgacggcacttacttctgcgccaccaacgtggcgcgggtgaatcttatccgacaggtacaggagccacgcagatgaccattctggactacatcgctacccatccgggttgtagcggcggagaaatcgccgcagcactgaataccccaaccacagccatcaatgctgagttacgccgactctggcgcggcggcttagtcatcagaacaaaccgcagcacaggtggtcgcgctcgcaaagcaggaggccaagcttcttaccacgtaaacccgatgccgttcgggtgtagcaatccacttactcacatgtttaaccagctactgaaggaaaccagagcatgagcaccatcaatcaccagaagctacgcgaactggcatttgccctgcaacgaatggcaacgcctcaaaaattactggtatttcgcgcaatgctctcgccgtctgctgtgctggcactgctggatgagctggagcacgccagaaccacggctcctgccattcgcctgacgctccatcatgaaatcgctgatttctgcgcgacgttgaaggcgccaggcgaaccggaaacaccggaagcaatacagcaagagctgctgcaacgcattgacaaggtttttgatttttttctgaaccagtaagaaaccagaacatgcacacacaaaaaaaccgcttgccatgccgcaatcagtcaggttacatttccgctgcacctcacaaaacgggtgtcgggtttcgcagcctgctgactacacaagcgcacaaccgcgccagcggtttttttgtgcgtactgtattgccacgtttttttcgcgtcagaattatggcggggcgtacggggccgacttcggtcgggccgggttcttgtgtagccggtactgcgaacctcgtacgtctcgccacccacagtttcgcagctctggatggtgagttttcacaacttactacacaaggggccacaccatggcaaaccgcaaaccacaccgcgctatcgcggagcgtcgtcacatccagactgaaatcaaccgcagactttcccgcgcatcacgcgtcgcgcaaatcatgcacatcaatatgctgcatgagcgcagccacgcactatcaaacatttattccgcctctgttttcagctatctggcggatgatctgcactagcttcaacagctcatccagcagcaaaacaaactccattaattcctgttccgggcctttcctgcaccttgcggcgggaggccttcgcacatctgtaacaagaggattgccgcaatgattctcgccaacgactttcttgaatacctgctcaacacagaacgtgatcttgccgctcgcgtgcgtgatcgttatgacatgtacctgaaatccctgcctgtaccgcagctcgctgacggaaagattgttattgatggtcgctacatgattgacagccacgagggaaattacaggctttaccgcattgaaggtggcaccccgtccgttattggcatttaccagcgcccatcctctgcaatcgtcgatgtgattgccgacagcatccgcatcacacatcgccatgccgacacagaagacaccgtgctggaaattcagcggctggctacagtctgccgcgacaccctgaatggcatgtcgaagtaaatcactatgacggcagagtacatcagggactggcaacaaccgcgccacgcagtggggcgtgaaggaacggggatccccgctcctgaatccgcgctttcctcctggctggatgcctaccgggtagagaacgagcgctgccaggaaatggctgatgcggcgttctccgcaacgccgctgggcaacctgattaataaaagcctggacgcacaggaaaaacaggacaaaaccatcacactggcaggagacgccagaaaacaggcacgcggcgcggtggatgaagccatggcttcgctgcgcctgctgccgtcctatctgcgcgatccgcttattcgccacctctccttcctgcgcaaaaaacaggaagccgatcgtcagaaaggcaaaaagagctggcaggctgaacgctacgcgcgcggaaacctgcgcaaaatattcgaacgtctggagcgcaccgatcaccgctggctgacacagggttatcgctcccttgccggacgcgaacgcctggatgatttgctttacctgccgcagctcaaccagcaccagatacagacgctggccaccatgacggcggcgatgttcagcagcaccttcgaaaaactctgcgatggctttggcgcgaccgatggcgaactgaccatggatgtaacgctgaaggcgtatcagatgctggcccgcatggcgttacacctgcacgccatgccgccacattacgaagctctgaacaagagcgatccggatacggaactgttaccgggcgcaatccttcgcctgacctgtgcggaatggtggaaacgcaaactgtggctgttacgttgcgagtggcgggaagaacaactccgcgccgcctgtctggtttccagaaaaacatcgccctatctgagccaggacgcgttaagcgagtttcgcgcacagcgcgagaaaacacgcgatttcctgaaaagtttcatgctggaaaacgaagacgggttcacgattgatctcgagacagtgtattacgcgggagtaagtaacccggttcaccgtaaggcagaaatgatggccaccatgaaggggctggaacttctggccgaagcccgtggcgacaaagcggtgtttctgaccatcacctgcccgtcaaaataccacgccacaacagagaacggtcatccgaatcccaaatggaacggggccaccatgcgcgactccagcgattacctggttaacacgttttttgcggcggtccgcaagaaactgaaccgcgacggcctgcgctggtatggcatccgcacggtggagcctcaccatgacggcaccgtgcactggcatatgatggtctttgctcatccggaagaaatcgacaccattgtgtcccacacccgcgatattgccattcaggaagatcgtcacgagctgggtgatgatattaccccacgctttaaggcggagtacgtcgacggctcaaaaggcacgccaaccagctacatcgccacctacatcggaaagaacctggacagccgcgccgtagatggcatcgac

SEQ ID NO: 10038 - DNA, 23938 bp, Escherichia coli
tccctgcgtgaatatctccggtgagccggaggcgtatttccggatggctccggaggactggctgcaggcagagatgcagggtgagattgtggcgctggtccacagtcatcccggtggtctgccctggctgagtgaggccgaccggcggctgcaggtgcagagtgatttgccgtggtggctggtctgccggggggcgattcataagttccgctgtgtgccgcatctcaccgggcggcgctttgagcacggggtgacggactgttacacgctgttccgggacgcttaccatctggcggggattgagatgccggactttcatcgtgaggatgactggtggcgtaacggccagaatctctatcttgataatctggaggccacagggctgtatcaggtgccgttgtcagcggcgcagccgggcgatgtgctgctgtgctgctttggttcatcggtgccgaatcatgccgctatttactgtggtgacggcgagctgctgcaccatattcctgaacaactgagtaaacgagagaggtataccgacaaatggcagcgacgcacacactccctctggcgtcaccgggcatggcgcgcatctgcctttacggggatttacaacgatttggccgccgcatcgaccttcgtgtgaaaacgggggctgaagccatccgcgcactggccacacagctcccggtgtttcgtcagaaactgagcgacggctggtatcaggtacggattgccgggcgggacgtcagcacgtccgggttaacggcgcagttacatgagactctgcctgatggcgctgtgattcatattgttcccagagtcgccggggccaagtcaggtggcgtattccagattgtcctgggggctgccgccattgccggatcattctttaccgccggagccacccttgcagcatggggggcagccattggggccggtggtatgaccggcatcctgttttctctcggtgccagtatggtgctcggtggtgtggcgcagatgctggcaccgaaagccagaactccccgtacacagacaacggataacggcaaacagaacacctatttctcctcactggataacatggttgcccagggcaatgttctgccggttctgtacggtgaaatgcgcgtggggtcacgcgtggtttctcaggagatcagcacggcagacgaaggggatggtggtcaggttgtggtgattggtcgctgatgcaaaatgttttatgtgaaaccgcctccgggcggttttatcgtttatggagcatgacgaatgggtaaaggcagcagtaaggggcataccccgcgcgaagcgaaggacaacctgaaatccacgcagctgctgagtgtgattgatgccatcagcgaagggccggttgaaggtccggtggatggattaaaaagcgtgctgctgaacagtacgccggtgctggacagtgaggggaataccaatatatccggcgtcacggtggtgttccgggcaggtgagcaggagcagtcaccgccggagggatttgaatcctccggctccgagacggtgctgggtacggaagtgaaatatgacacgccgatcacccgcaccattacgtcggcaaacatcgaccgtctgcgctttaccttcggtgtacaggcactggtggaaaccacctcaaagggtgaccggaatccgtcggaagtccgcctgctggttcagatacagcgtaacggtggctgggtgacggaaaaagacatcaccattaagggcaaaaccacctcgcagtatctggcctcggtggtggtgggtaacctgccgccgcgcccgttcaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgccctgaaggaccgccataatgccgttgaggtgaactggattgacccggataacggctgggagacggcgacagagcttgtggaggacacgcaggccattgcccgttacggtcgtaacgtcacgaagatggatgcctttggctgtaccagccgggggcaggcacaccgcgccgggctgtggctgattaaaacggaactgctggaaacgcagaccgtggacttcagcgtgggtgcagaagggcttcgccatgtaccgggcgatgtcattgaaatctgcgatgatgactatgcgggtatcagcaccggcgggcgcgtgctggcggtgaacagccagacccggacgctgacgctcgaccgtgaaatcacgctgccatcctccggcaccacgctgataagcctggttgacggacaggggaatccggtcagcgtggaggtccagtccgtcaccgacggcgtgaaggtgaaagtgagccgtgttcctgacggcgttgcagaatacagcgtgtgggggctgaagctgccgacgctgcgccagcgcctgttccgctgtgtgagtatccgtgagaacgacgacggcacgtatgccatcactgccgtgcagcatgtaccggaaaaagaggccatcgtggataacggggcgcactttgacggcgaccagagcggcacggtgaatggtgtcacgccgccagcagtgcagcatctgaccgccgaagtcactgcagacagcggggaatatcaggtgctggcgcgatgggacacaccgaaggtggtgaagggcgtgagcttcatgctccgtctgaccgtgacagcggatgacggcagtgagcggctgatcagcacagccaggacgacggaaaccacataccgcttcacacaactggcgctggggaactacaggctgacagtccgggcggtaaatgcatgggggcagcagggcgatccggcatcggtatcgttccggattgccgcaccggcagcgccgtcgcagattgagctgacaccggggtattttcagataaccgccacgccgcatcttgcggtttatgatccgacggtacagtttgagttctggttctcggaaaagcggattgcggatatcaggcaggttgaaaccacagcacgctatccttggcacggcgctgtactggatagccgccagtatcaatatcaaaccgggccatgattattatttttacatccgcagtgtgaacaccgttggcaaatcggcatttgtggaggctgttggccagccgagtgatgatgcatccggctatctgaattttttcaaaggagagatagggaaaacccatctggctcaggagttgtggacgcagattgataacggtcagcttgcgcctgacctggctgaaatcaggacgtccattacgggtgtcagcaatgaaatcacgcagaccgtcaataagaaactggaagaccagagtgcagcgatccagcagatacagaaggttcaggttgatacaaataataacctgaacagcatgtgggctgtgaagctgcagcagatgcaggacggacgcctttatatcgcgggtattggtgccggtgttgagaatactcctgacggtatgcagagtcaggtgctgctggcggcggacaggattgcgatgattaatcctgcgaatggcaacacaaagccgatgtttgttgggcagggcgatcagatattcatgaacgaagtgttcctgaaatatctgacggctcccaccattaccagcggtggcaatcccccaacgttttcactgacacctgatggtcgactttctgcgaaaaatgcggatatcagcggtaacgtgaacgcgaactccgggacgctcaacaacgtcacgattaatcagaactgtcggattctgggaaaactgtcagctaaccagattgaaggtgatattgtcaaaacggtgggaaaagcctttccgagaaatggcagttatgccagcggtacaataacggtcactgtgtacgatgaccaggcttttgaccgtcagatagtagtcccccccgttctgtttcgtgggggtaagcatgaaaacttcaacagcaacaaccaacagtcatactggtattcaacctgtaagctgcaggtactgaagaacggacaggaaatctttcagcaacccgcgacggatgtcagcagggtattttcatcagtcattgatatgcctgccggacacggccatgtcaccctgactttcaatgtttcttcatatggtgctaataactggacgccaacgaccagtatcagcgaccttcttgttgttgtgatgaagaaatctacagccggtatcagtatcagttgaattttataacccagatacgggcgccagaaatggcgccttttttatttgtggagtgaatatggcagtacagatttcaggcgtgctgaaagacggtgcaggaaaaccgatacagaactgcaccattcagctcaaagcaaaacgtaacagcaccacggttgtggtgaacacggtggcctcagaaaatccggatgaagccggacgttacagcatggatgtcgagtatggccagtacagcgttatcctgctggttgaaggttttccgccttcacatgccggggccatcaccgtgtatgaggattctaagccggggacattgaatgattttctgggcgctgcaacagaagatgatgttcgtccggaggcactgtatcgttttgaaaagatggtggaagaggtggcacgcaacgctgaagccgcctctcagagcgcagcggcagcaaagaaatcagaaacagcagcggcatcgtccaggaatgcggcgaaaacatcagagacgaatgcaggtaacagcgcgaaagcggcagcttcttcaaaaacagccgcacaaaacgcagcaacagcggcagaacgttcagagacaaatgcccgtgcgtcagaagaagcctccgcagacagtgaagaggcttcccgccgtaatgcagagtcagccgctgaaaatgccggagtcgccaccacaaaagcgcgggaggccgcagcagacgcaacaaaggccgggcagaaaaaggatgaggctctgtcggcagcgacacgggctgaaaaggcggcagaccgcgcagaagtcgcagcggaagtgactgcagagccctatgcgaatatagtgccgccgctgcctgatgtgtggataccgtttaacgattcactggatatgattgcgggtttttctccgggctataaaaaaatagctattggtgacgatgtggttcaggtcgccagtgataaacaggttaatttcagtcgcgcatcaacggcaacatatatcaacaaatctggcgaactgaaaacggcggaaattaatgagccgcgatttgagtgtgatggcctgcttattgagggacaaagaacgaactacatgctcaattcggaaagtccagccagctgggggaagtcatcaaacatggatgtgcccgaaaccgggacagatagttttggttttacttatggaaagtttgtctgcaacgattctctggttgggcaaacttcggctattaatatggcatcaattgctgcaacaaagtcagttgatgtctcaggcgataacaagtacgtgacaacctcatgccgttttaaaacagaacgacaggtaaggttacgtatacggtttgataagtatgatggtagtgcaacaacttttcttggcgatgcgtacattgatacgcaaacgcttgaaattaatatgacaggtggggctgccggcagaattacggcacgagtcaggaaggataagaccacaggctggatttttgcagaggcaacgattcaggcaattgatggtgagttaaaaataggctctcagatacagtattctcctgagcggggtggggcaacagtatctggtgactatatttatcttgccaccccacaagtagagaatgggccgtgtgtatcatcatttattatttcaggaggcagcgcaacgacaagagccagtgatttggttagtatccccaccagaaataatctttataagttaccatttacttttttacttgagattcataaaaactgggatattgcaccaaacgccgcaccccgcgtgtgggatatagcagcagccaataccgggcaatcagcaattgcagcaatcaacagaggtagtggtaagttatatatgagtctgtcaaacccttcaggcttgtatgttaatagcgcagcgacagatgtatttgcagagaaaaccacatttggatgtattgcaaaagctgatggtcactttcatgtggtgacaaatggtaaagcggttaatgaagtttattgtgaatataatggtgtgaccgctgataaaaatatccgatttggagggcagacgaatactggagaacgacatctgtttggccatattcgcaatttccgcatatggcataaagaattaaatgacaggcaattaaaagaggtcgtatgaaagatttaactttgaagtttcatgacaaactgcagtttaaggccttcctgtcatctcttgactgggaggaggatgaagacctccagaataaactgttagtcgatgaaattggtttcacctacacagaaacaggggtaacagaagagggagaacctgtctgtgtccggaatgacggttattttgtcaacattcgcattcttgatgacttgtttgatgtttctgtattctctgattatgtcgtggagctggaaacaccgcttcgggaatggagctgaaaggaggaaataatggatataagccccttacttcatgcgctttgtgctgtggctgcgcagatactggttggtctttttaccggaaactgggcttacggagcgatagccggttgtacgttcttcattgcgcgtgaacatacccaggcagaatatcgctggattgaaatgttcgggcatggcaagcgaatgaatatgccgtggtggggcggttttgatccgcgagcttgggatgtggcaagcctgatggattttgctgtgccggtggtggcgtgtctgctggtctggctgttggttaatcgtgggtgaaaaaaggtgagctgtatatgcaacggaggaagaaaccccgttgctggaagccaggaaaaagtatcgggtgttgctgtcctcggatgttgtgctaattgggtgataacagatcctgtgtatgggagtttccctttttgcgtgcgttgatgctggtaacggcaaacgtcatgatgaacaaaaccgcgaataagacgacaatcgtcggagctggtgcgctgtcgataaaaaaggacaaccagacaccagtcattgacactattaccgatatgccagtcgccagtaggagcgcaatatgaaagcgttgtgtcaggagtaccgcaatggcgccaggcgcaatgagcagagaaatggagagaatgatacctaccgctttcagcgtcgccacaatggtcagagagaccatgcacagcagcccataatgcagccatctcgtatgcaaaccgcttacctgcgcctgttgataatcaaagctgaacagcaaaaaatcccgccattttacgctaataacaagtgtaaccagcccggcaataatcatcgtctggattatatcgccgatggttatcccgagcatgtcgccgaaaagaatatggtcaagatgtacgtctggtttgactgcaatatacaagatcagacctgcggcaaacatgccagaaaaaacaatccccatcactgtatcttgcttgattcggctgttgtctttcaggtatcccgtcgccaccgcgcagaatactccggcgacgaatgcccctgtagccaaaggtaaccccagaatccaggcaagcacgattccaggaaaaaccgcatgactcatcgcgtcacccatcagtgcccaacctttcaggaccagaaagaccgacagcagcgcacagggtatggaaactaccagtgaaatcagcagtgcgtgactcataaaggtgaactgcagtggctccagtaataatgccatcatgagcgatcctccagcgccttatgcgcacgccgacgatttgccaaaagcccatgggtgggcgcaaagacaaatgctaaaagaaacagcagtgtctgcgccaccacgatgattccacctgtcgcgccgtccagaaagtaactgacccacgcgccgaggaaactggtcacactgccaatagttacagcaatcatgagcaggcggggaaaacgatcggttaacaaccatgctgttgcaccgggagtcaccaccagacagatcaccagaaaggcaccaaccgtttgcagcgccgcaacggtcgaaaccgacagcagggtgaagaagatgagttttaatctgcccggatgcaatccaatagcacgggcgtgattctcgtcgaaaaaggtcaccataagatctttccatttgaaaaaaagcacgatgatcgagagaatgccaatgatagtgagttgcaggatatccgccggatcgattgccagaatattgcccaggacgatggtctgaatgttcacagatgtcgggttcaatgacaccataaacagccccaggccaaaaaaggacgagaagatcagaccgatgatggcatcttcttttaagcgggtgcgttggttaagaaacagcatgctgcccgcagccagtccgccggaaaagaaggctcccagagaaaacggaagccccagcatatatgcccccgcaacacccgggacaatagagtgcgacaacgcatcgccaatcagcgaccagccttttagcatcagatagcatgacaggaaagcgcagagaccgccgaccatcgccgagacccacatcgcattgagcatatattcatagctgaagggttccagtagcacgttcatctttcttccctctgcaccgctgacggtcgatgagccacaaaagggcgttcatcgtcagtaataatgctttcttccgagccgttaagtgtgacatggcgcagtacgccgctaaaagccagctccaggttctcggctgtaaaagtggtgtctgtcggcccgcttgccaggacggtgcctttgaccatgaccgtataatcgcaaaatgtcgtgacggatccgagattgtgtgttgagacaagcatcgttttgccttccgcgcgtaactccctcaacaggctgatgattttggcttcggttttcacatcaacgccggtaaaaggttcatccagcaggatcacatcaccctgctgtgcaatcgctctcgccagaaagacgcgtttcttttgtccaccggaaagctcgccgatttgtcgatggcgaaaattcaccatatcgacacgttccagcgcatcggtgacaatttgacgatccctctttttggcgatacgcaacatacccatatgcccatagcggcccatcatcaccacatcttccaccagtacaggaaatgaccagtcaacatcttctgactgagggacgtaggcaaccaggtttttctgtaacgcctgtcgcgtgggaatacccagaacagatatctttccgctggtcagacgcacaaatcccataatcgctttaaacaacgtcgattttccggaaccgtttaccccaaccagagcggcaatagatccacttggtactgtgaaggatgcatcgcgcagtgctgtgtgcccgttacgccaggtgacagtaacatcattaacgacaatgcctgcagattgcatcattatttctcccttttcccagctttaattccctgtaccagcgtactggtagtaaccttaagaaggtcgatatacgtcggtaccgggccgttttctgtgctcagggaatcgacatagagcacaccgccgtagtgtgcgccggtttcacgcgcaacctgacgcgctggtttatcggaaatcgtactctcgctaaagactgccgggatatgatttttcttaactatatcaacaaccttacgtacctgctgcggtgttccttgttgatcggcattaatcggccacagataaagctcttttagccccaaatcgcgtgcgagataagaaaaagccccttcactggtgaccatccatcgctgattctcagggagttccgtaatctgcttacgcaggggggcaagggtttgggtaatcttggctttataagtatcggcattgcgttggtaggtttgtgcatttgccggatcgtattttatcaacgcatcacgaatattatcgacgtaaatcagagcattatctggcgacatccatgcatgggggttaggtttgccctcatagggtccttcggtgatccctacaggcgtcacacccgaagagacaattacttctggaaccccattgagatgctggtaaaagcgttggaaccacaattccagattcataccattggcgagaatcagttgtgccccctgcgcacgtttaatatcgccaggggtaggctgatactcatgaatttctgcaccaggcttggttatggatgagacttctgcagcatctcccgccacgtttttggccatatccgcgatgatggtaaatgttgtaatgaccttgaatttttcagttgcacttgcctgaaatgcgatcgagcaggtgagtgcgaggccccccaagagcatggttactttttttatcgagtgcataatttagtacctatagtgagcaaaattagaacaaacatagcaacggctatgttttatagcacaacctatacaaaatgaaaatgattatcattagcggttttgaggcccaaaacagggattaggttgtttccggctggcgacgcgttattgaggaaaaaagtaaggcagctagtaggctttgaaataacgttttgcggttggctgatgcaatttcgagagtgcatgtattgaatgatttctagccgttactgattttcgtattttttgtatgggaggatttgcacctctcctcaccgagcctccatgactttactccactgtctctagggctgctgtgtgccaggagcggaagcaggggggccagagactccttaaaagttgatagctcgttttgcagggagacttacacggtaagcgttattccgaagagcttaaaattgaagcagtcaaacgggttgttgagcgtgtttatgcgctgccatctgattaatcgacggaagcagttccgtttggtctatgatgcagttgtccggcaggcgctctgtgacgcaaaagaacgataggagtagcattgaagtgaacgaggttatgcttgtcttatattatcctctattttaaaaacatcagctggttgtgtaagagtttttattgttttatcttgttgactttgcttttatgaaaacagagtgattgatacaatgaaaaccttaagtgggaaagagtttaggaaattatttaatcgttatgagacaggattctatctaagtgagtttgaatacttaaaggactttgatcctttgtttcctgaatgcgtagggaaagaattaaagttgggttataaacgaaaagttgatgtatggtgcgaagaggatgctgcgctatatgcagaatttatagctacaaaagaaaggctgaaaagaggccggttaatcctaaaaataaaccaagtgtggtcgcgtgtatatcctgcttatatttatgcaattgaagaaagaataaatgtcagggcaaaggggagagagtcatttaagtatgaaactgtgcaagaaaaacaatgtaaactttccataatgttagatggtctgaaagaccttgaatgtgaaatagctatgatttcaagtgagtttgaaattgaaaaacactctatgcactatttttatatgatttttgatattgaacgctatataaatgactgcagttactttgttttttctgctgctaaagttgttaaaggcgtgattcaatgcattggttacattgacaaaaataacaaagcaagttgcgatgaattttattcaggcagctatgaatgcttggatgatgatcaggaaacactgaactatttaaatgaatcatgcgcagagggtatagacgctgataaagatctcatcaggaagaatgagttattagccttatccctgaaggaattgtatcaacttctcgtttcaaaaaaataacaagtaatacggcgagcgatatgacgtgccatgggatatccgcacccagcagcatgttgtctccacgatgtccgcagttcgctcataatagacattcactacagttatagtagaaggtatgcatgctgctgagtggggaaagtgtgaaagaaaagaagacagctgctttgtttgtcgtcacgtttatcttcattggctatgcaagtcgtaatacaaggcgggacaaaactgagacacataaggcctcgcaatggcttgcaaggccacacatgtattgagatgttaataaaatgtagacttgtaattttgatataaatggtagagaaaatctttccccaaaataaaaacgaacgtcaatgaaatcaaacggttgaataaagttgattttggctaatacaaagacaagaaaataatatttatgattaaatatcagcgagttgaatacataatttttatatactgctgcgccatatgggctggactgaagccgcagacctgattgttaaaggtatggaaggtgcaatcaacgcgaagaccgtaacctatgacttcgaacgtctgatggaaggcgctaaactgctgaaatgttcagagtttggtgacgcgatcatcaagaacatgtaatctctacatgtgttaaatattgaaacgggcgtataacacgcccgttgtttttataaatatgttaaccgttataaaataacgtatcaaaagtcaagtgaacacatttcaaatatcaatttgatcgtattggtctggtgattatttatggggagcaataaaaagacagtattaatcatccatagggatagtctctgcacttttatttccattatgctaatgccttactgaattatgaagcattttttaagctcccaactttagctagattaatggtttattattttctacatcttcaatatataaaagcgtattatcaatggcgtagtaactgcgtttgttatgattaacatcagtaacccaccggaaaacgccagcgcctgccagtgttgaacagtattcccgaaatgtagattttccgcgaatatgaagcaatgcggcctcttttattttagctgggttcttggtcgtactaacttttaacaggttcctggttcctcttaataacaaaaccgtgtcatcgtgagtaataattctgatgttatccgtagccagataataaatgtaatgtgcaatacggtgatgttttaattctgaataaaaccaggagaagttttgctcttttctcacttgctcaaacatcttttgaaaaacaacgacctgatccatcaggataataacctcttgttaggtgtgagactgcgtagtgtgcacgatcggttttaccacttcaatctggtctgtcctttggctgtgatatgtacaaagtgtgaaagggggattacctgaattctcccggtgggcattttgcaacggaccagctccgctacaaacgctggtgtgggttcagattataacattctgtctaaggggcgggataaaggtgaatttagggggcatgaaagatgactttataaccttgctcaccccagtgttgtaaaagttcgttttgccttctcgttggtgccatgcctgtccagacaatcaatgtttgcgttgggaacagttccgggcgcggcgattcaatgggatcagcaagaacagaaatgtgccatcctgacaatgataaacgccatgcttccagccacaatcgtgctctctcttcaacattccacgccatcagaatggcctctttaccgggcttacggcgcatttcgaaaagtgaggccgctgcgtattcaattaatgcgccgtcaaacatactgctcataatgcgggaggtgttgtgatcaagcacgagacgctggcgaacaggaaggtaaacatgattaatcaattgatctactgggtactctcgacccagtgaaataattcgcgcgcgtagtttggctggattagccatacgaagaattgacatcatctcttcttgcaggcggttccagtcatcttgcgtatcctggctggtagtttccagtaatgctttaactttgcctacaggaacgccattacttatccaacgcttaatctcttcgatgcgttgtatgtcttcttcatcaaagagtcggtgtccgccttcactgcgttgtggttttaacaaaccgtagcggcgttgccaggcccggagagtgacaggattaatcccgcaacgttcagcaacatcaccaatgctgtaataagccacaattcctccttgcgatcataaatctccgtcgcctctacacgacccaataatactttgtacaatatatgctaaaattgtacaaagtataaataagatttcagctaaattggatgaaacattatttttaatgtggattaaattaaaacataacgtattcattttcacgatgatttccagaaatcatgcgaaataatgtgctgaaaattattttttctccggccacgcaactgaagggataccattcaatttagctttggaaaacagatctccctgaaacatctcaattcctgcagattcaagccacatccactcttctggtgttgccacgcccatagcagagacttgaatttcaagtgatgtacagcatttcatgatcgcctgaataattgcctgccgtggtccgcttttatgaacattggtaatcaattcctgactgattttaattctgtcaggctggaagcgtgacaggagtaacaaaccagcaaaacctgcgccaaaatgatcaattgctacactgataccggccgcctttagcgatttaaccgcttcggcaaactcatcaaaccgagatatgacttcactttcagtaaattcaacgatgatttgttcaggtaccagagcattggcctttatttcatcaagtaaaaaagagactgcgtcaggtttgttaaccagggtcataggtaatagattgattgaaatcattttatcaccgagcttaagtgcgtgtgccatcgcaaatgcaagcgccttacttttgagatccgctgtgtagatttcctcgtctttacgctgcccaaccgctatagctgacgggctgtcttcatttttttgcacaatggcttcaaaagcgattatccgccgcgataaagggtcgacaataggatgaaaggcaaagtggtcgtttatatttgatgaaagggtacaagaatcaagttctttatcagatccgtcagcgataaaaagccaggagtcttcagcaggaatctcgaaataggttgattgttcagttgcaaggacaaaagtacgaaaaaattgtagcgctctgtcatcataagttagctgaaattttgatgtgcctttgtcgaatacggcctgtaaaacgtcatctcgctcgtgcaggcgtaaatcaaataattccattcctgctttgccaaaacggcgagcaggcgcgtaatcgcacaacagttcaacaatattatagtgccgtggatcctggcatatggcccgatatatcatttgaacctgttcttccggaccttccagaagctggaaaaaatgagaaccattaaacagtaagatccctgttacgtcagaccgcatgttcctgcgatttgctatcgaaaccatttcttcaatttttttgacaggttcgtcgccacgtatatggctacgataaataagggtggtaagcattaacaatccagggtaatgggcgaggcgagagtaagacggtaacagacatatcttcttgtgtctttcttttaataccaaaacataaccgtttctttacattgataaaaagtggaaaaggttgaagacggtttggcgaaaaaacctgtataggttgtcatttaaatgatgcaatatgttttatcgtaatgcattgttttatatgaattagcactaattgcgaaaaattaatttatcattctgtacacatatttcgtacaagtttgctattgttacctcacttaacattgattaacatttttaacagaggcgtagcatgcatcaaaattcagtgacttcagattctgcaggagcaatcactcgttactttgcaaaagctaacttgcctactcagcaggaaactctcggagaaattgtgactgagattttgaaagatggacgtaatctgagtcgaaagtcgctttgtgccaaacttctttgccggctggaacaagcgacaggggaagaggaacagaaacattataatgcactaattgggttgctttttgaataatgcaacagcctgattatttaacaggttagctatgaagtcgttatgaagacatctgataatgaaagtataaaatatgaaattactggccaggcggtgctccagatactgcgcatgaagataaatttttcgttgcagactcttattaagcaattactcgtaatgaaatcggctgaggaaaatactttccgacgagatttaattgacagcataattcgtgattttagcaacagtgatacaggagggccaaaccgaagaacagcgatagctgacaataaaagtatgttcactggtaagaaaataaacagaatacattaaaatttcataagtaagatgagaggttaccatgcttgaagatactactattcataatgcaatatctgataaagcgttatcaagttactttcgtagttcaggtaatttgttagaagaagagtctgctgtgttagggcaggctgtgaccaatttaatgctttcaggcgataatgttaataataaaaatattatcttaagtctgatacactccctggaaacaacaagtgatattctcaaagctgatgtgattagaaaaacactggaaatcgtgttgcgatacacagctgatgatatgtaacttttaattataaagtataagtttatagaaaactcattcatcttatttttgtctgtcgctttagactatacacagcataattttattggatcactattcctgcgaggctgacatgaataattcaatcccagagagatttatttttcaatgtgctttgtttaaaaatctcgagagggaggtgttcatgacacatggatatgttgatagtcatattattgctcaggctttacgcttgcgtttaaaagatgagaccagtgttattctttctgatctctatctgcaaatcttgcagtacattgaaatgcataagactacactaacggatatcattattaatgacagggaatctgtgctctcttaaaacttgagtaaggtttttgaataaacatcagctgtatcactatgctgatgcaaagtgagcatttcaggcgttatgctttcttaatatatccgcaatatcagagggcaaacaggaatggagagcgctcgttttccattcttgacgcctgatatcccgcctaatttgtttaattctgcctacattgtgctaaaaaattaataggctagatgaagttggagaaaattttatcttcggcgtggatatttgtgatgctctctaccatgctctctgtagaccccagcgcgagcgaatgaacgtctctttagcttctacagacttatcgataaaggctttgggattttgatatttattctgttaatcgcctgcgccgctgccttcctgcttgataggtatttcaataaaagcgcaacgcctgaagagatcctgcgacgggctataaataatggggagatcgtccctttttaccaacctgtggtaaatggtcgggaagggacattgcggggagttgaggtgttagcccgctggaaacaacctcacggtggatatatatcacccgcggcatttattccacttgctgaaaaatgcggattaatcgttccgcttacgcaaagcctgatgaatcaggttgccagacagatgaacgctatcgcgagtaaactgccggaaggttttcatattgggattaattttagcgcctcgcatattatttcgccgacgtttgtcgacgagtgcttaaattaccgtgacagttttacccgccgcgatttaaaccttgttctggaagtcaccgagcgtgagccattaaatgttgatgaaagtctggttcagcggttgaacattctgcatgaaaatggttttgtcatcgcgctggatgatttcggtactggttactcagggctttcttatctgcatgacttgcatattgattatatcaaaattgatcatagtttcgttggccgcgtcaacgcagacccagcatcaacccgaattctggattgtgtattggatctggcgcgtaaactttcgatcagtatcgtcgctgaagatgtcgaaacgaaagaacaatttgactatctgaaccaaaataatatcacatttcagcagggttattatttctataaacctgttacatacatcgacctggtcaagattatcctttctaaaccgaaggtgaagattgtggttgagtgaaaattgatcagcaaggccatggtgcggtgtaattatagacagctaattagctcgttgcctcttgttactattgttcattcttttgtttgctataattgtgtgaaagttttgactggattgccattagtagcatgaacaatagtaataatctggattatttcactctctatatcatcttttccattgcatttatgctgatcactctcctggtcatccttattgcaaaacccagcaccgggctgggagaagtgcttgtgacgataaatttgcttaatgccctggtttggctggcgatcaatctggttaatcgattaagggaaagactcgtcagccacagggatcagcactaatctttcagtttctcactgccagtatgcggctgaatgggttgctggcagtgaacccctggatcattgaaggaaaggaattattgcacaaatagttgtcaaccctggtgttatcacagttgttttatatatcagtgaaataatttccatggcaactgttgataattttgatgtcgaagagttatttgttaaacaaaatagttaccccaaagtgatcaatgtcatgaaaataagctaaaaatgataatgctggcttatttatcatttaaatattgtcgctgtttatctatttaaatttcttgtgcttttgtttttatctttgccttccgttttggtaatctgaactcataggttatttgaccaggaatgtttgttaatccaatgaatggatggttaatctatgaaactgaaaaaactccccggatttagtttaggacttattgctctggcggtgggtaatgcatatgtaacgcaattgttggatatttatagtataatttcctatataaccgatgaagaatcaccgattgaaatcaaaaataatacttctacaagtaatggggagtatctaatcacttaagacgaaagccatgctgtgaaagtggatgacggtgtaactggatatatacataatgccagtgtgatgactagtggtgatggatcttatggtatttctgttgatagccaaaacaaagtattatatataagcgatagcaatattaagacgctctgaaagcgtatctgacaaagaaaatggagggataacagccagcgcagtagtcagtgaatttggtggcaccatcgttatgaatggtgataattcagtcgagacgagggggcatattcagcgggacttttaagtcagattaatgattctgggactgtggaaaataacacccgtcttgaaaccacagataaaacgaacattgttacctatggggaaaaatgcagtaggagttcttgcatgttcaagtcctggagagtctcgaacatgtgtcgatgctgtagatgatgaagtttgtgattctaacagttacgaagttattagccgtgctgatttaaaaatgaatggtggttccataacaactaatggtattaatagctatggtgcttatgctaatgggaaaaaagcatatattaatttagattatgtggtacttgaaactgtggctgatggaagttatgcagttgctattcgacaaggtaacattgatataaaaaagttctattacaacaaatggcactaaagcccccattgcaaaaatatacaatggtagagagttatttttttccaatgtcacttcagaatcaacagaaacgcctacccccgtcctgcgacccgaagctggcagttacgtcgccaacctggcagccgctaacactctttttgttatgcgtctgaacgatcgtgcagatgaaacgcgctatatcgatcctgtaactgaacaggagcgttcaagccgattttggctacgtcaaattggcgggcataatgcctggcgtgacagcaacggacagttgagaacgacctcggcacaggccatctggatgggcgtcgatcataatgtgcacacggaagccaatggctcacgtattgagaatgacgcaaataacaatatccagacccgacttggtttccacacctttattcgtactcaggagaaaaacagcggtccgcacggtgacgactttgaaccttttgttgaaatgaacgggatccataacagtaaagattttgctgtctcaataaacggtgtgaaagttgaacaagccggggcgcgtaatctgggggaaattaaacatggcgtaaatggcaatctgaatcctgcggccagcgtctggggtaatgtgggcgtgcagctgggtgataatggctacaatgacaacgcaatgatggtgggcctgaaatataagttctgatcccgccattagctaaaaaaccgcgtcgaattcatcgacgcggtaacatatgaaatattattttttgccgatagcacgcatggtgtcatcaattgccgtgatcaacagcatttgcggatctttagcgcaaacctgattcagtttttctaccactttggcgctcagttccggagattgctcaatttttaaatcacggctggcaacgctggcattacccattaccgcaacaatttctgcaacctgtgcgctgtcagtttttgccatttcgttggcttctgcgcaagtaatataggtttctgatggcaaaccgttcttaatattgtagtcctgcgcccaggtcattggtgcgaaaacaaacagacccgccagtaaagcaaattttttcatcatcattccttatttcattttacccagaattgcaccacccgtaccgccaatcacggcacctttaatcgccccttcgaggccattgccggtcagaacgccagtgacagcaccaacggcggcacccacttttgcacctttacgcgcatttttaccgtcgcggcctttttctgttactgcaccaacaccagcgccaacagctgcacctttcagtacgccattaacaccattgccagtaagtaaaccaacgcctgcgcctagcaatgcacctttcgtggtgcgattcatatccgccatcgctggcgtggagcagaacaatgctgagataagcccgaaggcaagtatttttttcttcaacttagttgtccggtattaagtaagttgcacacacaataatttcgtcttcaattaagatctgcttaactaaagaacgctcgctattattcagataattcaaaatgagcgtgactgtgatgataggaattatgttttttacgggaatgagaataatctcaaatgagaaataactcattgattgacaatatttttattcaagaagtgtcattgactgttaacgcaatgttgtaaaggtaagataatctgatttatcaatattattgtgtgattgttatgtgagcagaagatattcattagcaacgattacattagtcattttattttgtggacggcctcattgtcgaaaaataagcgtacgacagtattatcagaaaagagtgattttttatccaacaacacttcagcgcactgcgtttaaaaaatacctctttcttatacgggatatcatcatttcatcatgatgtctttgatgagcggtgaacacaatacatttgcgctgtctcttcaggatgaatcccctggtctggttcctgcgggctgatgttgcagcagagctaaggtcacttagacgctactatcatttatccaatgcatggaatcgaaatcagtcgatacccgcagtatatatcgtgaactgggcgcaacgctgagttacaacatgcgtctggggaacggtatggaaattgaaccctggctgaaggcggctgtgcgcaaagaatttgtcgatgataatcgagtgaaagtgaatagtgacggtaattttatcaatgatttgtcgggtagacgtggaatataccaggcaggtattaaagcctcattcagcagtacgttaagcgggcatctcggggtggggtatagccgtggtgccggtgtggagtccccgtggaatgcggtggtcggtgtgaactggtcgttctgaccatcaacgattaaactgcgtttcggcgctgtttttgtttaccgggtgctaaaagggaaaattctggggcaaaaaaaagcccgtcagttacggcgggaaacctcatcctatgggagaacaatgaataatgaaattgcggggttatcatctcccaggatatccacgctaacaataaggttatttactcaaccaggcgtaaacattttgttctgtgcgtgggaacagccttaaggtgtaaagggggagggggaaatagcaatgaatagtatcagcaagaatactcgccgctttaccacaacgtggatgagagggatgaaaaactcaaggcagagatgactctgccttgaagataaatgcgcttttacagggggcttatttcagctcttctgcttccggtaaggtcacgttcagctcaagaatagaaatatcgccatctttttgctcaagctgtacggttaccatctcaggatcaatttgtacatatttacaaatgacctcaagaatatctttacgcaactgcggcagataatgcggttctgcatcgctgcgacggcgttcagcaacaataatctgcaaccgttcttttgcaatgttggctgtgtttttcttccgcgagagaaagaaatcgagtaatgccataacttatcctccgaacaagcgtttgaggaagcctttcttctcttcttcaatgaagcggaaaggacgttcttctcccaacagacgttctacggtatctgcgtaggctttacccgcatcggcgttaatgtcgagaatgaccggttcaccctggttagaggcgcgcaatactgattgatcctctgggatcacgccgacgagtttgatgcgcaggatctccagcacatcttccatgctcagcatgtcacctctgcttacgcggcctgggttatagcgcgttaacagcaggtgctctttaatcggctcttcgccattttctgcgcggcgtgatttcgacgccagaatgcctaaaatacggtcagagtcgcgtactgaggagacttccggattggtggtaataatggcttcgtctgcaaaatagagtgccattaacgcaccggtttcaatccctgccggggagtcacaaacgataaattcaaaatccatcgctttcagatcatcaagaactttggcgaccccttcacgggtgagggcatcttatcgcgagttgc

SEQ ID NO: 10039 - DNA, 23592 bp, Escherichia coli
cagaaccgatccctcgcctcgctaccctgctgaacgatatcccaccggcacgcctgtttgaagaatcgcttaaactgctacaagcgggctacggttacgaaacctataagctgctgtgtgaatatcatctgttccagccgctgttcccgaccattacccgctacttcacggaaaatggcgacagcccgatggaacgcattattgagcaggtactgaagaataccgatacgcgtatccataacgatatgcgcgtgaacccggcgttcctgtttgccgccatgttctggtacccattgctggagacggcacagaagatcgcccaggaaagcggcctgacctatcacgacgctttcgcactggcgatgaacgacgtgctggacgaagcctgccgttcactggcgatcccgaaacggctgaccacgctaacccgcgatatctggcagttgcagttgcgtatgtcccgtcgtcagggtaaacgcgcatggaaactgctggagcatcctaagttccgtgcggcatacgacctgttggccttacgagccgaagttgagcgtaacgctgaactgcaacgtctggtgaaatggtggggtgagttccaggtttccgcgccaccagaccaaaaagggatgcttaacgaactggatgaagaaccgtcaccgcgtcgtcgtactcgtcgtccacgcaaacgcgcaccgcgtcgtgagggtaccgcatgacagtggcgtatattgccataggcagcaatctggcctctccgctggagcaggtcaatgctgccctgaaagcattaggcgatattccagaaagccgcattcttgctgtttcttcgttttaccgcaccccaccgctggggccgcaagatcaacccgattacttaaatgccgccgtcgcgctgaaaaccactcttgcccctgaagggctactcaatcacacacagcgtatcgaattgcagcaaggtcgcgtccgtaaagctgaacgctggggaccgcgcacgctggatctcgacatcatgctgtttggtaatgaagtaataaataccgaacgtctgaccgttccgcactacgatatgaaaaatcgcggctttatgctgtggccactgtttgaaattgcgccggaattggtatttcctgatggcttatcattagttgaagctctacaggcaaaaggctttaatgaattagataagtggtaattattttttgcatgaatataaatatattccgaaaataatctcgagctattgcaaataataatatatttaagataaataaaagcacagaaatataatataccttcctgaagttctaattccatacaccacccccttaattttttaaagttaattttactaattttcatatttagtaaaattaaattgcatatgtcatggcattatgcaaaatagctgtcccaatgatgaatgaatgtaatacttagtaaaaaacaaacaaacatcattaacaaagtaacgttcagttacatggcattgcatcaaaatctcatcatcatgcaatgctgttatctgctttatggaatattactcaaggatttttatgtctaaaaaattaggttttgcgctgtccggtattatgttggcaatggctgctggtactgcatttgctgctaacgatatggacggcggtcaattaaatattagcggtctggtcgttgataacacttgtgaagctcgtgttgatggcggtaacaaagacggtctgatcctgctgcaaaccgctactgttgctgaaattactgatggtgtactggataccactgtaggtgctaaagctaaaccattcagcattactattgactgcagcaaagctaacccggctccgggtactactgcaaaaatgaccttcggttctgttttctttggtaacagcaaaggaacactgaacaacgacatgtctattaacaccccgtctgacggcgtaaatatcgctctgcacaatattgaaggttctactattaaacaggttcaggtcaataatccgggtgatgtttacagcaaaactctggattcaacgtctaaatctgcaacctacgattttaaagcatcctatgttcgtgcggatgcaagcaaagcagctactgccggttatgtaaaaaccaactcagcatataccattacttaccagtaaatatcaaccgcttaaattgatcgggtgaatatatacagggaataacatcaaatatttttacttttgataattattccctgttttaattaattctgtaaggaatggtttatgttttttaatactaaacataccgcagcattgtgcttagcgagctgtatggcttttagctcatcagctattgcagacatcgtaatttcaggtacacgcgtagtttataaaagcgaacaaaaaagcgtcaatgtacgtctggaaaataaaggcaataacccattgctggttcagagttggttagatactggagatgataacgctgaaccaggcagtattactgtcccctttaccgctacgccaccagtatcacgtattgatgctaaacgtggccaaacaatcaaactgatgtacaccgccagtagtgctctgccaaaagacagagaaagtgtgttctggtttaacgtactggaagttccaccaaaacccgatgcagcaaaagcagcaaatcaaagcctgctacaactggcatttcgcacacgtataaaactgttctatcgcccggaaggattgagtggaatttcatctgatgcaccattggctctgaagtggtcctgggcaacatctgaaggcaaagcagcattacgcgttgataaccctacgccctactatgtctcttttagcagtggtgatttagaagccaacggcaaacgctatcccctggatatgacaatgattgcgccgttcagtaacgacgtcatcaaggtaaatgggatgagtggcagaacaagctctgcaaaagtgcattttttcgccattaatgattttggtggatctattgaaggcaacgccaacctttaatctggcaaggatataacacagcaggaagcagaacgtgactattaaatctactaatcaccttacccacatcgccacgttttgcgctctgctgtatagcaatagtgctttatgcgctgaactcgtcgaatatgaccatacatttctgatgggaaaggatgcttcaaatatcgaccttagtcggtatacagaaggcaatcccacactacctggcatttacgatgtcagtgtgtatgttaacgatcaacccatcatgagccaaagcattgcttttgctgttattgaaggtaaaaagaacgctcaggcctgcattacgcagaaaaatttattgcaatttcatatcagttcaccagacaagaatagcgaaaaagccattttgcttaagcgagacgacgatcttggtgattgcctcaatctggctgaaatgatccctcaatcatccattcgttacgatgttaacgatcaacgcctggatatcgatgtcccccaggcatggattatgaagaattatcaaaactatgttgatccctctttgtgggaaaatggcattaatgcagccatgctttcctacaacctcaatggatatcacagtgaaagtccaggcagaacaaatgacagtatctacgcggcattcaacggtgggataaacttaggcgcgtggcggttacgtgcctcaggtaactacaactggatgaccaatgtccatagcgattacgattttcagaatcgctatttacaacgcgatcttgcgtcactacgttcacaactggttattggtgaatcttacacgaccggcgagaccttcgattcagtcagaattcgcggtattcgcttatacagtgacagtcgaatgctgcctccggtattagccagttttgcgccaatcattcatggcgtagcgaataccaatgccaaagtaaccgttatgcaaaatggttataagatctatgaaacgacggtgccgccaggggcttttgccattgacgatcttagcccgtcaggttatggcagcgatctcattgtgactatcgaagaagctgatggcacaaaacggacgttctcccagccattttcatctgttgtgcaaatgctgcgccctggcgttggtcgctgggatattagcgccggtcaggttttaaaagacagtatccaggatgagcctaatttatttcaagccagctactactatggtttgaataactacctgacaggatataccggtattcagctaaccgataataactataccgccggattgctggggcttggtatgaatacccccgtgggggctttttctgtcgatgttactcactcaaatgtcagcattccggacgataaaacctatcaaggacaaagctaccgtatttcctggaacaagttatttgaaaataccagtacatcattaaatatcgcggcctatcgctactccacccagcattatctgggcctcaatgatgcgctgacgctgattgatgaagtagaacatcctgagcaagatcttgagcctaaatccatgcgcaattactcgcgcatgaaaaatcaggtcacggtcagtatcaaccaaccgctgaaatttgagaaaaaggattacggttcattttatctctctggaagctggtcagattactgggcctccgggcaaaacagtactaattactctattggttatagcaatagtgcgtcctggggcagttacagtatcagtgctcaacgttcgttgaatgaagatggtcaaaccgacgatagcatttatctcagcttcacaattccaatagaaaatttactgggtacggaacaccgcagctccggcttccagagtattgatacacaattaaacagcgactttaagggtaataaccaactcaatatcagcagtagtggttacagcgataccaatcgcatcagctacagcgtaaacacgggttatatgatgaataaatccagtgatgatttgagttatatcggcggttatgccagttatgaatcgccgtggggaacgctgtcaggttcagcctcagcaagcagtgataatagtcgccaattctcactcaatactgatggtggatttgtgttacatagcggcgggctgacgttcagtaatgacagttttagtgattccgacactctggctgtcattcaggcgccaggagcaaaaggcgctcgtattaactacggaaacagcaccgtagaccgctggggttatggtgtgaccagcgccctttcgccataccatgaaaatcgtatcgcactggacattaacgatctggaaaacgatgttgaattgaaaagcaccagtactgtcgccgtcccgcgccagggagccgtcgtctttgctgattttgaaacagttcagggacaatcggcaattatgaacatcgtgcgaagcgatggtaaaaatattccatttgcagcggatatttatgatgaacaaaacaatatcatcggcaacgtaggtcagggtggtcaggcctttgttcgcggtatcgggcaggaaggaaatatacgaattacctggattgaagagggcaaaccggtcagttgttttgctcattatcaacaaaacacgacatcagaaaaaatagcacaatctattattctgaacggacttcgttgtcagatacagtaaccacaagggacttccaatgataaaaatcacaccacataaaataacaatactcatgggactattgttatcgccttcggtatttgcaacggatgttaatgtcgattttaccgctaccgtgaaagcaacaacctgtaatattacacttaccggaactaatgtcactgataatggaaaagataagtacaccttagttattccctcgatgggaatggataaaatagccaataaaacagcacaatctgaagccaactttaaattggtagccaatggatgcagcagtggaattagctggattgatacaaccctgacaggaaatcaatcaggaagttcacccgcgctaattatccccctggccagtgatacaacctccaccacaagctatatcggaatgggatttaaaaggaaggcgacttcaggcgatacatttctgaaacctaatagcgcagaatatatacgttggagtgcatcagaaattagcaccgatggacttgagatgactgtcgcactgcgtgaaacaagtgtagggaaaggtgttccaggcaagtttcgcgcactggcaacttttaacttcagctatcaataacaaggatgacaatgatgatattaaaaaaattatgttatggattatcgggtagtctatttctggcttcatcactgttaaccatttcctcacatgcggccactgacagtattggcctgactgttactactgacgtagaaatgggtacctgtacatcaacgttgactgatgacggtacaactaaaatttccaccatcaatttcggtgatgtatatatttctgaaattaatgccgaaactaaaattaaaaccttcaaattacagttcaaagactgtgcggggattcccgggaaaaaggccaaaataaaattgactacacgagcattatgtgaaggtaattctaataatggtcctggatttgctaacgcatcaacggcaacagcaaaagcagcggcggtcgccgttgaggtctggagcacatccacaccaggtaagaacggcgctaaacaattcagttgtgtcacccccgcaacagaagaagtcagtattgctaatgcgacgggcagcaatgttgtcgattacccaatgagtgcggtgttggtggtcgcaaaagataaaactgtcacaaatgtcactgcgggtgatttcactgccccggcaacattcaccgtgacttataactaacaggcagactgattcaggaactaaatatgcgtcccactcaacgtaatctgatgaaaaaatcaattctgcttctgtcgttgctattcagcgccacttcccctgtggttgcaggacaggatgttgacattgttgcaaatataaaaaataacacctgccaaagtggaatcagcaacaacggaaatattgatttaggtgtcgttggcgtgggcgattttaccggaaacatttcagccgaaaattatcaccccggtggaaaagagttcactattacagtacaggactgcacacttcagggcacagggaatgtgttaaatcagttacatattaattttcgcgcactcagtggcgtaatggcgacaggttccagtcaaatattcgctaatgaagacaacgccggggctaaaaatgttggggtagttatattttctattcaggacccggcaaataccttcaacgttcttagtgccactggtagctcacgttccgtttatccggtcatgtcatcagcactaaataattcatcctggaaatttagcacccgaatgcaaaaaatcgatccagcgctgaatgtcacctctggcccactgataagccatgtgttagtggatatttactacgaataacagacaaagtgctgcaagcattatcttgcagcatgacaatggagtaaaaatgaagatattcttcagatactttctttttttagcactgtgctcttgttgttatatagcaagtgccggtaccgatgatcacgtcggctatgttgttgggaataattacggtgttggtccatcaggccaaaaatggcgagagacaggtcctaatggagatgttaccgtcaaattccggtatggctcagtcaccaataatttagttttttataaaccaacccaacttggcccaaccggggtgtcattaaaatgggcgcagttagattccgcttcaggtggaggtttcctttactgtaacaggagtggtagcacaagcggcgggccaatgcatattgaaaataaaatggttgattccggtaaaagttatggcggacataaactctttaagacatctgttccaggcctgtattacacgttagcaatatcaaacatttggtcaacatatacatatactgatatcaacccatcaggcatgtatattggcgattctacgagccaatcttttaactggcgtggcgaaagcgagcaaacactatattggtcttgcaacaatgcgaatacaaaaaataaatattgggccgttggcggcgttatgcaaacgctcacgattgaattttataccgataccgactttaacccgacaacgaatcaacgggtaacattatccagaacagataattacctctactcattcaaagcatatggtgctggcattggtatcaatgactacagctattttcttaaaatagactttgacctgacagatatcgtattaacaaaccctacctgttttactgcggcgcttagtggctcatcggtaagtggttcaacggttaaaatgggtgattataccccagcgcaaataaaaaatggcgcaacagcggttccttttgatatcacgctacagaactgtattcgtgttcgcaatatagaaacaaaactcaagtcaaacaaggtgggtagtgtaagcaaagaacttctggctaacacactcacaggaaatgacgcagcaaaaggcgttggtgtactgattgaaggtttaaaaaacactaaaagtgcacaaatggtactgaaaccaaatgatgcaacgtctatttataaagattatgaaacagaagatgacactaccggaggaatttacccggataaaggaaacggtacctcacaacctcttcatttccaggctacattaaaacaagacggtaatattgctatagaaccgggggattttaaagccaccagcacttttcaggttacctacccctgataacactatcgcaccgccagacaacggcggtgcgatacggataaatcattgcccccaccaatgtgactgataaaatgcgagacagcacaacatcatttatcaggatacgctatgaaaccaaccacgattgcttcattgcagaaatgcaagcaggacaaaaaacgtttcgcaaccatcaccgcttacgactacagcttcgcaaaactgtttgccgaagaaggacttaacgtcatgctggtcggcgattcactgggcatgacggttcaggggcatgactccacgctaccggttaccgttgccgatatcgcctatcacaccgccgctgtgcgtcgcggcgcgccaaactgccttctgctggctgacctgccatttatggcgtatgccacgccggaacaagcctttgaaaacgccgcgactgtcatgcgtgctggggccaacatggtcaaaattgaaggcggcgagtggctggtagaaaccgtacaaatgctgaccgaacgtgccgttccagtttgtggtcatttaggcctaaccccacagtcagtgaatattttcggtggctacaaagtccaggggcgcggcgatgaagcgggcgatcgactgctcagcgatgcattagccttagaagctgctggggcacaactgctggtactggagtgcgtgccggttgaactggcaaaacgcattaccgaagcactggcgatcccggttatcggtattggcgcaggcaacgttaccgatggacagatcctcgtgatgcacgatgcgttcggcattactggcggtcatatccctaaatttgccaaaaatttcctcgccgaaacgggcgacatccgcgcggctgtgcggcagtatatggctgaagtggagtccggcgtttacccgggcgaagaacacagtttccattaaggagtgacgttgtgttaattatcgaaaccctgccgctgctgcgtcagcaaatccgccgcctgcgtatggaaggtaagcgcgtggcgctggtgcccaccatgggtaacctgcacgacggccatatgaagctggtcgacgaagccaaagcccgcgccgatgtggtcgtcgtcagtattttcgttaacccaatgcagtttgaccgcccggaagatctggcacgttatccacggaccttgcaagaggactgcgaaaagctgaacaaacgtaaagtggatttagttttcgcgccttcggtaaaagagatctacccgaacggtactgaaacccacacctatgttgatgttcccggtctttccaccatgctggaaggtgccagccgtccgggacattttcgcggcgtgtcgactatcgtcagcaagctgttcaacctggtccagccagatatcgcttgcttcggtgaaaaagattttcagcaactggcgctgatccgcaaaatggttgctgatatgggcttcgatattgagattgtcggcgtaccgattatgcgtgcgaaagacggtctggcgctgagttcccgtaacggttatctgacggcggaacaacgcaaaattgcgcccggtctgtacaaggttttaagttcaattgccgacaaattgcaggctggcgaacgggatctcgatgaaattattgctattgccgggcaagaactgaatgaaaaaggtttccgttccgatgatattcagattcgtgatgccgacacattgctggaagtctctgaaaacagcaaacgcgcagtgattctggtagccgcctggcttggcgatgctcgcctgatcgacaacaaactggtcgaactggcgtaatgcttaactggcgctacggctgatggcgccagttattcattgccacgttatctgtaggcaattattcataatgcagacaacttagttaatcattttatcaatctcagcaagaggtaaatttgccatctctgcaacgtcttcccgagacattcctttactcagaagacgcagggcgaattcctgacttacttcctgtcttccctgctgaatccccttctcttcaaaccactgcgccagcgtcatcatagactcccctcccgtttccctgtctctcaccacaccataaaacaaatccgcttgttcagtatgaccgcgttgcagcatatagttttgcatggcaactaactgacttccgctagtgtacccttcgtcaatcagcgtgaccagttgctccagcaataacattaagtcgcgctggcgaatatgtttttgcagcagttcgagaatcgcaatccgccgatgttgcatgatttcgtcatccggtgtgatagtgatatccaccagcgggaaaggactgttatagacgcgtcgcgccagttccggtgagtaaaacatatcaaaccagcacattgatagcggataaggtgtggcctcgccctgataaaacagaattggcaccaccagcggcagcttatcgtgatcagcctccagatgccggtgcatggcagcaatagaataacgcatcatgcgaaaggccattttcttatctggcttgctttggtgttcaatcacaacatgcagataacccgtactaccctgcatctgtacggaatagagcacgtcagtgctgtgccctttcaggctttcttcaataaaactccccgactcaagatgcagcgtgtcgaggtcacacagttcgcgtagctccgctggcaaatggatatccagaaagtcgcgagccgtttccgcatgcattaaaaattgtttaaacaccgcatcatgcggtgtggtactcggtgcatccatcttccctgccttccgtgtggtcttgcgtgaaggcagtatccagtcatggtgtgccgtcgtcagccgcctctttagtgtttaccgagcagcgttcagataaatttcaattggttacaggcgttacatggcacgcttcggcacggtacgcaaactgctgctgcaaatgccgtcagatgagtagacactcaacaaaaatcgggcaatactgcgtgagaatttcctcaaagcaggcatcgcctgcttcgttaacgacagggtagaaaggtagaagttatgattcgcacgatgctgcagggcaaactccaccgcgtgaaagtgactcatgcggacctgcactatgaaggttcttgcgccattgatcaggattttcttgacgcagccggtattctcgaaaacgaagccattgatatctggaatgtcaccaacggcaagcgtttctccacctatgccatcgcggcagaacgcggttcgagaattatttctgttaacggtgcggcggcccactgcgccagcgtcggcgatattgtcatcatcgccagcttcgttaccatgccagatgaagaagctcgcacctggcgacccaacgtcgcctattttgaaggcgacaacgaaatgaaacgtaccgcgaaagcgattccggtacaggttgcctgattgttatccctgcggctggttactcaccagccgcgacatcgtctccagcgaatccgttcttaagatataaagtcgttttagtaacaacggattatcccccggttttactttgcctttcatggtcgtcaccgccaggtgaaatccggcttcttttgctgccttcacggctttgtcattaaatccgccaaatggataagaaagatacaaaacatgtggattaaattgcgccagagcgcggcgtgaacgtgcaaaatcaaacagaatattgtgctcactacggctcagcaatataggccgccgataaccatctatccgatgcaaaaaatgagtatgtgactggaaatcaaatacatcgcgaatttcgttaagttcagaaacgctcataaattgcagcgattttgggttccatttctgcgggtgacgtttgatgcgcgaggtaacaataaacgccgtcgccttcataccatattgtttcaacacaggatacgcatagcggctcaccgacttgaggccatcatcaaaggtaattaccaccgctcgcgcagggagattgatcttattcttcacgtaaccttccagctgcgccatgctcagtgtcgcgtatcccctgtcgcgcagccaggccatctggttattgaaagcgcgtaccgaggtggtcgtcgaagtatggcgaaaacgggtgttttcttcgtcgcgcaaaatatggtgataggttagcaccggcaagccattatcgggttgggcatccagcgcgctgatataggccagtcgatcgccaatacggatctgataccaggtttgatttaacctgtctttcagtttatgcaaaatcgggtagcgcaaattgtccgccagtactccaaatggcgcactgcccacactcggtgcgttataaaccggcgtatctttcctggttattaagttctgattactcagcggcttgttgaggtcacccaaaccatcttcaactttttgtcgcccctgaaccggctcgagatggcctttatcgataaaccctttaccaaagccaaaattaaatacgtaataacttgcggcagtgggctccacggcaatgatttgtccggcccgaatattccctaccgtcaccattttgtcgccaatttgcgcccagaccgcggcattttcgatggtttgcatataacgggcaggtaacgcggcactgacacttgcggtaaacagcatcagcaggagaataacagcttgtttgtacatgaaaaaataaccgagggtgaaacaacgcctttattgtagcaaaagcgtcatcagaatcgcgggttaatactcatacaaattatgtttgaggacgaaaggcggatttttttgttgttggtgccaaagactactcacctccggcgcacccagttcgacaatatgctcgcgaaacgctgaactggtcatggtttcacggcaagccatcatctgttcaattaacggtaacgtgacaccagaaatcacttcgcaacgggagtgtttgtggcttaataatgaagccacgcggtacggtggcgctccggctatatcggttaaaaagataacgccctcaccagagtccgtttcatgcaaggcatcgcacatcatgcggctgagcatattagagcttaatccgcgccagaaattcacggcccggcactgaagaagtgccccatgttttttctccagcgcatccagtatctcttgcgcccggtcatcgtgacaggtaattacccaacctaacatcgccttcctccttagccgaaaatcagtctaccctgaccattgttgataaagggtgatagccgtcaaaactcctctcccccaaatccagaggagaggaaatagccttagctacgcaaaccacgtccacgttggatcagcgaccaacagatcaaataaaacgccacaataaagaccaccagtacaccgaaggtagtgaccagcggaacatcattgataccgaggaagccgtagcggaaaccactgatcatataaacgattgggttcaggtgcgacagcccttgccagaacggcggcaacaaagtcagggagtaaaacaccccgcccaaatacgtgagtggcgttaacacaaaggttggcaccaggctgatgtcatcgaacgttttggcaaacacgccgttcagcaaacccgcaagggagaatagcaccgcagtgagcaccagggttaaggcaacgaatacccacgaatgcacctgaaacggcacaaaaaacagtgaaattgccgtcaccaaaataccaacaaacagaccacgcgccacgccaccaccgacatatccggcaataatgacatgagtcggaaccggcgctaccagcagctcttcaatattacgctggaacttggcaccaaaaaatgatgacgcgacgttagcgtaggcgttggtgatcaccgacatcatgatcagccccggtacgatgaactgcatgtagctgaagccatgcatatcgccaatacgcgaaccaatcaggttaccgaagataataaagtaaagggtcatggtgatgactggcggcaccagcgtctgcacccagatgcgcataaagcgatggatctctttcgcccagatgctttttagcgccacccagtaaagatgcatcatgtgcgatctccttgtttttcattaaccagtgaaacaaacagctcttccagacggttagctttgttacgcatacttaatacctgaatgccctgctcacttaactgcgtaaatacgctgttgatgccctgctcacgcagcacttcaacttccagcgtggcggtatctaccagtcgatactgatagccatcgagcttcggtaacggacttttcggtgcgagatcgagaataaaggtttctgatttcagcttcgccagcagcgccttcatcgaagtattttccaccagctcaccgtgttgaataatgccgatattgcggcacagcatttctgcttcttccaggtaatgtgtggtgagaatgatggtggtgcctttgtcgtttaaatccttcaaaaagccccacattgagcggcgaagttcaatatccacgcctgcggtcggttcgtcgagaatcagtagtttaggttcatgcattaacgcacgggcaatcattaaacggcgcttcatcccgccagataacatacgcgcacgttcgttgcgttttccccatagatcgagttgtttaagatacttttcgctgcgaatgtacgcttctttgcgctccacaccgtagtaccctgcctgattcaccacaatttgctgcacggtttcaaacgggttgaagttaaattcctgtggcaccagccccaactgacgtttagcgtttacgacatctttctcgagatcgtaaccaaatacgctgacccgcccggaggttttatttaccagagagctgataataccgatagtggtcgattttccggccccgttcggcccgagaagcgcataaaaatcacccgcttcgacctgcaaatcgattccacgaagcgcctgaacgccgcctggataggtttttttaagctgttgaagttccagtgcaatggtcataaatttttacttaccttacgttcttacactttatctgtggtttaaatcgtcccggagttgccctatattagccaaacgtaattatttggttacaggtcgttaacctccatgaaagacatagatacactcatcagcaacaatgcactatggtcaaaaatgctggtggaagaggatcccgggttttttgagaaactggcacaagcgcaaaaaccgcgctttctatggattggatgttccgacagtcgcgttcctgcagaacgtttaaccggtcttgagccgggcgaactctttgttcaccgtaatgttgctaacctggtcattcacaccgacctgaactgcctttccgtggttcagtatgcagtggatgtactcgaagttgaacacattattatctgtggccactacggttgcggcggcgtacaagccgcagttgaaaacccagaactggggcttatcaacaactggctgctgcatatccgcgatatctggttcaaacatagctcattgctcggcgaaatgccgcaagagcgccgtctggataccttgtgtgaactgaacgtcatggaacaggtgtataacctgggccactccaccattatgcaatcagcgtggaaacgcgggcagaaagttaccattcacggctgggcctacggcattcacgacggcttgctgcgtgatctggatgtcacagcgactaaccgcgaaacccttgagcaacgttaccgtcacgggatctccaacctcaagctgaagcacatcaatcacaaataaattcgccatgccggatgcaacacatccggcaacttcacacttactcgtccagcagaatcactttgccgatatacggcagatgacggtaacgctgtgcgtaatcaatgccgtaacccaccacaaactcatccgggatcgagaaaccgataaattctaccgggacgttcacttcacgacgggacggtttatccagcagcgtacaaatcgccaacgacttcggttcgcgcaggcttaagatctcacgcactttcgacagtgtattccccgagtcgatgatatcttcaacaatcagcacgtccttgccacggatatcttcatccaggtctttgaggattttcacatcacgggtggtggacatgccgctaccgtagctggaggcggtcataaagtcgacttcatgagatacctgaacttcacggcacaggtccgccataaacataaatgagccacgcagcagacccaccagcaccatatcgctgccgctgtctttgtaacgctcagtaatctgacgacccagttcggcgatacgcgctttaatctccgcttcggggatcattacttctacagtatgtttcatatctataaccatatgatttaaaaacaaatcacttcgcacgggcaggtttcagcaccgcaacaaagcgcaagacacgcagtataccagtaaaactattcattcgcggaatctgttaataaagctcgaattgtgatgacgatcacacatgttaaaacctataattaattgctactaaaatattaatgaattgaaatggtgtctctttatggcaattaacaataccggctcgcggcgattactcgtcacgctaacagccctttttgcagcgctttgcgggctgtatctactcattggcggaggctggctggtcgcgattggcggctcctggtactaccctatcgctggccttgtgatgctcggcgtcgcctggatgctgtggcgcagtaaacgcgccgcgctttggctgtacgcagccctgctgctcggcactatgatttggggcgtctgggaagttggtttcgacttctgggcgctgactccgcgcagcgacattctggtcttcttcggcatctggctgatcctgccgtttgtctggcgtcgcctggtcattcctgccagcggcgcagttgccgcactggtggtcgcactgctgattagcggtggtatcctgacctgggccggatttaacgatccgcaggaaatcagcggcaccttaagcgccgataccacgccagcagaagccatctcccccgttgccgatcaggactggcctgcctatggtcgcaatcaggaaggtcaacgcttttcaccactgaagcaaattaacactgataacgtccacaagctgaaagaagcctgggtgttccgtactggcgatgtgaagcagccgaacgatccgggcgaaatcaccaatgaagtgacgccaattaaagtgggcgacaccctttacctgtgtaccgcgcatcaacgtctgtttgcgctggatgccgccagcggtaaagagaaatggcattacgatcctgagctgaaaaccaacgagtccttccagcatgtaacctgccgtggcgtctcttatcatgaagccaaagcagaaactgcttcgccggaagtgatggcggattgcccgcgtcgtatcattcttccggtcaatgatggtcgtctgattgcgattaacgctgaaaacggcaagctgtgcgaaaccttcgccaataaaggcgtgctcaatctgcaaagcaatatgccggacaccaaaccgggtctgtatgagccgacttcgccgccgattatcaccgataaaaccatcgtgatggccggttcagtcaccgacaacttctcaacccgcgaaacgtctggcgtgatccgtggttttgatgtcaacaccggggagctgctgtgggcttttgatccgggcgcgaaagatccgaatgcgatcccgtctgacgaacacacctttacctttaactcaccaaactcgtgggcaccagcggcctatgacgcgaagctggatctggtctatctgccgatgggcgtgaccacgccagatatctggggcggtaatcgcacaccggaacaggaacgttatgccagctcgattctggcgctgaatgccactaccgggaaactggcgtggagctaccagaccgttcaccacgacctgtgggatatggatcttcctgcacagccgacgctggcggacatcaccgttaatggtcagaaagtgccggtcatttatgctccggcgaaaaccggcaacatttttgtgctcgatcgtcgcaatggtgaactggtggttccggccccggaaaaaccggttccccaaggtgctgccaaaggcgattacgtgacccctactcaacccttctcggaactgagcttccgtccgacgaaagatttgagcggtgcggatatgtggggtgccaccatgtttgaccagttggtgtgccgcgtgatgttccaccagatgcgctatgaaggcatttttacgccgccatctgaacagggtacgctggtcttcccgggtaacctggggatgttcgaatggggcgggatttccgttgatccgaatcgtgaagtggcgattgccaacccaatggcactgccgtttgtttcgaaactgatcccacgcggtcctggtaacccgatggaacagccgaaagatgccaaaggcacgggtacggaatccggcatccagccgcagtacggtgtaccgtatggcgtcacgctcaacccgttcctctcaccgtttggtctgccatgtaaacagccagcatggggctatatctcagcattggatctgaaaaccaatgaagtggtgtggaagaaacgtattggtacgccgcaggacagtatgccattcccaatgcctgtaccggtaccgttcaatatgggtatgccgatgctgggcgggccaatctccacggcgggtaacgtgctgtttatcgccgctacggcagataactacctgcgcgcttacaacatgagcaacggtgaaaaactgtggcagggtcgtttaccagcgggtggtcaggctacgccaatgacctatgaagtgaatggcaagcagtatgtggtgatctccgcaggcggtcacggttcatttggtacgaagatgggcgactatattgtggcttatgcgttgccggatgatgtgaagtaaccataatgcccggagagatccgggcatatttccgaatacggtctttttataccgtaaaccctaacatcatccccgtatcttcatgctccagcagatggcagtgcgccatataagcatgttctttcggtgcatcgtgattaaacttcaccagcacttcgctgacattaccttctaccttaacggtatctttccagcctgcacgatgcgtcgctggcggtttgccattttctgacaagatacggaactgcgtaccgtggatatggaacggatgcagcatcatgtcgcccacgccagagataacccaacgttcgtactgccctttcgccgccgcaaacatcggcttattcatatcaaacgcctgaccgttgattttgttggcatggtggaaatcaaacttcccgctgtggttcatatgattcatattgccgtgccccatatggcccatcatctggctgtgatccatcccggccatcgcctgatcgccatatttctccatcagcatctgcatccccatcatatcgagcattgggtccatagaaagttgcagcttgcgtaccgtcagcccttccagcgaaggtaacgcaggcaggctacttaatgtgtctggcaaagcaccagaggcactaatggcaatcggctgaatccgcattaccggatgcggcttgtcaaacggcgcaatcgccatccccatctgactgaccggcagcgtcaccaggtcaaatggtttgttgtcgttaacctccaccagcacttcaaaacgctcacccatcagcaccggtagctcgctcaccttcactggttcaggtagcagaccaccgtcgctggcaatcacatacagcgggcgattgtcgctggtggcgaaattgagcgaacgggcattacagccattgagcaaacgcaggcgcagccagccgcgcggggcagcgtgttgcgggtagattgcaccgttggtcagcagcgtatcgccaaaccagcccacggcggcggtcatcacatccagttgataatcaatctgcccgtcagcgttaaattttttatcctgaacaatcaccgggacatcatcaataccccactgttttggcagcattaatttcaggatctcgtcatcttcaatcaccaccaaaccagccagccccatcgccacctgacgtccggtcttgccatgttgatgtggatggaaccagcaggtagcggcaggttgatcaacgttcaacgtcaccgagcgcttgccacctggcggaataattccctgcgggccgccgtccacttcacccggtacttccagcccgtgccagtgcaacgtcgtctcttccgtcagttggttgtagatatcaaccgttaccgctttgccacgctgtaatttcaccgccggccccagcagattgccgttatagccccaggtagttgcggttttcccgccaaaggtggactgacctgcgccaatagttaactgaatgcgattacgggcatcggtcgtgagcaaatcagggattggtaacgttgggcgttccgccgcaaatactgcgcggctccacagcggcaaggctgaagccacacccagcgcgacggaatatttcaagaaatcacgacgttgcatagttatttccttattcttaagcaggcgaaacaaaatcaaacgttgagcatagtccttccccttacgggaaggtcaagccgcagacacaatttaatcgacaataatggtcgtcgcctcgctcgcagtgtgctaacgtttatcttctttaagcccctggtagaagcaatgaagacgtttttcagaacagtgttattcggcagcctgatggccgtttgcgcaaacagttacgcgctcagcgagtctgaagccgaagatatggccgatttaacggcagtttttgtttttctgaagaacgattgtggttaccagaacttacctaacgggcaaattcgtcgcgcgctggtctttttcgcccagcaaaaccagtgggatctcagtaattacgacaccttcgacatgaaagccctcggtgaagacagctaccgcgatctcagcggcattggcattcccgtcgctaaaaagtgcaaagccctggctcgcgattccttaagcctgcttgcctacgtcaaataatccctgatacctttttgtagaaatattgaccgtgcatccgcggtcaatgttagctattatgttgcgccatttttttacgggtgttaacaaaggaggtatcaacccatggccgaaaaaaaacagtggcatgaaacgctacacgaccagtttgggcagtactttgcggtagataacgttctgtatcatgaaaagaccgatcaccaggatctgatcatttttgagaacgccgcatttggtcgcgtaatggcgctggatggtgtagtacaaaccaccgagcgtgacgagtttatctatcatgagatgatgacccatgttccgctactggcccacggtcacgcgaaacatgtgctgattatcggcggcggcgacggtgccatgctgcgtgaagtaacccgacataaaaacgttgagtcaatcacgatggtggaaatcgatgcgggtgtcgtgtcgttctgccgtcagtatcttcccaaccataacgccggtagttacgacgatccgcgctttaaactggtgatcgacgatggtgtcaatttcgttaatcaaaccaaccagacctttgatgtcattatctccgactgcaccgatcctatcggtcccggcgaaagtctgtttacttctgcattttatgaaggctgcaaacgttgcctgaatcctggcggtatcttcgtcgcacaaaacggcgtctgctttttacagcaggaagaggccatcgacagtcatcgcaaactcagccattacttcagcgatgttggcttttatcaggcggcgatcccgacctattacggcggcatcatgacctttgcatgggcgacagataacgacgccttacgccatctctcaaccgaaattattcaggcgcgttttctcgcttctggcctgaaatgccgttattacaatccggcagtccatacggcagcttttgccttaccccagtatctgcaagatgcactggcttcacagccgtcctaaggagaagataagaaattgaaaaaactgaaactgcatggctttaataatctgaccaaaagtctgagtttttgtatttacgatatctgctacgccaaaactaccgaagagcgcgacggttatattgcttatatcgatgaactctataatgccaaccgtctgaccgaaatcctgtcagaaacctgttccattatcggggccaatattcttaacatcgcccgccaggattacgagccacaaggtgccagcgtcactattctggtgagtgaagaaccggtcgacccgaaacttatcgacaaaacagaacatcccggcccactgccagaaacggtcgttgcccatctcgataaaagtcatatttgcgtacatacctacccggaaagtcatcctgaaggcggtttatgtaccttccgcgccgatattgaagtctctacctgcggcgtgatttctccgctgaaggcgctgaattacctgatccaccagcttgagtccgatattgtgactattgattatcgcgtgcgcggttttacccgcgacattaacggtatgaagcactttatcgaccatgagattaattcgattcagaactttatgtccgaagatatgaaggcgctgtatgacatggtggatgtaaacgtctatcaggagaatatcttccataccaagatgttgcttaaagagttcgaccttaagcactacatgttccacaccaaaccggaagatttaaccgacagcgagcgccaggaaattaccgctgcgctgtggaaagaaatgcgcgagatttattacgggcgcaatatgcccgctgtttaacgtctcaggcggagcacggaggctccgcctgatttacttacttctgctgcacgaaattacggtaagccgccacca

SEQ ID NO: 10040 - DNA, 23013 bp, Escherichia coli
ggtttgccttattcctggcaaagttggtgttcaggatcctcagtttgcgattgaaggcctgctcaattacgcgatggcactggataacccgacattgaacaaattgagtgaagaaacccggttacagatcatcccttaccttgtgaattttgcctttgctgattattccaggtctgcggcaagtaaggctcgctgtgagcattgtactggtactggatttcataatgtattgcgcgaagtggtgaaacattccagaagcggggaatccgttatcaaagaagagtgggtgaaggaactgtgtcagcattgtcatggcaagggagaagtcagcacggcgtgcagagggtgtaagggtaaaggtattgtcctggatgaaaaaagaacccggcttcatggcacgcctgtttataagacttgtgggcgttgcaatggaaaccggtttagccgtttaccgactacactggcacgacgtcatgtccagaagctggttccagacctgactgattatcagtggtacaaaggatatgcagacgtaattgataaactagtaacaaagtgctggcaggaagaagcatatgctgaaacacaattgagaaaggtgacgagataagtgattttcgccgaagatagtgacatgaagcttgcatttttcaaaaaatatggataagattttctcaacgatgggctttgtatgtctgccgttgataattttcacgaacccgctgttgagcgggtttttatttacttgtactgaaacacattatataacctcatatcagttaaaaaggaggttgtatgattaatgccgttgagtacagattaccgttaggaaatatctctccagagaatcttgacgcgttgtcagaacttatcgttaagcattccgataaatttaataactatgtacttagttctatttctgatgatgatattcgatattcttacgattactacaattttgaaatcacagagatagatgaatatgggtttcactttatagcaccatatagctattatgaaggatgcgttgacaataacttctcaggagaggttgaaggttatgcagaatacgaaattattgataatgaattagtcttctctcttgaggaactaccttgggatgtaaaataaatatcaataataaaggccgtaacgaacggcctttattattataaaatcatcaatgcctgatgaattagaatgtaattttcgaattaataataaatcaacatatcatttcacgctccgattttctgtcggaggcgaaactgcggctattcatatgcacgaaaaagagaatcttgccggagcgttctggcttgttttgctgatcatcgcaggttggggggggcttgtccgttacctgattgatgtgaagcagagtaaagcaacgtggagctggataaatgccctcgctcagatagttgtatcaggattcaccggtgttattggtggcctaatcagtatcgaaagtggattcagtatttacatgattctcgcaactgcggggattagtggtgcgatgggttcggttgcactgacgtacttctgggaacgactgacaggggtgaaaaatgcaaaatcttaatcctcagcgtaaagctttcctcgatatggtggcctggtcagaaggaacggataatgggctacaaccgacacgtaatcatggttatgacgtcattgtgggcggagaaatattcactgattactccgatcaccctcgcagacttgtcacgctaaacccaaaactcaaatcaacggctgccgggcgctaccagcttctttcccgctggtgggatgcataccgtaaacagcttggactgaaagacttctctccaaaaagccaggatgctgttgcactgcagcagattaaagagcgtggtgctttaccgatgattgatcgcggtgatattcgtcaggctatcgaccgttgcagcaatatctgggcttcactgccgggagctggttatggtcagtttgagcataaggctgacagcctgattgcaaaattcaaagaagccggcggaacggtcaaagagattcaggtatgagcagagtaacggtgattatatccgctctggttatctgcatcatcgtctgcttgtcatgggctgttgataattaccgtgatgacgccatcgtctacaaagtacagcgcgataaagccacatccatcatcgctgatatgcagaagcgtcaacgtaatgtagctgaactcgatgccagatatacaaaggagcttgctgatgctaatgcgactatcgaaagtcttcgtgctgatgtttctgctgggcataagcgcctgcaagtcgccgccacctgtacaaagtcaacgaccggagccagcggcatgggcgatggagaaagccctagacttacagcagatgctgaactccattattaccgtctccgaagtggaatcgacaagataacctcacaggtcaattacttgcaggagtatatcaggacgcaatgtcccaactaatcacattttgaggatatttaacgtctatgctttaatgattttattcattgttttataatcgcgaagaataatgatgaacttggcaaaggatatgattatgcgtattaaacctcaagattttaagtttgatgtgttgactgttgctggttacgctaaccctaaagctaaaacacatttcgcaccttctgcttctggatttaattttaaatgggagtgggaagggaaaatttatgagcttcatatcgagcaagaaaaattacagtaccctgattttattcttgaacgactttttgatgccgcaattgagatggctaaaaaatgacaaaaatcaccggatggggtttttgtttatagatattcacacatagcccttgcatctagaacagaaaatcttgtcatggcgcggggctatgttagcaaaaatttatttaataggatattttgtttgcagatttaagctctttaagagtagcgtcaagtatatgtaaaaatagagaagtgtcgccatactcataatgtggctcggatttgtattctctaatataaataaatccacctttggataaaaataaatcaatcagctcgttgttattttcatcggttgggtcaatggcagcaaacttcaatacaggagcttcatcaatgactagcagtgtttctttgaaaataagttctagttcatatgttgaaagtttgagggttaacctatttttttatctttattgaaaattattgtgtcgccaagaaaatcgtattcagagcttgagtcaataatgttattcttaagtttgagagatattgcatctaaagcctttttatgctctgcgcacttaacaactttatgaacatctaaactggggatactcataatacaaccacctatgtaagaactaaagagcattgagtctatgtgattaatatcaagacccaattaaattttttaaattattagagttagatcccactttaaatgcccccacgaaccccaaaagcctgccgcgttcgcggctgccgccaaaccaccactgatccgtcaggctattgtgaaagccacaaaagcgaaggctggaaacaatacaagccaggacaatcccgtcaccagcgcggctacggttcgaagtgggatgttatccgcgcgcgcgtgctgaagcgtgacaaaggcctgtgtcagttgtgcctgcatgtcggtgtggtgcgtgaggcgaaaaccgttgaccacatcatccctaaagcgcatggcggcactgatgcagactgcaatctgcagagcctgtgctggccgtgtcataaggcgaagacggcccgtgaacgactgaagtgataataattctcaactttctgaggggaggggcgggtcaaatccctgtgacctgacgtcttccggactgcccgccccatcgtttttttatacccgcgaaaaatgaaatttaaccaggagtgccgcatatggctggaacggcggggcgttccgggcgtcgccccaagccaacggcgcgcaaggcgctggccggaaaccccggcaagcgagccctgaacaaagatgaacctgtttttacgcccatcaaaggtgttgagccaccggagtggttcgctgaagaagatctccctctcgccacgatcatgtggcaactgacaaccaaagaactctgcggtcagggcctgctgtgcgtgactgacctcgcggtgcttgagcggtggtgcgtggcctatgagttctggcgacgtgctgtgaaaaatattgccatacagggcaataccatcaccggcgcaatgggcggcagggtcaaaaatccggagctgacagccaaaaaagaacaggagtccgagatgagcagcacgggggcaatgctcggactcgaccccagcagccgtcagcgtctgattggcctggcggggcagaagaaagccactaacccgtttctgaaaatcatcgaatcatgagccggaaatcttaccccaacgtaaatgctgccaatcagtatgcccgggatgtcgtgcgcggaaagattgtggcctgccagtttgtgattcaggcctgccagcgccatcttgatgacctgatggcggaaaaaagtaagtcgtttcgttaccgcttcgacaaggacctggctgaacgggccgccaaatttattcagctgttgccgcacaccaagggtgagtgggcatttaagaggatgcccatcacgctggagccgtggcagctctttgtgatctgctgcgcgtttggctgggtcaataaaggctcccggctgcgccgcttccgggaggtgtataccgaaatcccccgtaagaacggcaaatcggcaatctctgccggtgttgccctgtattgttttgcctgtgataacgagtttggcgcggaagtgtattccggtgccacgacagagaaacaggcgtgggaagtctttcgcccggctcgactgatgtgtaaacgcacacccatgctgacggaagcgttcgggattgaggttaacgcctcaaacatgaaccgtccggaggatggcgcgcggtttgaaccgctgatcggtaaccccggtgatggttcatcaccccactgtgcggtggtggatgaatatcacgagcacgccaccgatgcgctttacaccacgatgcttaccgggatgggggcgcgacgtcagccactgatgtgggctatcaccaccgccgggtacaacattgaggggccgtgctacgacaagcggcgggaagtcatcgagatgctcaatggctcggtgcctaacgatgaactgttcgggatcatctataccgttgatgaaggtgacgactggaccgacccgcaggtgctggaaaaagccaatccaaatattggcgtgtcggtttatcgcgaatttttgttaagtcagcagcagcgtgcgaaaaataacgcccgtctggcaaacgtctttaaaacaaaacacctcaatatctgggtgtcggcgcgttcggcgtatttcaacctggtgagctggcagagctgcgaggataaatcactgacccttgagcagttcgaggggcagccgtgcattctggcctttgacctggcgcgtaagctggatatgaacagcatggcgcgactttatacccgcgagattgacggtaaaacgcattactacagtgtggccccgcgtttctgggtaccgtatgacacggtgtacagcgtcgagaaaaatgaagatcgacggacagccgaacgctttcagaaatgggtggaaatgggcgttctgaccgttaccgatggtgcggaggtggattatcgctacatcctcgaggaggccaaagcggcgaacaaaatcagcccggtcagtgagtcacccatcgaccccttcggggcgaccgggttgtcacatgaccttgctgatgaagacctgaaccccatcactatcattcagaactacaccaacatgtccgacccgatgaaagagctggaagcggcaattgaatcggggcgctttcatcatgatggcaatcccatcatgacctggtgtatcggcaacgtggtcggcaaaaccattccgggtaacgatgatgtggtgaaacccgtcaaagagcaggcggaaaacaaaatcgatggtgcagttgcgctgattatggcggttggcagagccatgttgtacgagaaagaagacacgctgtctgaccacattgagtcctacgggatccgctcgctttaactgaggtaattatgatcatgctgattctcgcgcctctggtgggcgtgctgggtgcgcttttgctggcatatggtgcctggctgatttatcccccggcgggttttgttgttgccggggcgctgtgcctgttctggtcgtggctggtggcgcgatatctcgatcgtacacagctgtctgtcggcggaggtaaatagtgttcttttcgggattatttcaacgaaaaagtgacgcgccggtgaccacgccagcagagctggcggaggctatcgggctgtcatacgacacctataccggaaagcagatcagcagccagcgggccatgcgactgacggcggttttttcctgcgtcagggtgctggcagagtcggtcgggatgttgccctgcaatctgtatcacctgaacggcagcctgaaacagagggccaccggcgaacgtctgcataagctgatctccacgcatcccaatggctatatgacgccgcaggagttctgggagctggtggtcacctgtctgtgcctgcggggaaacttttacgcctacaaagtgaaagcatttggcgaagtggctgaactgctgcccgtcgatcctggctgtgtggtaccgaagcttaacagtagctgggagccggtctatcaggtcacattctcggacggctccacggatgtgctgagccaggaagatatctggcatgtgcgcacgctgacgctggacggtctggtggggctgaatcccatcgcctatgcccgcgaggcaatatcgctggcagctgcgaccgaagagcacggggccagactgttcagcaatggtgcggtgacgtcgggtgtgttgcgtacagagcagacgctgtcagatcaggcttacgagcgcctgaagaaagattttgaggagcgtcacaccgggcttggtaatgctcaccgcccgatgatccttgagatggggctggactggaagtcgatggcgctgaacgccgaggacagccagttcctggaaacccgcaagtttcagcttgaagaaatctgtcgtctgttccgggtgccgttgcacatggtgcagaacaccgatcgcgccaccttcaacaatattgaagagctggggctgggatttatcaactattcactggtgccgtatctgacccgcatcgagcagcggatcaacaccggactggttcgaaaaagtaagcagggcgtttattacgccaaatttaacgccggggcgttactgcgcggggatatgaagtcccgttttgaagcctacgccaccgggattaactggggaatttactctcccaatgactgccgcgacctggaagatatgaatccccgtcccggtggggatgtctatctcacaccgatgaacatgaccacgaaaccctccgatggcagtaaagccggtaagcagaaggataacgccaatgcagacgaaacaacgtcttgatgtaccgctgagtctgaaatctgtcagtgactccggtgagtttgaagggtatggctccgtctttggtgtaaaggacagccacgatgatgtggtgatgtccggggcatttgctgcttccctgcgggcgtggagtgacagaaaagcgttacctgcgctgctctggcagcaccgcatggatgaacccatcggtgtttacaccgaaatgaaggaagacgatgtcgggctttacgtcaggggacggttgcttattgatgatgatcccctcgcaaaacgcgcacatgcacacatgaaggccggttcgttaaccggcctttctattgggtacgtcctgaaagactgggaatacgaccggagcaaagaagcctttctgctgaaagaaatcgacctctgggaagtcagcctggtgacgttcccgtctaacgacgaggcgcggatcagcgacgtcaagaacgcactggcccgcggggaaatccccgaacagaaaaaaatcgaaagagtcctgcgtgatgtcggactctcccgtacccaggccaaagcattcatggccgggggctatggcgcactgtccctgcgcgacgctgaggatgtgggctctgcactgaatgcactgaaaaatctgaacttctaatcaggagaaatacgatggcggttgatattaaagatgtcgaacaggtcgcgcaggagctgcagcagaagtttgacgacttcaaagcaaagaacgacaagcgcgtggatgcgattgagcaggaaaaaggcaaacttgccgggcaggtggaaaccctgaacgggaaactcagcgagctggaaaacctcaaaagcgatcttgaaaaagagctgcttgagctgaaacgtccggcaggtggtgcgcaaaataaactggccaccgagcataaagaagcgtttgtgggcttcctgcgtaaaggccgtgaagatggtctgcgcgatctggagcgcaaggcattgcaggtgggcaccgatgaagacggcggctatgccgtgccggaagcactggatcgcaacattctcaccctgctgaaagatgaagtggtgatgcgccaggaagccacggtgatcaccgttggtggttccgactacaaaaaactggtgaatctgggcggcacggcttccggatgggttggcgagactgacgcgcgctcccagactgccacctcaaaactgggcctgattgaacctttcatgggggaaatctacggtaacccgcaggccacccagaaaatgctggatgatgcctttttcaacgtggaagcatggatcaacagcgagctggcaaccgaatttgccgaacaggaagaaattgcctttaccaccggcgatggtaccaagaagccgaaagggttcctggcgtatgaatccactgatgaaaccgataaggtccgggcgttcggcaaacttcagcatattgtatccggcgaagcgacggcggtgaccgcagacgccattatcaaactgatttacacgctgcgtaaggcacaccgcactggcgcgaagttcatgatgaacaacaacagcctgtttgccatccgtctgcttaaagacagcgagggtaactatctgtggcgtccggggctggaactggggcagccgtcctctctggcgggttacggtatcgctgaaaacgaacagatgccggatatcgccgctgatgcgaaagccattgcatttggtaacttcaaacggggttacaccatcgttgaccgtatcggcacccgcattctgcgtgacccgtacaccaataaaccgtttgtcggtttttataccaccaagcgcaccggcgggatgctggtcgattcgcaggccatcaaactgctgaagattgcagcggcgtaatcactcaggggcgcggaaccgcgccccctgttctgacgggtgaagaatcatgatcctgaaacaagatctgaaatggtcaccggacggtatgcgtgttgaggtcattcgggccggtgagtatgacgatggggcgcttcctgcccgggtgcaggagattgcacttcaggccgggttagcagagcgcggaatcagtgcaaaaagcagtaaagcggcaaaagagaaaaaagccacgaccagtaaagagggctgagtatgcttctgacaatggaagagattaaagcccaactccggctggatgaggatttcgatgctgatgaccgccatctgcaactgctggcctgtgcggcacaaaagcggacggaaacgtatctgaaccggaagctctatgcaccggatgaaaccattccggacagcgatccggacgggctgcacctgccggatgatattcgtctggggatgctgatgcttatcagccatttttacgaaaaccgctcgtcggttacggaagtggagaaactcgacatgccgcagagttttggctggcttgtcggcccgtacaggtactttccgcaatgaaaattcgtcaggcgcagaccagcgcaacctacattctgccggaccccggtgaactgaataaacgcgtcctgatccgcctgcgggtggatatgcccgcggataactttggcgtggagcctcaatacctgattacgttccggacatgggcgaaggttatccagaccagtgccaccacctggcaggaaaccgcgcagaccggggacgccatcacccattacatcaccattcgttaccgccgggggattaccgctgattatgaggtggtctgcggtgacagtgtgtaccgggtgaaacgtcagcgcgatctgaacggggcgcggcgctttctgctgctggagtgtacggagctgggcgaatgtaggcagagtcacggaggcaacaatgacgacttcctttttgcacgttgattttcagcagcccgcggagatgcgctttaaccgcgcccgtgtccggcgggcgtttgtcacgattggtcagcgtcatatgcgtgatgcccgtcggctggtgatgcgccgtgcgcggtcggcaccgggtgaaaaccccggttatcagaccggacgcctggctcgttcgattggttacatggtacccagagccagtaaacatcgccctggttttatggcacgtatagcccctaaccagcgtaatggagagggaaaccgccgtatcaccggtgatttttatccggcttttttgttctatggcgtgaggcgaggggcaaagcgtcgtcgcagccatcatcgtggtgcatccggtggcagcggctggcgactggctccacgtaataactttatggtggaaacgcttgaaaagaaccgcagctggacacgctattttctggcgcgggaattacgtaaatcactgaagccggagcgacgacgcagatgaaactgacgcctgttattgctgcgctgcgtgcccgctgcccgtattttgaaaaccgggtggcaggcgcggcacagttcaaaaatctgccggaggtcggaaagctgagactcccggcggcatatgtggtaccgggtgatgactctccgggagaaaacaaaagccagaccgactactggcaggagctgaaagagggcttctccgtggttgtcatactgagtaacggacgtgatgagcgcggtcagtttgcctcgtatgatgtggtggacgatgtccggcagatgctctttaaggccctgctgggctggaacccggaagcgtgcggtaacccgattacctatgacggcggcacgctgctggatctgaatcgtcatgagctgatttatcagttcgatttttcggtcatcagagagctgaccgaagacgatacccgccagcaggatgacctgaacagtctggatgaactgcgaacgctggcgattgatgttgattatctcgatcccggtaacgggtctgacggcgatatcgaacatcacaccgaaataccccttccttcctgaggatcatcatgtttgtgaaacctgttaaagggcggtcagtgcctgaccctgcccgcggcgaccttttgcccgccgaagggcgaaatgttgatgagaacaactactggctgcgccgtgaagcagcgggtgatatccggcgcgtgaataaaaaggtgaacaccgatgacgataagctttaacaccattccgtcgaatacgctggttccgctgttttatgcggaaatggataaccaggctgcgaatactgcacaggacagcggagcatcgctgctgattggtcatgccaataacggtgcagagattgttgccaacagtctggtactgatgccgtcggcagactatgcacgccagatttgtggtgcgggaagtcagctggcgcgtatggtcgaggcttatcgccagactgacccgtttggcgagctgtatgtgattgccgttcctgaatccacaggcgcggcggcaacggttacgctgacggtgaccggggcggcaaccgaaaccggcacggtgaatgtgtatgtgggacgtacccgcgtgcaggtaccggtgactaacggcgataacgttacgatgattgccagcagtatccaggatgccatcaatgccgttccgaccctgccgtttacggcttcatcttcggcaggcgtggtcacactgaccgcgcgtcataaggggctttgcgggaatgaaattcctgtcagcctcaattactacggctttggtgggggcgaagtgctgccagcgggcgtacagattgccgtggtgacgggtaccgccggaacgggtgctccggttctcaccggcgctgtggctgcaatggcggatgagccgtttgattatatcggcctgccgttcaacgacacggcctccgttaacacgctggtgaccgagatgaacgataccagcggtcgctggagctatgcgcgtcagctgtatggtcatgtgtatacggcaaagaccggcacgctgtcagaactggtgaccgcaggtgaccagtttaaccagcagcacattaccctggcggggtacgaaaaagacacccagacgcctgccgacgagctggcggcaagccgtaccgcccgcgcagcggtgtttatccgcaacgatccggcacgtcccacgcagaccggtgagctggtgggtatgctgcctgcgccgaaggggaaacggttcacgatgaccgaacaaaagaccctgctgtctcatggcgtggcaacggcgtatgtcgaaagcggggtactgcgcattcagcgtgatgtcaccacgtacaggaaaaacgcttacggggttgcggataacagctacctcgacagcgagacgctgcataccagtgcgtatgtactgcgcaaactgaaatccgtcattaccagtaagtacgggcgtcacaagcttgccagcgacggtacccgctttggtcccggtcaggcgattgtcaccccggcggtgatcaaaggggaactgctggcaacctaccgtcagcttgagcgtgcggggatcgtggaaaactacgaactttttaagcagtacctggttgtggagcgtgatgccagcgatccgaaccgcctgaacacgctgttcccgcctgactatgttaaccagttgcgtgtctttgccgtggttaaccagttccgtcttcagtattcagaggagtccgcataatggcccgtatcgggggaacctgttatttcaaaattgacggtcagcagctatcgctgaccggcggcattgaggtgcccatgaacaggacggtcaatgatgacatcatcggcctggacggttcagtggaccgcaaggaaactcaccgtgcgccttatgttaaagggaccttcaaggtgccgaagaattttccggtgagcaaaatcacctcgtctgatgagatgaccatcactgccgagctggcgaacggtcaggtctatgtactgtcgtctgcctggctgcacggcgaagcgaaccataatgccgaagaagggacggttgatcttgagttccacggtgaagaaggggattaccagtaatgaaagagcttgagttaaagaaaccgattaccgctcatggcgagacactctccgtactggagtttgatgagcccaccgggaaagatgtccgcgagctggggtatccctaccagatgaatcaggatgagtccgtcagacttctggcgcatgtggtatcgaaatacattgtgcggctggcgaaagtgccgcaaaactctgtcgaccagatgtctccggcagacctgaatgctgcggcgtggcttgtggctggttttttcctccaggcctgacggctgaatacctcactgatcgcttctttgactgcgccagctactggcgcattaatcccttcgaattgctgaatatgccgatcagtgaaattcccttgctggtcagtcaggcaaacaggatagagcaggagaaacgcacacatggctgaatttgagcttaaggcgttgatcaccggtgtcgacaggctttctcccgcgctgtcgaaaatgcaaaagaaaatccggggatttaaacgccaggcggaagaagcgtcacagggtgggctggcgcttggtggcggactggctgcgggtctgacgctttccctgaaatcttatgccgatcaggaaaacgccgccaccgggctgaaagttgccatgatggatgcgaacggtgaggtcggaaagcgctttcaggacatcaataaactggctattggtctgggtaaccagctacccggtacaacggctgatttccagaacatgatgcagatgctggtgcgtcaggggatcccggcagaaaacattcttggcggtgtgggtaaagcgacagcttatcttgcggtacaactgaaaaaaacaccggaagcggctgccgagtttgccgcaaagatgcaggatgctaccggaacggcgtcagaagacatgatggggctgttcgacactatccagaaggcgttttatctgggcgttgacgataccaacatgttgtccttcttcactaaaaccagctctgttctgaagatggtgaacaaggacggtcttcaggctgcacagagccttgcccccatcagcgtcatgatggatcagatggggatgaacggggagtcggcaggtaacgccctgcgaaaagttatccagtccggattaagcgttaagaaaatcagggacgtcaataaagtcatggcccgccagaaactcggggtacagctcgattttactgacggcaaagggagttttggcggtcttgataacatgttcaggcaactggcaaagctgcgaaaactgaccgacgttaagcgaactggtgtacttaaggcaatatttggtgatgatgccgaaacccttcaggtggtcaatgcactaatcgataaaggaaaggatggctacgaccagatccagcagaagatgaataaacaggccagtctgaataaacgtgttcaggcacagcttggtacgctgtccaacctgtgggaggcaatgacagggaccgcaactaacggccttgcggctattggcggcgcattttctggtgacgctaaaaatatcacgcaatggctgggggagttgggggagaaattcacgaagtttgcggatgaaaatccccgggttattcgcggcgtcgtcgggcttgctgccggtcttgcgattctgaaactgggattgatgggcgttggcggtgccatcagtattgtcagcaggatcatgtcgatgacgccgattggcatgattgcgacggcgatagccctggctgcgggattaattatcactaactgggatgttgtcggaccttatttcaagaagctctgggaaaccattggtccttattttgaggctggccgggaacttctgaagaaggtttttgcctggtcgccgctggggatggtaatcaataactggggaccggttgttaagtggtttcaggatatgtgggacaagctgaagccaattattgagtggtttaccgacagttccggtgacacggtcgatgccattaactctgcgcagtggggcgcgggtgcttatgatgcttatgggacgggaataccggcacggggatacacaccttatcaggcggtggatccggctcagtcaaacaacgcctccggtgccacaggcccgaatcccttcatgattaacaaagcttctgcgccaaaagttgatggtgagatcaaggtctcttttgtgaattcacctccgggtatgcgggttatggaaacgcgatccagcggttttgatgtcagccatgatgttggctatacgcgctttggcaggtaatgaaaaattaatctgttaatgagtcccactccggtgggattttttatgtacggagtttatatgacgtggaaagacagacttcaggacgcgtcatttcgcggtgtgccgtttaaggttgaagaagaaagtgcgggaaccggtcgtcgtgtggaaacgcacgaatacccgaaccgcgacaaaccctataccgaagacctggggaaaatcactttccgcccgtccatcacagcttatgtggtgggagatgactgctttgaccagcgcgatcgcctgattgacgcgctgaataaacccggtcccggcacgcttgtccatccgacttacggtgagctgaaagtctgtgttgacggggaagttcgggtcagcacatcgaagagtgaagggcgtattgtccgctttgacctgaagtttgtcgaagcgggagaactctcttaccccacttcaggtgcggcgacggcgcagacgctgatgtcatcctgttctgcactggatgactgcatcagtgacagcttcagtggtttcagtatcgatggcgtggcagattttgtgcagaacgacgtcgtcggtaatgccagcacaatgcttgggtatgtttctgatgcgatgaaagtggtggattctgccgtatcggatgccgccaggctgttgcagggggatatctcggtacttctgccgccgccatcgtcaggcaaaaatttcgttgagcaggtgcagaaaatgtggcgtaccgggaaacgcctttatggtaacgccagcgacctggtcaccatgatcaaaacgctttccggtgtcagcctcggcagcgatctgcaaccgcgcggcgtctggaaaacggacagtaaaaccaccgccacggcgacgcagcagcgtaacgtggttgccagcacccttcgtacgaccgcaatcagcgaagcggcgtatgccgtcacacgattgcctgcgcccacaacttccgcggtgatgcagaatgccacagtggggcagtcaacaacacccgcgcagagcaccggctggccttctgtcacgcatccggcactgaacaatgcaccggcggtgaaaaacacggttgacctgccaacgtgggaagaactgaccgacattcgcgacacactgaatacggcaattgataaggagttgtcccgtacaaccagtgatgtgctgtttctggcgctgcgccgggtgaaagcagatctgaatgcggatatcaacacgcgccttgaacagtctgcacggatcattcagcgcacaccggatgaggttttacccgcgctggtgctggcggcgacctggtttgataacgcggcgcgtgacgcggacattatccggcgtaatgccattacgcatcccggctttgtgccggtgatccctctgaaggtgccagtgcaatgaacgataacgtcacgctacgggtaaatggccgggagtggaatggctggacatcggtgcgcatcggtgccggtattgaacggctggcgcgggatttcagtgtggagatcacccgccagtggccgggtgatgagggtatcaccacgcttcagccgcgcattaaaaacggttcaaaagtggaggtgctgattggtgatgagctggtgatcaccggctgggtggaggcgacgcccgttcgttacgatgcccgttcggtcagcaccggtattgccggacgcagtctgaccgctgacctgattgactgtgcagccgaaccgacacagtttaacggacgatcgctggtacagattgcgcaggcgcttgctgcgcctttcggcattgaggtggtgaacaacggtgcgccgtcgggtgttattcctgacgtccagcccgatcacggtgaaacggtgattgaggtaatcaacaaaatactcggtcagcagcaggcactggcttacgacgacccacacggcaggctggtgattggcggtattggctcaacgcgggcacatactgcgctggtactcggggaaaacatcctttcctgcgatacggagaagagtatccgggagcggttttctgtttaccaggtggcggggcagcgtgctggaaacgacgatgatttcggtgaggccaccaccagcgcgctgcgggcccgcacagaggacgcatttattgcccgttaccgtccgatgtatatcaggcagacagggcaggctacgggggcaggctgtattgcgcgtgctgactttgaagcccgacaacgggcggcgcggacggatgaaaccacctatgtggtgcagggctggcgacagggtaacggtacgctgtggcagcccaaccagcgggtgattgtcttcgatccggtctgtggtttcgacaataccgaactgcttgtctcggaagtcacgtttactcaggaccagaacggcaccctgacggaaatccgtgtcggcccacctgatgcttatctgcctgaacccgaagcccccggcgcgcggaaaaagaaaaaagccagagtacaggaggacccgttctgatgagtacgattgaagccatgcagcgacaactcctcggcctgattgggcgggcagtggtgaaaagcatcagtgccgccacgaaatgtcagaccgtggatgtgtccctgattgccggtgaacccaaagccggggttgaacatcttgaaccctacggttttaccgcaagggcaaacagcggtgcggaagcggtggtgttgtttccggatggtgaccgttctcatgcggtggttgttacggtgtcggaccggcgctaccgcctgaaagggctgcagacgggtgaggtggcggtctatgacgatcaggggcagtctgtgacgctgacccgggaggggatcgtggtggacggtgcaggtaaaacgatcacgtttcgcaatgcacctgaagcacgttttgaaatggacctggaagtgacaggacaggtgaaagacctgtgcgactccagcggcaccaccatgtcagcgatgcggcttgcctataacgggcatcgtcacagagagaacggtcagggcagtaacaccgacaaacctgataaagcgatggaggcatgatggaactgtggctgacggtgaacggtaaacgcacctgcgccagcgcaccgctggatccgctgacccgcgccgtggtgatttccctgtttacctggcggcgggcggagcctgatgacaacgccgacgtcccgatgggatggtggggggatacctggcctgcggtacagaatgaccgttacggctcccgactgtggctgcttcagcgcagcaaactgaccaatcagctggtgcagacggtaagggggtatatccgcgaatgcctgcaatggatgattgatgacggcgtggtgtcccgtattgatctggatatcctccgcaccgggattaatgaactgggtaacagtatcactctctggcgtcgtgacggaccggtaatgatttctttagatgatctgtggagtgcgataacgcatggcggacagtgaatttcagcgcccgacgctggcagaaaatatcagtatgctccgtaacgatttattcgccaggctggacgtcagcgacacgctccggcgcatggatgaagacgtgcgggcaaaggtgtatgcggcggcgctgcatacggtttacgggtacatcgattatctggcaatgaacatgctgcctgacctgtgcgatgagtcctggctggcgcgacatgctgcgatgaaacggtgtccgcgcaagggggccacgactgccagcgggtatatgcgctgggaaggcgtcagcgatggcctgaaggtgaccgccgggagtgttattcagcgcgatgacctgattcagtacacggcaactgccgatgcaaccagcgccggtggtgtcctgcgcgtgccgatcgcctgctcaagtgcaggcgcggtcggtaacgctgacgacggtacgtcattaatcctggtcacgccggttaatggtctgccgtcttccggcgtggcagacactctgacaggtggatttgatactgaagagctggaaacgtggcgcgcccgcgtcattgagcggtattactggacgcctcagggcggggctgacggggactatgttgtctgggctaaagaattgcccggcattacccgcgcatgggcataccgtcactggatgggaacggggactgtcggtgtgatgattgccagcagtgacctgattaatcccattccggaagaatcaacggaaacggcggcaagacaacatatcgggccactggccccggtggcaggctctgatttgtatgtgttcaggccggtggcgcatacggtggattttcatatccgtgtgacgccggatacaccggaaatacgggctgccatcaccgcggagttgcgttcgttcctgctgcgtgatggttatccgcagggagaactgaaggtgtcgcgtatcagtgaagcgatttccggtgcgaacggggaatacagccatcaattgcttgcaccggcggaaaatatctccattgcaaaaaatgaactggcggttctggggacgatttcatgggcgtgacaaacgatgattacatccgtctgttgtcggcactgctgccgcccggtccggcgtggtcagccagcgatccggcgattgccggtgcggcacagtcattaacccgcgttcatcagcgtgcggatgccctgatgcgggagctggatccgcgcaccaccaccgaactgataaatcgctgggagcgtctgtgcggcctgccggatgaatgtattcccgcaggaacacagacccttcgccagcgtcagcaacgactggatgcgaaggttaacctggcgggcggcatcaatgaggatttttaccttgcacagcttgctgccctgggcagaccagacgccaccatcacgcgatacgacaaaagcacgttcacctgctcatcggcctgtactgacgcggtgaatgcgccggaatggcggtattactggcaggtcaacatgccagccgccaccaacagcacctggatgacatgtggcgatccctgtgattccgcgctgcgtatctggggcgacaccgtcgtcgaatgtgtgcttaacaaactctgcccttcgcatacctacgtaatttttaaatatccggagtaatccatgcatcgtatagacacgaaaaccgcgcagaaggataagttcggcgcgggtaagaacggttttacccgtggtaacccccagacaggcacgcctgccaccgatctggatgatgactactttgacatgttgcaggaagaactctgcagcgtggtggaggcatccggtgccagtctggagaaggcgcggcacgaccagctgcttaccgcgcttcgtgcgctgctgttaagccgcaagaatccgtttagcgatatcaaatcggacggcacggtgaaaacggctctcgaaaaccttggtttgggagaaggctctgcattacctgttggtgtgcctgttccatggccttcagccacaccgccaacaggctggctgaaatgcaacggtgcggctttttctgctgaagaatacccggaactggcaaaggcttatccgacaaataaattgcctgatttacgtggtgagtttattcgtggctgggatgatgggcgcggcgttgattcaaggcgtgcggtgctgtcaacacaagagccaactgtaggtactttttatgtggagctagctatcatctcgggaactttgagcggctcaggtgctaaatttaccgattcagtagggattggatcaaccagtagtaacattaccgttagcaacggtaatgaccagtccgtgtcgggtacagtggccgttaaccccgtcgatacccgtccacgcaacattgcatttaactatatcgtgagagcagcataatggataaagcaatattaaatagtggacttgttgctacaaaggcaggggatattaccgtttataactatgatggtgaaactcgggaatatatttccacttcaagtgaatatcttgccgttggtgttggtatcccggcatattcctgtctggatgcaccaggtatacataaggcgggttatgctatctgtcgttctgtgaatttaaattcatgggaatatgtgccagaccatcgcggtgaaatcgtctataacaccgaaacgggagaatcaaaacaaatcacagcaccgggtgattaccccgaaaatacaaccactattgccccattaacgccatacgataaatgggatggtgagaaatgggtgaccgatactgaggcacagcatagcgccgcagtagacgcggcagaagcacagcgtcagtcactgattgatgctgcaatggcttccatcggtctgattcagctgaaattacaggccggacggaagctgatgcaggcagaaacaacccggcttaacgctgtgctggattacattgacgcggtgacggcaacaaataccagcacagcgccggatgtcatctggcctgaactgccggaggcgtaggccattcaatatctggcgcacaggaagtatcgaccagttccagtgcgtccagataatccagccacgaattatattgcgccagttcctcgcctttcagacgaccaatagcagctttgccaggccactgatgggtattgatgtaggtattgacttctgaaaccaaagatatttttttcatttcagccgtcaacacctcatcctcttttgaagggggtggggaattaatccatactggccgtcctgaactgtcagcgccaatttctttcccttctggatgcagaccaagaaattgctcatatgtttctctggtaatttcaataacatcatcaggaagcgttcccgcatcctcatattctggaaacaattcttgcagataaaaacttttacttccgggtgaaaagaatactgagttcattattaccgtccaatgattaacgctgagacgctggtatctgaaggaaaggctgcattcagtggtttgtcgactttgaacacaatcgtattattccccctgacagcggcaaaagaacaaaccgccgtcgcgtatgaacctgtaatattactggatacaccaccataagctgttgttgataccagagggataacgcccagcaccttattaggaaatacaaagggcaatgtggctgtggcaatataagacttattagaacctgtgatggcataagcattatcagtcattccattcatcgccactgggccgcttatacttacagtaaccatctgaatgattagcccgtcaggttgacgaatcacaaaatttccattgccaccagtaaccgtccagaaagacatatcagggatttggttttccccgttgcccacattccgttttgccgcttctcccaaaccaaggttttcgagagc

SEQ ID NO: 10041 - DNA, 22854 bp, Escherichia coli
tggtaagacgttgccgatgtccatgacattgcaaaaagcagcaaagaagatctggaagcatatgacattctgctgctgggcatcccaacctggtattacggcgaagcgcagtgtgactgggatgacttcttcccgactctcgaagagattgattttaatggtaaactggttgcgctgtttggttgtggcgaccaggaagattacgcagaatacttctgcgatgcattgggcaccatccgcgacatcattgaaccgcgcggcgcaactatcgttggtcactggccaaccgcgggctaccacttcgaagcgtcaaaaggtctggctgatgatgaccactttgtcggtctggctatcgacgaagatcgtcagccggaactgaccgctgaacgtgtagaaaaatgggttaaacaaatttctgaagagctgcatctcgacgaaattctcaatgcctgatgtgatgcggcgtagactcatgtctacgccgtattaatagataatgccaatcaaaataattgctacaaatttgtaacttttgctgttgtacctgtacaatgtcccggtgttcaagtggccttgccgttgtaaatgtaagctgtgccacgtttttattaacaatatttgccagggacttgtggttttcatttaggcgtggcaattctataatgatacgcattatctcaagagcaaattctgtcacttcttctaatgaagtgaaccgcttagtaacaggacagattccgcatgactgataacaataccgccctaaagaaagctggcctgaaagtaacgcttcctcgcttgaaaatcctggaagttcttcaggagccggacaaccatcacgtcagtgcggaagatttatacaaacgtctgatcgatatgggtgaagaaattggtctggctacggtatatcgcgtactgaaccagtttgacgacgctggtatcgtcacccgccacaattttgaaggcggtaaatccgtatttgaactaacacagcaacatcaccacgatcacctgatctgcctcgactgcggtaaggttatcgaatttagtgatgattccatcgaagcgcgtcagcgtgaaatcgccgcaaaacatggcattcgcctgactaaccacagtctctatctttacggtcactgtgccgaaggcgattgccgcgaagatgagcacgcgcacgaaggcaaataagccagcctgaacgagaaaagccaacctgcaggttggcttttttatacaaggaaaataagaaaagcgagagttacagctctcacttatttgttattactgcgaatttcctgccagaccttatcacaatcggctttcaccgcctgatcatttccggtttgcgttgcctgaatacactgctgataatccagtacgcggacactttcctgctcggcaaactgctgatgttgtttctctttcttcagcacgtttaacacgctctggcaggcttcaattttttccggcgaaccttgtgcggtgttgatacaggcgctgtatgcctctttcagacgactgtcttcctgtggcgcggtggattgtgcacaagccaccagccccgatgccatcatggcgatgagaatcaattttttcattgcaaattcctcaaacgtgcggcaggcacaaaacctgccgcgtcgggcatcagaagatggtgaatggtgcgattaccataaatttcacgtcacgctcatcctggaagatgttgccgtaaccaccgccccagcttgggatgtcggagtggttgtcatattcggtgaaatgcagtttgaacatcgtgcccttggcacgaccgtcctgaatggtgtaaaccgcatccaggctgtaggcagactcttcaatagtccggttcttgtcgtagtacgcatccggattgctctgccaggtcgcaggtttagcatcccatgcgtaaacgtaggaagcgccgatggcgaagcctggaagattccagtttttcaggtcatacatcgcaccgaagaagaccgctttttcgccgttggcgttgaagtcggaacggttatcccaccagatatccaggcgaccgttcgaggaagcgtaggttggagtcatacgttgcaggaagtatccttgctgaccgtcagccttaacccaggtaccttcgaggcgcaaatccactacgtcagccgcccggtaaccaaaggtcaacgcctgcagccaggcggtgccgtcataaagatcgttgacgctgcgatcgtcaactttatcgcgcgtaccatagaactggtagctggtggttaacgggctaccggcgatatcaaatttgtagctggctttggcaaaatattgatcgatatacccttcggcctgaccaaacgccgcttccagtacgaagttatttttgaagtcgtacttcgccccaagggagtgtagataatcaactttggtggttttatcgttctgataaaactcatccatttccagatgccacggtgctttgtattcgttggtccacatgtaggagaaactcaacgcaccagcatcgccgtaatcaaaattcgccccggcctccgccccctgataagtacccggcataaagctccagtgtggcgctaacagcgtctgaccggttggctgaatataacctgccctcgcccaaaccggaccgtatttaaatttggccgctgctttatacaggcttataccgcttttatcgccggaccagtcttcgtcataggctttattactttttgaaaacgcgatttcgttcgggtgagagctgtcgccgttttccgccatttcaatcgccgtaaacgcggcaatatcaaggccgaacatatcagcagcataaccagactgaaaatcgaggttggcgttccaggtggagtgagaaaggttggttttgtatttatcgccgtcggtaacatctttacggtcgcgttcacgctgccagtaatagataccgccggttaaggttgaatcgtcgatgaatccttcggcgcgagcctccggaattgccataaagcccgacatagctgtaacaccggcgatagccagcgccagcgtactacgtttgccactaaacgtacgcatgggttaatcctctttgacgtataaattgctgcaccaaaggtgaacagcgaaaaaaataaaaattaaaaaagtagcgttgagaaaagtctcgctgactacaggaacagactatttttcgcgacgcgaattatcaatctctttctgtaaccagaatgtaagaacatgagcaaccgcacatattttgatgatttttgttacaaggcttaagttgtagttgaaaggcttgcagaagaataaaagcgtgaatttccagcaagatgaaaacggttacattttacttaattatggtttgtgattttaaatttgttttctggataaattgcgaagcggaattaattcgcgaagaaaagcagaaaaaaaacgccgcagagcgcggcgtttgggattgtttgcatatttcttgccggatgcggcgtaaacgcttcacccggcctggtagaacttaaaattactcgccaactttcgcccaggtatcacgcagcccaacggtgcggttaaataccggtttttccgccgtagaatggcggctgtcgaggcagaaataaccttcacgctcaaactggaatgctttacccgcaaccgcatctttcagcgacggttcagcaaagccctgtttgatcaccagcgattccgggttaatcaccgacaggaaatcatccgcagcaccagggttcggcacgctgaacagacggtcatacaaacggatttcaaccggcagcgcatgtgccgcgctcacccagtgaataacacctttgactttacgaccatctgccggatctttgcttaaggtgtcggcgtcataagtacagaagatggtggtgatattgccttcggcatctttctccacgcgttctgccttaatgacgtaagcattacgcagacgcacttctttacccagcaccagacgtttgtactgcttgttagcttcttcgcggaaatcggcgcgatcgatccaaatctcaccgctaaacggcacctgacggctgcccatttccggtttattcggatggttcggcatggtaaccatttcgccttcgccctggtagttttcgataaccagtttcaccggatcgataaccgccattgcgcgcggcgcattttcgttgagatcttcacggatgcaggattccagtgacgccatctcaatggtgttgtcctgcttggtcacaccaatgcgtttgcagaactcacgaatagaagccgcagtgtaaccacgacgacgcagaccagaaatggtcggcatacgcgggtcatcccagccttcaacgtgcttatcggtcaccagcaggttcagcttacgcttggacatcacagtgtattccagattcaggcgcgagaattcgtactggcgcgggtgaacaggaatggtgatgttgtccagtacccagtcgtacagacggcggttgtcctggaactcaagcgtacacagagagtgcgtaataccttccagcgcatcgctgatgcagtgggtgaagtcgtacatcgggtagatgcaccacttgttgccagtctggtggtgttcagcaaacttaatgcggtacagcaccggatcgcgcatcacgataaacggcgaagccatgtcgattttcgcacgcaggcaggctttaccttcttcaaaaccgccggtacgcattttctcgaacagcgccaggttctcttcaacgctgcgatcgcggtacgggctgtttttacccggctgcgtcaaggtgccgcggtattcgcggatctgttccggcgtcagttcatcaacgtacgccaggcctttattgatcagttcgatcgcataggcgtggagctgatcaaaataatcggaggagtaacggacgttaccagaccagtggaaacctaaccactctacgtcgtttttgatcgaatcgacatactcgatatcttcttttaccgggttagtgtcgtcgaaacgcaggttgcactggcctttatagtcctgggcgatcccgaagttcaggcagatagatttcgcatggccaatatgcagatagccattcggctccggcgggaaacgggtgtgtactgtggtgtgcttaccactggccagatcttcatcgatgatctgacgaataaagttagtcgggcgggcttctgcctcactcatcgtggattcctcaaagcgtaaacaacgtataacggcgtatgatcttataagcgggacaggctgacaactgttagttagagaaaaaatggttttgcgtaagatattggggcgttttctgcgctactgccagcagatcctcgcgctggaaacgtaaggccaaacgtcgccagcctgacgcatttattaaattgccggatgagctggccgcagagtcatagattagtcggctatgattaaacgcgtcgacaaggacgcaagcgttctacgcgtctgcccatcaagctgactatccgtaataatctctgtcagttcattaagatgcgcgatattaaacagcgaccatgaaccgtattttgagctgtcagccaggagaattttgcgcgaagcatgcgcgataagatcgcgttttagtgcggctttctcttccgtgggtgctgtaatacccttttcaagatcccagctgttacagcttaaaaatgccacgtccggccaggtattttgcagcaatttacgaccatgttcgccaatgcaggactggctggagtcgtcgatacgtccgccgataatcgtcacttcaatttgcttgaattcagccaaaaaaagcgcgatatgcaggtcgctggtgatcacgcgaagcggtaaatgtgtaatctgccgcgcaagttcaatcattgtcgtaccggcatcaaggacgacggaatcccccgctttgaccattgacgccgctgcgctggcgatggcatgtttttccgccaggctgcgctgcattttctcatgggtagtcggttgggtaggaataaaccggttgagggtcacaccgccgtgtgtacggctgataacaccctgctcatcgagttttatcaggtctcgacgaatcgtagccggcgacgcattggttaccgccaccagctcatcaacggtgaccagattatggcttttcaggtaatccatgatctgctctaaccggttatatcccttcattttattctcgcgaaatctgcattgctaactggatggaaactgccatgctctcagacttggcttttcctgtccaggcaatatcaaacgcggtgccgtggtcggcagaagtgcgaataaatggcaacccggcggtgatattcaccccatcataaaatccaagcagttttaaagggatatgcccctgatcgtggtacatagccactaccatatcgaatagcccttcatggcattgcataaacacggtatctggcgggcacgggccagtaacatcaatatcttcggcctgcattgcttcaatcgcaggcgcgataatctcgatttcctcagtgccgaataaaccatgttcccctgcatgtggatttacacccgccacggcaatacgcggacgctcaataccaacacgtttcaggaagtggttcgcaactcgaataaccgttttgaccctttcaccattcaaagtatccaggaatttacgcagtgagatgtgagtcgaaatatggataaccttgagcttatcggtatagagcaccatcgcgtactctttgctgccggtaagatgggccagcaattccgtatgccccggatagttatgcccgccaagatgcagcgcttctttattcagcggcgcagtggctatggctttcacctcgcctgataaggccagagccgttgcacgtttgatacagcgatacgctaaatcgcctgccgcagcctgtaccactccgggtgtcagcgcatcggggttagccagcggctcatccatcacgttaatcacgccgggagcaaaatgggcgtcgcacaccttttgaatgacgcgtaactctgcctgcggcgtgatattcatcgccataatacgtcgcagcgtacgcacacagcccaccaccaccaccggggcaccagcaagcccggcttcgctcagggatttaataatgatctccgggccaatacccgccgggtcacccatcgttaccgcaataatattattcactacacttctcctcgataaaattcagaacctgatgcaacgtggtctcatcgccaaacccaccggctttcgtcatcaccgaacgggaccagacaccgcccagaaagtgaccgtatggaacgcattgcgccaccttccccgtaatacgaaatccggtcgcgcctaacgcactggctgttgccattgcgacatcaccaccagagagataaagcgcatcgggcattgtgcgaagcagaacttgccgggtaagttcgccaagaaaccggcaaattttttccccaagtgcagcgcgactcatctgccaacgctggcaaagggtgtcgatctgatgtcttgctacagaatcgttacaggtgtggacaatgcagtggtcgcctttctgcaaggcctgcacaatacgcgcgtcatagtcactggcattgcctgccagaatgtgttcaacatcgacgtatatctgtgtgatacgtgggtgtgaatgaagtgtggcgatctgccgttgagcgatttcgctcattgaaccaataatggccagcacggtgggtggcgacataatcgcggagcgccgggcaacggcatcacaaataccagcggagccgaccagcagcagcggttgtttagcctgcatcacagcggcagcgatgcgatccaggtcgctgtccgtctgcgcatctatcacgccaatccacggttgctcataagacaaatggctgagctgagaaaccgtaacgggctggcatggaatggccgtctgcaaccggatgatatccgcaattcgggcgctcaataccggggttttcggatcgctggcaaactcggtttccgttatccgcacaccgtttacccaacactcaccggccactgtggtccttcccgcctgaggaaatgcgggggcaaccactgcgcccgttataccgcatgccttcatcagggcttcaatttctgcgccgatattgcctcgcagcgtggaatctatctttttaatcacgagcggcggattattcgccagagggagatgactcatcagcgaggttattttcatcgccgccagcttaggatccatcgcccggctgtcgctgttaatcacccatacgctggcatcaccgcgataatgcatttcaaaggccacatcaactgtatgccccacctgcgccaggcttacccccgcgtcgttggctcccgtgaaatcatcggcaacgacgagaatgctcggcttagtgattcccttttccatcatcactccaggttgttttatgataacaatgattatattcaatcatgattgattaaatgtgagcaagctcaagttattaatcactcgaataaattataaaattagaccatgttacgtaggctacggcattttgaatgattgaattcaatcaccagaagagaggttatttgtggtaattatcaatagcacgatactgagcggcgcaggcgctatcccttccctgacgtcgctcttacccgacatcagaaaaatgctgctggtcactgaccgtaatattgcgcagctcgacggtgtgcagcagattcgcgccttactggaaaagcactgcccgcaggttaacgttatcgataatgtgcccgcagagcccacgcatcatgatgtgcgccagctaatggatgcccttggcgatgcctcttttgatgtggtggtcgggatcggcggtggcagcgtgttggatgtggcgaagctgctgtcggtgctttgccatccacaatcaccggggctggatgcgctgcttgcgggtgaaaaaccgactcagcgggtgcaatcatggttgattcctacaaccgccggaaccggctcagaagccacgccgaatgcgattctggcaatccctgaacaaagcacgaaggtgggtattatttcccaggtgctgttaccagactatgtggcgcttttcccggaactgaccaccagcatgcccgcgcatattgcggcgtccacgggcattgatgctctttgccacttactggagtgttttaccgcgaccgtggcaaatccggtcagcgataacgcggcgctgactgggttaagtaaacttttccggcacattcaacccgccgtgaacgatcctcaggatctgcgcgcaaaactggaaatgctgtgggcgtcttactatggcggcgtagcgataacccatgcgggcacgcatctcgttcatgcgctctcctacccgttaggtggcaaatatcatctgccgcatggcgtcgcgaatgccatcttgctggcgccgtgcatggcgtttgttcgcccctgggcggtcgagaaatttgcccgggtctgggattgcattcccgatgcggaaaccgccctgagcgcggaagaaaaatctcatgccctggtgacctggttacaggcattagtcaatcaactcaagctacccaacaatctcgcggatctcggcgtaccgccagaggatattgcctctctgagcgaggcggcactgaacgtgaagcgccttatgaacaatgtgccgtgccagcttgatctacaggacgtacaggccatttaccaaacactgtttccgcaacatcaatttaaggaataaatcatgccgaaaaccattgaaggtgtattaaccgctatcgtcaccccgtttaccgcgaccggcagtctgaatatcccggcgttaaaagtgcaggtgaatcgtcaactggaagcgggtaacgcgattttttgcggcggcaccaacggcgagttttttgtgttgaatgaacaggagaagctcagcgttacgcaaacctgcgtggatgaagtggctggtcgtgcgccggtcgtggcacacattggcgagatctctacgcgcgaaacgattcgtctgggtcagcagattgaaaaacttggcgtagatgccgtgtcggtcattgccccttacttcgtaccgctgaaacaggaagagttgattgcgcattacagcgcaattgccgacgcactgagcattccgatgtttctctataacatcccggcccgcactggcaatacgatccagccagaaaccgcgcgtgctctggcgtcgcaccccaatatcattgggattaaagacagcgccggaagcgacgaaagcctgaagggttttctcgatgcggtgcgcgacattgacggctttaatgtgctcaacggcccggattcgctgatccataaagggtttgtcgagggatgttcagcctgtatctctgggctcgccaacatcgcgccgcgagaaatcaatgccatctggtctcgcttccatgccggtgatattgaagggtcttatgaagcacaggagagtgtaacgggcctgcgtaccgatctttataaagtagcattctccccggctgcggtgaaaaaagcgttgcagcttatggggcatgatgttggtgatagccgctacgcggttaatttcacgcctgaacagatcagcgagattcaacaaattattcgtcattataacattaattaaattaactctattatccagcccgctataaagtttagataaagagaataaaggattaccccatgtttttgtggtttatgcagccagatatctggctcactttaattaccctcacctttctggaaattattcttggggtggataatattatttttctttcactggtggtggcaaaacttccgttatcacaacaaaatatggcgcgtaaactgggtttaagctgcgcgatgattatgcggatattattgctgatatccattgcgtggctttcacatattacccagccgctttttaccgtgctgacgctggagatttcgttccgcacgttgattctgctcggggcgggctgttcctgatttataaagcgatacaggagatacgcgaagagctgtcgcccgcgcaggaagacgaacatggcagcggatcgcggcaactgtcgttgtgcggtgccattgtacagataatgctgctcgatatcgtgtttagcctggattcggtgatcaccgccgtcggcctttctcagcatatatttatcatgattgccgccgtaatgattgccgtcggtgtcatgatgtttgcggcgaaaacaattggtgatttcgttaacgccacgccgtcaataaaaatactggcgttaacctttttattgtttgtcggtgtattgctggttgccgatagtctcaacattcatattgccaaagagtatctctacttcgcgatatttttctcattaagtgttgagacactcaatattatccgtgaaagaagaaagtttcgacattgatcgaaacgcatgaatcgcactcgcattaataaatctattaccaactttaagatggagtctaactatgtctgtagcccttattcgtgacggcgtcatccgtccatccgaaaacgattcgcatgtgcttaccgccatgctgccctcgtcctgcccgcaaaaccacgcggcgaatattctgcctttgccggatggcgcgttaatgtgcgtctggtttgcgggaacgcaggaaggtattgccgatatttctgtctggggatcgcgattgcccgctggcggaatgcagtggagcgatgcggtcaaactttcccacgatgacacgcgttcagagcaaaacccggtgctgtttctcgcgccggataacgtgctgtggctcctatggaccgcacaaatatccggtaatcaggacaccgccatcgtccgctaccgtaagtcagacgacctcggacaaacctggggcgagattgccaccctgcttgataaacccggtacgttcattcgacagccaatcacggtgcttgataacggcaactggctgctgcccgtcttttattgccgtacccaacccggcgaaaaatgggtcggcaatgatgatatcagcgcagtgaaaatttccgctgacggtggtcactcctggcgcgatgtcgaggtgccgcaaagtctcggctgtgttcatatgaatatcacaatgttgcacgacggtacgttggttgctctctttcgcagccgttgggcagacaacatctatatcagccattcagtggacaacggcgagagttggtcggtgccgcaagcaaccgaattgcccaacaacaattcgtctattcaggtaacgacgcttgccagcggcgaactggcgctggtgtacaacgcgatgagtgcggcaggcgcagtagaacgtcgcgcgtcgctttatgacgaaatcgtcgatggcgacgacagccgcaaagaaccgacagccgtcggacgctccgctttctggggtgccccacgcgcgccgatgacggtagcgatttctgccgatggtgggaaaagctggccgtggcggcgcaatctcgatgaaggcgacggctactgcatgaccaacaattccctggaaaagctaaatcgtgagttctcctaccccagcatcaaacaaagcccggacggtacgctacatatcgcttacacctggtggcgtcaggccatcaagtacgtacgcatctcccccgagtgggttaaggggcaggcatcatgattatcggtaatctcaaccatttgtcgctggcggggcttcctgcctgggtgagaaatattctgctgcgcccggagtgttcattatcggcgttatccaccagagaggacggtcgctggcaacctgaaggatgtcggtggttctgcacgctgggaacttcagacacgcaacccgccgaactccgccatacggagtatcaccatttatgggccgatatacaggtggtgattactggttgtgagggcattaatgcgggaacgcggcccatcgctcgcgaaaacgatgaagaacgtaagcccgatctgtttatcgccccatcccctgaaaacagtgtcgccatcaccctacacgccggtgatttcgccgtctttatgcctgaggaacctcaccaggcgctgtgcgcaattggcacggctacttcaatacgcaaagcggtctttaaagtaccgcgcgacatgctggaagcctaaaaggagagaaaaaatgacaatggaaatgatcctggcattaggaatactggtcctgatgatcgtgctgatcatgtcggacaaaatgccttttggcgcaccgccactgcttgcgtgtttattgctggttgtatcgggactttcgaccgttcaacaggcttttgccggattcgtcaatccaagcgtggtgatgattgcagggtttatggtggtcatggcggcgctacaaaaaacccggcttatcagcaacgttaaatctgcgatgataagcctggtcaataaaggcagttaccgcagctatgggctgttgttagtcattgttatgctgggtgccagtcttgccggcaccggagcgaccggttattacgtgctaattctgtcgctggtatccaccattccgtacagtaaaaagctaccaacatcgaaattaatgatgcccctgggatttgccaccaaccacccgcttcttcctatcaatctcgcgcttctctttggcgttacggcgaccgtactcgaaaccgcggggtttcatcaggagatttcgatggggcgctttgcgctggtgaatctcatcatgtcagcggctttcctcgcatggagtcttattgcctaccgttttcttccggatcatcccattgcggatgcttccgaggatgcgctggcggcacgcgaggaaacgtttaacgcccttcctgcctggaaagaatattgcactattgccgcattcgctgtcagcgttatcggcatgatgctaatgaacattctgggaaatatcgccttcgttattccgggtcttgcgggtgcgtttgttctgatgatcgatgtactggacttcaaagaagttcgcgatcatatgggggctccggtcattttaatgatggcgggggtgatcggtatagctgatgcactggcgggcaccggctttacggcgatggttggcgatgccgttgcaggtgtgctcggttctggcgtctcaccgtttgtatttattgtcgcctttgctttgcttaccagtacctgcgccaccttcacgggttcgaatatggggtcagtatatatttttgcccccatcgccattgccgcctgtactagccttgggcttaacccgaccgctgccgcgattgcggtggtgatttctggctggaatggcggctatatgcctattgacggaatgccagccatgatcctcggaatggggaaatacaaacttcccgaattctgggtgttctctgtaccaatgtatctcatccgcattctggcgctttgtgcaggcgctgtttttatcttcccaatgtaatctcagacaaaaaaagcggcagagaagatccctgccgctttttattgtctgatgcgacgctgccgcgtcgcatcagacataaagcagattactttttgatttcatacagcggtgtttgacccgccacaacatggccctgagctttaatgataaggccgctgaaatcgtcgatattgctgcaaaccaccgggctaatcatcgagcgagcgttagcgttcaggtaatccagatccatttccagaatcggttgccctgcgcttacctgcgcgccctcttccaccagacgtttaaagcctttaccttccagcgctacggtgtcgatacccatatggacgacgatctccgcgcctttttcggtttccagacagaatgcgtggttggtgttgaagattttcacgattgttcctgcggctggtgatacgacgattttatctgtcggtttcaccgccacaccgtcacccaccgctttgctggcgaatgcttcgtcaggaacctgatccagtgccacaacatccccggtaatcggcgataccagctccgcgatagataccgcgtttggtacagcctgcggttttgctacaggagcggcagttgccggagttgcttcagctgacgcagcggctaccggaccacgggcaacgactttcttcatcgcatcgccgatggattctgctttcgcgccaacaatcacctgaatagtctgtttgttcagtttcactaccccagaagcacccagacgtttacacatcgcatcgttgacgcgagctgagtcaaccacggtaaggcgcagacgagtaatacaggcgtcaatggctttcaggttgtcagtaccgccaaccgcagcaatatagttggttgccagttgattgagaccttcttcagtattgctgttagcctcttcagtaacgatctcgtcttctttatcttcacgacccggcgttttcaggttgaacatgcggataaccaaactgaacaccacgaagtagatagcgaagaagacaacccccatcaccagcagcatccagacgttctggctggcggccggcaggttatacatcaacgcgtagtcgatagcccccgcagagaaagagaagccggcatggatacccagcagcgttgccacaaacaggctgataccggtcagcagtgcgtgcaggaggtacagcagcggtgcaaggaacatgaacaggaattccagcggctcagtcacaccggtcaggaacgcagtaacagcaacagaaagcagcatcccgccaaccatcggacgacgctctttcggtgctgcgaagtacatcgccagcgccgcacccggcagaccgaacatcataatcgggaagaagccggacatgaacatccccgcggtgccgtcaccggcatagaagcggttgatatcaccgtggaaaaccgttcccgccgcgttggtgaattcaccaatctggaaccaggcgatggtgttcagcacctgatgcagaccggttgggatcagcagacggttgatgaaaccaaagataccggaacccagcgcgcccgcagaaacgatccactcgccgcctgcatggatagcgtgctgtaccggtggccagacgtaaccaaaaatggccgccagcaccagacagaagaagccggtggcgatcggcacaaagcgtttgccgccgaagaagctcaggaagtccggcagtttaatatcggaccaacggttataggctgcgccaccaaccagaccggtaatgatacccgccagtacacccatgttaatttctgggttgatggtcaccatcgctttggttaacacaaagtaacctaccgcacccgccagtgccgccgcacctgcgctgtctttcgaccagctggatgccacgccgatggcgaagattaatgcgaggttatcaaaaatcgcaccgcccgcctgggcaataaacgcaacgttaagtaaatctggctgaccgaatcgcagcaacagcgccgccaccggcagcaccgcgatagggagctgtaacgccctaccgagtcgctggaaaaaacctaaaatattcatcttattccccctacgagaaccctatttggctcgtttaaagccgtatttttattttgctgcaaattgtactgccgatgttctgtaatcagattgttagatcatctgctacagagtgtgtgaaaatttaattcgtatcgcaaattaaacgcgtgtcttttgtgagttttgtcaccaaatatcgttatcatcactcccttttactggctaaaccagaaaacttattttatcattcaaaaaatcaggtcggattgacgcctgtctgcgcaaatccaggttacgcttaaagatgcctaatccgccaacggcttacattttacttattgaggtgaataatgagactgatccccctgactaccgctgaacaggtcggcaaatgggctgctcgccatatcgtcaatcgtatcaatgcgttcaaaccgactgccgatcgtccgtttgtactgggcctgccgactggcggcacgccgatgaccacctataaagcgttagtcgaaatgcataaagcaggccaggtcagctttaagcacgttgtcaccttcaacatggacgaatatgtcggtctgccgaaagagcatccggaaagctactacagctttatgcaccgtaatttcttcgatcacgttgatattccagcagaaaatatcaaccttctcaacggcaacgccccggatatcgacgccgaatgccgccagtatgaagaaaaaatccgttcttacggaaaaattcatctgtttatgggcggtgtaggtaacgacggtcatattgcatttaacgaaccggcgtcttctctggcttctcgtactcgtatcaaaaccctgactcatgacactcgcgtcgcgaactctcgtttctttgataacgatgttaatcaggtgccaaaatatgccctgactgtcggtgttggtacattgctggatgccgaagaagtgatgattctggtgctgggtagtcagaaagcactggcactgcaggccgccgttgaaggttgcgtgaaccacatgtggaccatcagctgtctgcaactgcatccaaaagcgatcatggtgtgcgatgaaccttccaccatggagctgaaagttaagactttaagatatttcaatgaattagaagcagaaaatatcaaaggtctgtaattattatccctgccctgacaccttgctcagggcaatattttttaaaatcgggggtcagaatgtatgcattaacccagggccggatctttaccggccacgaatttcttgatgaccacgcggttgttatcgctgatggcctgattaaaagcgtctgtccggtagcggaactgccgccagagatcgaacaacgttcactgaacggggccattctctcccccggttttatcgatgtgcagttaaacggctgcggcggcgtacagtttaacgacaccgctgaagcggtcagcgtggaaacgctggaaatcatgcagaaagccaatgagaaatcaggctgtactaactatctgccgacgcttatcaccaccagcgatgagctgatgaaacagggcgtgcgcgttatgcgcgagtacctggcaaaacatccgaaccaggcgttaggtctgcatctggaaggtccgtggctgaatctggtaaaaaaaggcacccataatccgaattttgtgcgtaagcctgatgccgcgctggtcgatttcctgtgtgagaacgccgacgtcattaccaaagtgactctggcaccggaaatggttccagcggaagtcatcagcaaactggcaaatgccgggattgtggtttctgctggtcactccaacgcgacgttgaaagaagcgaaagccggtttccgcgcggggattacctttgccacccatctgtacaacgcgatgccgtatattaccggtcgtgaaccgggcctggcgggcgcgatcctcgacgaagctgacatttattgcggtattattgctgatggcctgcatgttgattacgccaacattcgtaacgctaaacgtctgaaaggcgacaaattgtgtctggttaccgatgccaccgcgccagcaggtgccaacattgaacagttcatttttgcgggtaaaacaatatactaccgtaacggactttgtgtggatgagaacggtacgttaagcggttcatccttaaccatgattgaaggcgtgcgtaatctggtcgaacattgtggtatcgcactggatgaagtgctgcgtatggcgacgctctatccggcacgtgcgattggcgttgagaaacgtctcggcacgctcgccgcaggtaaagttgccaacctgactgcattcacacctgattttaaaatcaccaggaccatcgttaacggtaacgaggtcgtaactcaataagagaaagtatgacaccaggcggacaagctcagataggtaatgttgatctcgtaaaacagcttaacagcgcggcagtttatcgcctgattgaccagtacgggccaatctcgcggattcagattgccgagcaaagtcagcttgcccccgccagcgtaaccaaaattacgcgtcagcttatcgaacgcgggctgatcaaagaagttgatcagcaggcctccaccgggggccgccgcgctatctccatcgtcaccgaaacccgcaatttccacgcaatcggcgtacggcttggtcgtcacgacgccaccatcaccttgtttgatctcagcagcaaagtgctggcagaagaacattacccgctgccggaacgtacccagcagacgctggaacatgccctgctgaatgccattgctcagtttattgatagctaccagcgcaagctacgcgagctgatcgcgatttcggtgatcctgccagggcttgtagacccggacagcggcaaaattcattacatgccgcatattcaggtagaaaactgggggctggttgaagcactggaagagcgttttaaagtgacctgttttgtcggccacgatatccgcagtctggcgctggcagagcactacttcggtgcaagtcaggattgcgaagactccattctggtgcgtgtccatcgcggaaccggggccgggattatctctaacgggcgaatttttatcgggcgcaacggcaacgtcggtgaaattggccatattcaggtcgaaccgctgggtgaacgctgccactgcggcaactttggctgcctggaaactatcgccgccaatgctgccattgaacaacgggtgttgaatctgttaaagcagggctaccagagccgtgtgccactggacgactgcaccatcaaaactatctgcaaagccgcgaacaaaggcgatagcctggcctcggaagtgattgaatatgtcggtcgtcatctgggtaaaaccatcgccattgctatcaacttatttaatccgcaaaaaattgttattgctggagaaatcaccgaagccgataaagtgctgctccctgctattgaaagctgcattaatacccaggcgttgaaggcgtttcgtactaatctaccggtggtacgttctgagttggatcaccgctcggcaatcggcgcttttgcgctggtaaaacgcgccatgctcaacggtattttgctccagcatttgctggaaaattaatgtgcttttatagtggcgcttattgttgtcaatattctgggtagtccatgaccattaaaaatgtaatttgcgatatcgacggcgtgctgatgcacgataacgtcgccgtacccggtgcagcggaatttttgcacgggattatggataaaggcctgccgctggtgttgctgaccaactatccttcacagaccgggcaagatctggcgaatcgctttgccactgccggtgtcgatgtaccggatagcgtgttttatacctccgcgatggcgaccgccgatttcctgcgtcgccaggaaggcaagaaagcgtatgtggtgggcgaaggcgcactgattcatgaactgtacaaagccggtttcactattaccgatgtgaaccctgattttgtgattgttggcgaaacgcgttcctacaactgggacatgatgcataaagcagcctatttcgtcgctaacggtgcacgctttatcgccaccaacccggacacccacgggcgcggtttttatcccgcctgtggcgcgttgtgtgcagggatcgagaaaatctccgggcgcaaaccgttctatgttggaaagccgagtccgtggatcatccgcgcggcattaaacaaaatgcaggcgcattcggaagaaacggtgattgtcggcgataacttgcgtaccgatattctggcgggcttccaggccggtctggagacgattctggtgctttctggtgtttcgtcactcgacgatatcgacagtatgccgttccgcccaagttggatttacccatcggtcgctgaaatcgacgttatctgaatagcaaccacgcctcagggcgtggtttcttatttttacccatcattaaaatcaccccattcaataaaacccgtcaaaaattatcgatccatcaataaatatacccaaaagccctcccctttttcatcaatcagcaatcgccattacgttttttatttttccaccgccaaatcgcttgcgcaccgtgctgctttgcggcatttttttaacaagcaaacacaacacgcagtaaacaccaggttaacggagaaggttatgtgttcaatttttggcgtattcgatatcaaaacagacgcagttgagctgcgtaagaaagcactcgagctgtcacgcctgatgcgtcatcgtggcccggactggtccggtatttatgccagcgataacgccattctcgcccacgaacgtctgtcaattgttgacgttaacgcgggggcgcaacctctctacaaccaacaaaaaactcatgtgctggcagtaaacggtgaaatctacaaccaccaggcattgcgcgctgaatatggcgatcgttaccagttccagaccgggtctgactgtgaagtgatcctcgcgctgtatcaggaaaaagggccggaatttctcgacgacttgcagggcatgtttgcctttgccctgtacgacagcgaaaaagatgcatatctgattggtcgcgaccatctggggatcatcccactgtatatgggctatgacgaacacggtcagctgtatgtggcctcagaaatgaaagccctcgtgccagtttgccgcacgattaaagagtttccggcggggagctatttgtggagtcaggacggcgaaatccgttcttattatcatcgcgactggttcgactacgatgcggtgaaagataacgtgaccgacaaaaacgagctgcgtcaggcactggaagattccgttaaaagccatctgatgtctgatgtgccttacggtgtgctgctttctggtggtctggattcctcaattatttccgctatcaccaagaaatacgccgcccgtcgcgtggaagatcaggaacgctctgaagcctggtggccgcagttgcactcctttgctgtaggtctgccgggctcaccggatctgaaagcagcccaggaagtggcaaaccatcttggcacggtgcatcacgaaattcacttcactgtacaggaaggtctggatgccatccgcgacgtgatttaccacatcgaaacctatgacgtgacgacaatccgcgcttcaacaccgatgtatttaatgtcgcgtaagatcaaggcgatgggcattaaaatggtgctgtccggtgaaggttctgacgaagtgtttggcggttatctatacttccacaaagcgccgaacgctaaagagttgcatgaagagacggtgcgtaaactgctggccctgcatatgtatgactgcgcgcgtgccaacaaagcgatgtcagcctggggcgtggaagcacgcgttccgttcctcgacaaaaaattccttgatgtggcgatgcgcattaacccacaggataaaatgtgcggtaacggcaaaatggaaaaacacatcctgcgtgaatgttttgaagcgtatctgcctgcaagcgtggcctggcggcaaaaagagcagttctccgatggcgtcggttacagttggatcgacaccctgaaagaagtggcagcgcagcaggtttctgatcaacagctggaaactgcccgcttccgcttcccgtacaacacgccgacctcaaaagaagcgtatctgtaccgggagatctttgaagaattgttcccgcttccgagcgccgctgagtgcgtgccgggcggtccttccgtcgcttgttcttccgctaaagcgattgagtgggatgaagcgttcaagaaaatggacgatccgtctggtcgcgcggttggcgttcaccagtcggcatataaataagacgtgtaatattgccccggagaaatccggggcaatttcagttactggggcgcttgttgattctgatatgcagtaaggaaatgttccgggtttgccacatcgatgtttgacaactcattactgtaggccagtatttcatagattaatttcccaccactattgttgaattcc

SEQ ID NO: 10042 - DNA, 22781 bp, Escherichia coli
tatcgcgaaaaaaaagatggctacgtagctcagttggttagagcacatcactcataatgatggggtcacaggttcgaatcccgtcgtagccaccatcttttttttgcgggagtggcgaaattggtagacgcaccagatttaggttctggcgccgcaaggtgtgcgagttcaagtctcgcctcccgcaccattcaccagaaagcgttgtacggatggggtatcgccaagcggtaaggcaccggtttttgataccggcattccctggttcgaatccaggtaccccagccatattcttcgagtaagcggttcaccgcccggttattggggtatcgccaagcggtaaggcaccggtttttgataccggcattccctggttcgaatccaggtaccccagccatcgaagaaacaatctggctacgtagctcagttggttagagcacatcactcataatgatggggtcacaggttcgaatcccgtcgtagccaccaaattctgaatgtgtcgaatatgttcggcaaattcaaaaaccaatttgttggggtatcgccaagcggtaaggcaccggattctgattccggcattccgaggttcgaatcctcgtaccccagccaatttattcaagacgcttaccttgtaagtgcacccagttggggtatcgccaagcggtaaggcaccggattctgattccggcattccgaggttcgaatcctcgtaccccagccacattaaaaaagctcgcttcggcgagctttttgcttttctgcgtatattcaatgccgaatacgatgttgactcgtcttatccttacaaagtcggatgcgacgctgccgcgtcttatccgacctacggttggcatgcatccagcaatgttgtgaggctacaaccctaacgcatatttcagcgccttacgtttcaacacgccagcacgctccgccgccatcaaaccaagattacgcacaaaacgcagcggtggcagattattgctgaatccggcataaaacagatccataccactttgcatcatgaagttatccgccatacgccgcatctggtaacgcttgagcacaggataactggcccacgcttcgccgtagctgcgggcgttcaccagaacgtcaatcagggcatcgacatcacgataaccaagattcactccctgccccgccagcggatggatggtatgcgcggcatcgcccaccagagcaagccctggttgcacatactgcaacgcatggcgacgtatcagcggaaacgcaccagcggcaagcggtgttacgtaacccagacgcgacgggaaatgcttcgcgatttccgcctgtagctgcgccatattcatattctgcaactggcgaatgcgcgccggagagtcataccacaccagcgatgcccagttatcaaacaacggcagaaacgcacgcggtccgtccggggtaaattgctgccaggtgctgtcgccgggatcgttctcacactgtacgctaattaacatacacgactgcgcatactgccaggcatgaacgccaattcccgccatctgtcgcacctgcgaatttgcgccgtcggcaccaatcaccagcttcgcgaggatcgtttcaccgcccttcagttccagctcctgaagatcattatggcgatgcagtgcaatcagcgagcctggcacacgtaacgttactttcggatgcgcttccagcgcctgccacaacgcctgttgcaggacagtgttttccaccatgtagccaagcaacggtagcttaagttcagcggcgtcaaacacgacatgcgccgtttcccactcccacgtttccagtctgcggtaaggatggcaacgcatagcctgtactgcatcccagacccctaaccctttaagcaatgataccgaagccgcgctgatcgccgagatccgcacgtccggttggctgtcagcgacaaacggcgcaggttctgcgtgctcgatcaccgttaccgcaaatccgtgctgtgccagccccagcgccagtgcgccgccgaccattcctccgccgacaatggcaatttccgttggttgatttgtcatggtcaatcatcctgttagcaatatgctttaagtttacaggatttttacccccaagggctgataacgctcatactggtcacaacggcagcaaagcattacactatgcgccctgcattcctggctactatttcgcaagagcaagtcgatgaccaaaaaactccatattaaaacctggggctgtcagatgaacgagtacgattcatcgaagatggccgatctgctggatgccacccacggctatcaactgaccgacgtggcggaagaagcggatgtgctgctgctgaacacctgctcaatccgcgagaaggctcaggaaaaagtcttccatcagttgggtcgctggaaactgttaaaagagaagaatccagacctgattatcggcgtcggcggctgcgtggcatcgcaagaaggcgagcacattcgccagcgcgcccactatgtcgatattatttttgggccgcaaacgctgcaccgcctgccggagatgatcaactccgtgcgcggcgaccgcagcccggttgtagatatcagcttcccggaaatcgagaagtttgaccgtctgccggaaccgcgtgccgaagggccgaccgcgtttgtctccatcatggaaggctgcaataaatattgcacctactgcgtagtgccatacacccgtggtgaagaggtaagccgtccgtccgacgatattctgtttgagatcgcccagcttgcggctcagggcgtgcgtgaagttaacctgctcggccagaacgtgaacgcctggcgcggtgagaactacgacggcaccaccggatcgtttgccgatctgctgcgtctggttgcggcgatcgacgggatcgatcgtattcgctttaccaccagccatccgatcgaattcaccgacgatatcatcgaagtgtatcgcgacacgccggagctggtgagcttcctgcacctgccggtacagagcggttccgatcgcattctgaacctgatgggccgtactcacacggcgctggagtacaaagcgatcatccgtaaactgcgtgcggcgcgtccggatattcagatcagttctgacttcatcgttggcttccctggcgaaaccaccgacgacttcgagaaaacgatgaagctgattgccgacgtcaatttcgacatgagctacagctttatcttctctgcacgtccgggtacaccagccgccgatatggttgatgatgttccggaagaagagaagaagcagcgtctgtatattctgcaagagcgcattaatcagcaagcgatggcatggagccgccggatgctcggcaccacccagcgcattctggtagaagggacttcacgtaagagcatcatggagctttccggtcgcactgaaaataaccgcgtggtcaacttcgagggcacaccggatatgatcggtaaattcgtcgatgtagaaattaccgacgtctacccgaactctctgcgcggtaaagtggtgcgaactgaagatgaaatgggtctgcgcgtggcagaaacaccggaatcggtgattgcccgtacccgcaaagaaaacgaccttggcgtgggttattatcagccgtaattctcaggcccgccgttccggtgggccttgttttttctctctttatccccatctttatcgcaatgcttgcgcctttttcctgtggcgtgaataatttccttataggccggtgaatgttcagcttccggcggcatacagataagaggaacggtttgaacatagacactcgcgaaatcaccctggagccagcagacaatgcgcgtctgttgagcctgtgcggcccgtttgatgacaacatcaaacaactcgaacgccgtctcggcatcgagatcaatcgccgcgataaccactttaaactgaccggccgtccgatttgcgtcaccgcagcggcagacattctgcgtagcctgtatgtcgatactgccccgatgcgcggtcagattcaggatatcgaaccggaacagatccaccttgcgattaaagaagcgcgggtactggagcaaagcgcggagagcgtgccggagtacggcaaagcagtcaatatcaaaaccaaacgcggcgtaattaagccgcgcacgccaaaccaggcgcagtacatcgccaatattctcgaccatgacattaccttcggcgttggcccggcgggtacgggtaaaacctacctggcagtggctgcggcagttgatgccctggagcgtcaggaaattcgccgtattctgctgactcgtccggcggtcgaagccggtgagaaactgggcttcctgcctggcgatttaagccagaaagtagacccgtatctgcgcccgctgtacgacgcgctgtttgaaatgctgggctttgagaaagtcgagaaactgattgagcgcaacgttattgaagtcgcaccgctggcctatatgcgtggtcgtacgctgaacgacgcgtttatcattcttgatgagagccagaacaccaccatcgaacagatgaagatgttcctgacccgtatcggttttaactcaaaagcggttatcaccggcgacgtcacacagatcgacctgccgcgtaataccaagtctggtttgcgtcatgccatcgaagtgctggctgatgtcgaagagatcagctttaacttcttccacagcgaagacgtggttcgtcacccggtggtggcgcgtatcgttaacgcctatgaagcctgggaagaagccgaacaaaaacgtaaagcggcgctggcagcagaacgcaagcgcgaagaacaggaacaaaaatgagtcaggtgatcctcgatttacaactggcatgtgaagataattccgggttaccggaagagagccagtttcagacatggctgaatgcggtgatcccgcagtttcaggaagaatcggaagtgacgattcgcgtggtcgataccgccgaaagccacagtctgaatctgacctatcgcggtaaggataagccgaccaacgtgctctccttcccgtttgaagtaccgcctggcatggaaatgtcgctactgggcgatctggttatctgccgtcaggtggttgagaaggaagctcaggagcaaggcaaaccactggaggcgcactgggcgcatatggtggtgcacggcagtctgcatttgttaggttacgatcacatcgaagacgacgaagcagaagaaatggaagccctcgaaacagagattatgcttgctctgggctatgaggatccgtacattgccgagaaagaataatttgccaggcatttgactggcagacgtccccgccgttggtgattaacgacggcgttttgattaactaacatgagaacccatacgacgccatgagcgacgacaattcacacagtagtgacacgataagcaacaagaagggatttttctccctgttactcagccaacttttccacggtgaaccaaaaaaccgtgacgaactgctggcgctgatccgtgattccgggcagaacgaccttatcgacgaagatacgcgcgatatgctcgaaggggtgatggacatcgcagaccaacgcgtccgcgacatcatgatcccccgctcccagatgattaccctgaaacgcaaccagacgctggacgaatgccttgatgtcatcatcgagtccgcccactcacgtttcccggtgattagcgaagacaaagatcacattgaagggattctgatggcgaaagacttgctgccgtttatgcgcagcgatgctgaagccttcagcatggacaaagtgttacgtcaggcggttgtcgttcctgaaagtaagcgcgtagaccggatgctgaaagagtttcgctctcagcgttaccacatggcgatcgtcattgacgaattcggtggggtttccggtctggtgaccattgaagacatcctggaactgattgttggtgagattgaagacgagtatgacgaagaagatgatatcgacttccgtcagctgagtcgtcatacctggaccgtgcgcgcactggcttctattgaagacttcaacgaagcgttcggcacccactttagcgatgaagaggttgacactatcggtggtctggtgatgcaggcatttgggcatcttccggcgcgtggcgaaaccatcgacatcgacggttaccagttcaaagtggcgatggccgacagtcggcgtattattcaggttcatgtcaaaatcccggatgactcaccccagccgaagctggatgaataaaaccgaaactggatagataactacatggcttttgcctcattaattgaacgccagcgcattcgcctgctgctggcgttattattcggtgcctgcggaacgctggccttctctccttacgacgtctggcctgcggcgattatttcgctgatggggcttcaggcgttgacctttaaccgtcgtccactccagtctgccgctattggcttttgctggggatttggtctctttggcagcggtattaactgggtctatgtcagcatcgcgacctttggtggaatgcctggcccggttaacgtcttcctggtggtgctgctggcggcgtatttgtcgctgtataccggactgtttgctggcgtgctgtcgcggttgtggtcaaaaaccacctggctgcgcgtggcgattgccgcccctgctctctggcaaatgaccgagtttctgcgcggttgggtgctgactggcttcccgtggttacagttcggctatagccagattgatggcccgttaaaagggctggcaccgataatgggcgtggaagccattaacttcctgctgatgatggttagcggcctgctggcactggcgttggtcaaacgcaactggcgtccgctggtggtggccgtcgtgctgtttgcccttcccttcccgctgcgttacatccagtggtttaccccgcaaccggagaaaaccattcaggtttcgatggttcagggcgatattccgcaatcgctgaaatgggacgaaggccagcttcttaatacgctgaagatttactacaacgcaacggcaccgctgatgggcaaatcatcgttgattatctggccggagtcggcgataaccgatctggaaattaatcagcaaccgttcctcaaagcactggacggtgagttgcgcgataaaggtagctcgctggtaaccgggattgttgacgcacgtctcaataagcagaaccgctacgatacctacaacaccatcatcacgctgggtaaaggtgcgccgtacagctacgaatcagccgatcgctataacaaaaaccatctggtgccgtttggcgagtttgtcccgctggagtcgattctgcgtccgttagcaccgttctttgatctgccgatgtcgtcgttcagccgtgggccatatatccaaccaccgctgtcggtaaatggtattgagcttactgcggctatttgctacgagatcattctcggcgagcaagtgcgcgataacttccgcccggataccgactatctgctgactatctccaacgatgcgtggtttggtaagtctattggtccatggcagcacttccagatggcgcgaatgcgtgcgctggagctggcgcgcccactgttgcgcagcaccaacaacggcattacggcggtgattggcccgcagggtgagattcaggcgatgatcccgcagttcacccgcgaggtgttgaccactaacgtgacaccaaccaccggactcacaccgtacgcacgaaccggcaactggccgctgtgggtgctgacggcgctgtttggttttgccgctgtactgatgagtctgcgtcagcgacgtaaacgttgatgtgaatgatgcgcgacgcttatcaggcctacgcgatttttacaatatgttgaattttcgcgattttgtaggataaagcgtactttttcaacacgctctggggcatgattatcatgcccttttttcttacggttcagggatacaagccacatcgccatattggggatgccgaataattgcctgcggatcaagcgagcgcgtcctgtccatttggattaacctgttcttcgccataacaaatatctttctatcatccgctgaaaaacgaagatgattcacgtagctggcgggataaacgccaataatctgcccggcattaatattgagcaggatgacataaccttgcaggccatatgacaccaacgctaaatactgaccgtccgggctaataccctcaacggaataaacgctcctgctacaccattgcgtcataatgctggcttgttgatcctcagctcttatacgtgaaatcccctggctatcggcaaaaataatctcaccattttttggtcggaatcccatcgcagaaacgacaccacgcgcattacctgcgggaaagtcttctttctgatgcgtgatggtattgatccgcacgatgttacctctgcctgctcccggaaccagtaatgttttttcatccggggaaagtgccataacccaggcgcctggtttaccgctcatccccgtcccgtcgtatttctccagcgggatatccgccacatgctgataagccaccagatcaatcgctgacacactattactggtgcgattcatcacccaggcttttgtgccatcacgcgagaggataaagctgtcaggatgtgcgccggtggtaatcgactgaataatctcccccgtcgccacgttaatgaccgataacgcattcgcttcaaatgaagtcgcataaatcaacttttcatccaggcttaatgccagcgatctgacgccctgatctttacagccaccacaatgtttgactgacttttctttcgctatgggcgctgtaaaggtatgcaggattttcttttgtccgaggtcgaaaacaacaatactgttcgtgttttcaattgcggcatacaacgtattaccatcccgactgatcgccatatcatggatatcggcaatctcagcgagtaaatcaccactggcctgctcacgacttaccggagcggataatgtttccctgagggcgttgcgctcctccactaactgctgctttttttgtcgtcgctcttgttcaatctcctgcggataaaacgcttcacgcaggctttgcccgacctgtaaaactgattcatcaatctgctgctgcacaaaccagatagtcccggtcagaagaagagtgaccgcaacaataatcccgccttccgtaacgagccgattttgcccaactaaacgcgcactcagccaacccaacgcgccccccgcaatcaggccgccaatgtggcaagcgttatctattcctgtttgccgggtaccatacaacagtgtcagcgccaccatacccaacagaggaaatactcgccgctggtttttatggtgtgtgcccgcacctgaagcaagctgtgttgctatcgcagcgcccgctattcccataattgccccggatgccccaatgctgatgactatctgctcactttcgcgtaacgtataacaggcgctgatcagcccaccaaagatgccggagaataaccagataatcaggagtcgccatttccccagtatccgttccgccactgtccccaccaccaggagtgcaaacatattcatcagcaaatgggaaaaactactgtgcagaaaaacactgctcaataagcgccaggattcatccgacaacgtgagagaagcaacgttagcgccgagatggatgagtgcggattgatcgacttcttcgtaactcatccattgtgcgaggtaacaaaatatcccaacacagagcgcaaaaaggatcagggttattgcgggtaattgaacatttaacggcttaaccgaagatgcagacataaggtgattcttccttgaaaagactagtaaaaagcattttcccgagtgtagttatcatcccggcaaacgtcccacaccgaaaagttaacactgtccgaaatatgactttttcaaactgaaattacaatcgtaattaattcacccctaagtattttttggcatgtaagttgctttatttactgtgtaagcaatgaaatcagccgcaacgcaaccgggttgcaccaccacaaatcagcggtagcaccaaaaaggtgcggtttaagaattttgcttcggaatggtgcggcgcacctcgcaaaaataaacaataaaacagcaatatctttacatttatccaaactaaatgttacctaacaaacacaacactgcacaataaagtcgcagatgataacaacacaaacactcacaacgggtatccatgcgtttttaacgcagaagataaaggagttggatatgcaattacgtaaacctgccacagcaatcctggccctggcgctttccgcaggactggcacaggcagatgacgccgccccggcagcaggcagcacgctggacaaaatcgccaaaaacggcgtgattgtcgtcggtcaccgtgaatcttcagtacctttctcttattacgacaatcagcaaaaagtggtgggctactcgcaggattactccaacgccattgttgaagcagtgaaaaagaaactcaacaaaccagacttacaggtgaaattgattccgatcacctcacaaaaccgtattccactgctgcaaaacggcactttcgattttgaatgcggttctaccaccaacaatgccgaacgccaaaaacaggcggctttctctgacactattttcgtggtcggtacgcgcctgctgaccaaaaagggcggcgatatcaaagattttgccgacctgaaaggcaaagccgtagtcgtcacttccggcactacctctgaagttttgctcaacaaactgaatgaagagcaaaaaatgaatatgcgcatcatcagcgccaaagatcacggtgactctttccgcaccctggaaagcggtcgtgccgttgcctttatgatggatgatgccctgctggccggtgaacgtgcgaaagcgaagaaaccagacaactgggaaatcgtcggcaagccgcagtctcaggaagcctacggttgcatgttgcgtaaagacgatccgcagttcaaaaagctgatggatgacactatcgctcaggtgcagacctccggtgaagcggaaaaatggtttgataaatggttcaaaaacccaattccgccgaaaaacctgaacatgaatttcgaactgtcagacgaaatgaaagcactgttcaaagaaccgaatgacaaggcactgaactaattacaagaaccaggggcggaaattccagccctctcgattgttacgtagcacggacagactatacgcctggtggtcgttccccatcgggcctgaaaaccgcaatacgctgggtaacaatcttcgagggtagcagttaacgctgctaccctcttttttctggagtagatttatgtctatagactggaactggggtatttttttacaacaagccccgttcggcaacaccacctatcttggttggatctggagtggttttcaggtgacgatcgctttgtcgatctgcgcctggattatcgctttcctcgtcggttcatttttcggcattttacgtaccgttccaaaccgttttctctccggtctgggtacgttgtatgtcgaactgttccgcaacgtgccgttgattgtgcaattctttacctggtacctggtgatcccggagctgctgccagagaaaatcggcatgtggtttaaggcagagctggatcccaatattcagtttttcctttcatccatgctctgcctggggctgtttaccgccgcccgtgtttgcgaacaggtacgcgcagctattcagtcgctgccgcgtgggcaaaaaaatgccgcgctggcgatgggtctgacgctaccgcaggcctaccgctacgtactgctgcctaatgcttatcgcgttatcgtcccgccgatgacctcagagatgatgaacctggtgaaaaactccgccatcgcctcgactatcggtctggtggatatggcggcgcaggcgggtaaattgctcgattactcggcccacgcctgggagtcgtttaccgccattacgctggcgtatgtattgattaacgcttttatcatgctggtgatgacgctggttgaacgtaaagttcgcctgcccggcaacatggggggcaaataatgtacgagtttgactggagttccattgttccttccctgccatatctgctcgacgggctggtgatcacgctgaaaatcaccgtcacggcagtggtgattggtattttgtggggcaccatgctggcggtgatgcgcttgtccagctttgcgcccgtagcgtggtttgccaaagcctacgttaacgtattccgctcgattcctttagttatggttttgctgtggttttacctgatcgtaccgggttttctgcaaaacgtgctgggattatcacccaaaaatgatatccgtttaatttcggcgatggtggcgttttcgatgtttgaagcggcctactattcagagattatccgtgctggtattcaaagtatttctcgtggtcagtcgagcgccgcgctggcgttgggaatgactcactggcagtcgatgaaactgattattctgccgcaggcgttccgcgcgatggtgccgctgttgctcactcagggcatcgtactgtttcaggatacctcactggtgtatgtgttatctctggccgatttcttccgtaccgcctcaaccattggtgagcgtgatggtacgcaggttgagatgatcctgtttgccggatttgtttatttcgttattagccttagcgcgtcgttgttggtcagctacttgaaaagaaggacagcataatgattaccctgaaaaatgtttcaaaatggtatggtcactttcaggtgctgaccgactgctcaaccgaagtgaaaaaaggcgaagtggtggtggtttgcggcccgtctggttcaggcaaatcaacgctgattaaaaccgtcaacggcctcgaaccggtgcagcaaggtgaaatcaccgtcgatggcatcgtggttaacgacaagaaaaccgatctggcgaaactgcgttcccgcgtcgggatggtgtttcagcatttcgagctgttcccccatctgtcgattatcgaaaacctgaccctggcgcaggtgaaagtgcttaaacgcaataaagcgccggctcgtgaaaaagcattgaaattgctggagcgcgtcgggctttccgcacatgccaataagtttccggcgcagctttccggcggccagcagcagcgtgtggcgatcgctcgcgcattgtgcatggatcctattgccatgctgttcgacgaaccaacgtcggcgctggatccggagatgatcaacgaagtgctggacgtgatggtcgaactggcgaacgaaggaatgacgatgatggtggtgacccacgaaatgggctttgcccgtaaagtggcgaatcgggtgatctttatggacgagggtaaaattgtcgaagactcgccgaaagacgctttcttcgatgatccgaaatcggaccgcgcaaaagacttcctcgcaaaaatcctgcattaatcactctggcgcgcatactcaattgcgcgccatctcacgctttctcgtttcgtccctcgtatctgttacatcccggcgttacccttgtcgcaaagaaacacacaacaaggagcaacaatggcactgccaattctgttagattgcgacccaggtcatgacgacgctatcgcaatcgttctcgccctcgcctcaccagagcttgatgtcaaagcaattacgtcttccgccggaaaccagacaccagaaaaaaccttacgcaatgttctgcgtatgctgaccttgcttaatcgcaccgatattccggtagcaagcggtgcggtaaaaccgttaatgcgtaatttgattattgcggacaacgtgcacggcgaaagcggtctcgacggcccggcattaccggaaccgacgttcgcaccgcaaaactgtacggcggtggagctgatggcgaaaacgctgcgtgaaagtgaggaacctgtcaccattgtttctaccggaccgcaaactaacgttgccttgctgctcaatagccacccggaactgcatagcaaaattgcccgtatcgtgattatgggcggcgcaatggggcttggtaactggacgcctgcggctgaatttaatatttacgttgacccggaagcggcagaaattgtcttccagtcaggaattccggtggtgatggccggtctggatgttactcacaaagcacaaatccacgttgaagacactgagcgtttccgcgcgattggcaaccctgtttcaaccattgttgccgaactgctggatttcttcctcgaatatcataaagacgaaaaatggggctttgtcggcgcaccactgcatgacccatgcaccatcgcctggctgttgaaaccggagttgtttaccactgttgagcgctgggttggcgtggaaacacaagggaaatatacccagggtatgacggttgttgattattattatctgactggcaataaaccgaatgccaccgtaatggtcgatgttgatcgtcagggctttgttgatttactggctgatcgtctgaaattttacgcttaatcactcgccggatgacatcacgccatccggcgccactcatttcattacggctcgaacgggcgtctctggaactgatcatgaccacatttcgggcatagcgtcagcacttccggtgtatagatcgggagatggaagtgacatttctcgcagaccagatttcccagccctaccacttctccgctgtgataaaccccgtgatgattgaggtcctggaaaacttcgcgccattcaagctgcgttttatcggtgatgtctgccagctcctgccacaagctttctttaatcacccgcataaagacgctgtcagactcttctttcaggctctcttcatagctcatggcgaactcttccaggtcacgtctgacagctcgcgtcagctcatcgacctcggttcgcgttaactcccctgtttttattacgcgctcgcgcgcctgttccaccagtgcgtcgatatcacgttcgccattgcgcaggcgttcgctcaatgacgcgaccagttcacggtaatattgagcaaccttgttcatcgtttcatctcccgggtcgttaactgactataataatagacgttctttgttccttgctttgctaatacgcccacaaactctgtaaattaatgtatgaataatccgggcatcatttcaacgtcgagtgcgcgaaaggctgttttgacgcgggcgtttgggctatgctatgcggatctgaaaaaccacatcaacgctacatttgtagccgtattgaaaacaggaccactggctgccatgcaagagcaataccgcccggaagagatagaatccaaagtacagcttcactgggatgagaagcgcacatttgaagtaaccgaagacgagagcaaagagaagtattactgcctgtctatgcttccctatccttctggtcgactacacatgggccacgttcgcaactacaccatcggtgacgtgatcgcccgctaccagcgtatgctgggcaaaaacgtcctgcagccaatcggctgggacgcatttggtctgcctgcggaaggcgcggcggtgaaaaacaacaccgcgccagcaccgtggacgtacgacaacatcgcgtatatgaaaaaccagctcaaaatgctgggctttggttatgactggagccgcgagctggcgacctgtacgccggaatactaccgttgggaacagaaattcttcaccgaactgtataaaaaaggcctggtatataagaagacttctgcggtcaactggtgcccgaacgaccagaccgtactggcgaacgaacaagttatcgacggctgctgctggcgctgcgataccaaagttgagcgtaaagagatcccgcagtggtttatcaaaatcactgcttacgctgacgagctgctcaacgatctggataaactggatcactggccagacaccgttaaaacaatgcagcgtaactggatcggtcgttccgaaggcgtggaaatcaccttcaacgttaaggactatgacaacacgctgaccgtttacactacccgcccggacacctttatgggttgtacctacctggcggtggctgcgggtcatccgctggcacagaaagcggcggaaaataatcctgaactggccgcctttattgacgaatgccgtaacaccaaagttgccgaagctgaaatggcgacgatggagaaaaaaggcgtcgatactggctttaaagcggttcacccattaacgggcgaagaaattcccgtttgggcagcaaacttcgtattgatggaatacggcacgggcgcagttatggcggttccgggtcacgaccagcgcgactacgagtttgcctctaaatacggcctgaacatcaaaccggttatcctggcagctgacggctctgagccagatctttctcagcaagccctgactgaaaaaggcgtgctgttcaactctggcgagtttaatggtcttgaccatgaagcggccttcaacgccattgccgacaaactgactgaaatgggcgttggcgagcgtaaagtgaactaccgcctgcgcgactggggtgtttctcgtcagcgttactggggcgcgccgattccgatggtgacgctggaagacggtaccgtaatgccgaccccggacgaccagctgccggtgatcctgccggaagatgtggtgatggacggcattaccagcccgattaaagcagatccggaatgggcaaaaactaccgttaacggtatgccagcactgcgtgaaaccgacactttcgacacctttatggagtcctcctggtactatgcgcgctacacttgcccggagtacaaagaaggtatgctggattccaaagcggctaactactggctgccggtggatatttacattggtggtatcgaacacgccattatgcacctgctctacttccgcttcttccacaaactgatgcgtgatgcaggcatggtgaactctgacgaaccagcgaaacagttgctgtgtcagggtatggtgctggcagatgccttctactatgttggtgaaaacggcgaacgtaactgggtttccccggttgatgctatcgttgaacgtgacgagaaaggccgtatcgtgaaagcgaaagatgcggcaggccatgaactggtttataccggcatgagcaaaatgtccaagtcgaagaacaacggtatcgacccgcaggtgatggttgaacgttacggcgcggacaccgttcgtctgtttatgatgtttgcttctccggctgatatgactctcgaatggcaggagtccggcgtggaaggggctaaccgcttcctgaaacgtgtctggaaactggtgtacgagcatacagcaaaaggtgatgttgcggcactgaacgtcgatgcgctgactgaagatcagaaagcgctgcgtcgcgatgtgcataaaactatcgctaaagtaaccgatgatatcggccgtcgtcagaccttcaacaccgcaattgcggcgattatggagctgatgaacaaactggcgaaagcaccgaccgatggcgagcaggatcgcgccctgatgcaggaagcgctgctggcggtagtccgtatgcttaacccgttcaccccgcacatctgcttcacgctgtggcaggaactgaaaggcgaaggcgatatcgacaacgcgccgtggccggttgctgacgaaaaagcgatggtggaagactccacgctggtcgtggtgcaggttaacggtaaagtccgtgcaaaaatcaccgttccggtggacgcaacggaagaacaggttcgcgaacgtgctggccaggaacatctggtagcaaaatatcttgatggcgttactgtacgtaaagtgatttacgtaccaggtaaactcctcaatctggtcgttggctaagcgcgggaggaagcgtgcgatatctggcaacattgttgttatctctggcggtgttaatcaccgccgggtgtggctggcatctgcgtgacaccacgcaggttccttccactatgaaagtcatgatcctggactcaggcgatccgaacgggccattaagccgtgcggtgcgtaatcagttacgtctgaatggtgtcgagttgcttgataaagaaaccacgcgtaaggacgttccatccctgcgtttgggtaaagtgagcatcgcgaaagataccgcatcggtattccgtaacggtcaaacagcagagtatcagatgatcatgacggtgaatgcgaccgtgttgatccccggccgtgatatctacccgattagcgccaaagtcttccgttcgttcttcgataacccgcaaatggcgttagcgaaagataacgaacaagacatgatcgtaaaagagatgtacgaccgtgctgccgaacagctgattcgtaagctgccaagcatccgtgctgcggatattcgttccgacgaagaacagacgtcgaccacaacggatactccggcaacgcctgcacgcgtctccaccacgctgggtaactgatgattcggttgtacccggaacaactccgcgcgcagctcaatgaagggctgcgcgcggcgtatcttttacttggtaacgatcctctgttattgcaggaaagccaggacgctgttcgtcaggtcgctgcggcgcaagggttcgaagaacaccacactttttccattgatcccaacaccgactggaatgcgattttttcgttatgccaggccatgagcctgtttgccagtcgacaaacgctattgctgttgttacccgaaaacggaccgaatgcggcgatcaatgaacaacttctcacactcaccggacttctgcatgacgacctgctgttgatcgtccgcggtaataaattaagcaaagcgcaagaaaatgccgcctggtttactgctcttgcgaatcgcagcgtgcaggtgacctgtcagacaccggagcaggctcagctgccccgctgggttgctgcgcgcgcaaaacagctcaacttagaactggatgacgctgcaaatcaggtgctctgctactgttatgaaggtaacctgctggcgctggcccaggcactggagcgtttatcgctactctggccggacggcaaactgacattaccgcgcgttgaacaggcggtgaatgatgccgcgcatttcaccccttttcattgggttgatgctttgttgatgggaaaaagtaagcgcgcgttgcatattcttcagcaactgcgtctggaaggcagcgaaccggttattttgttgcgcacattacaacgtgaactgttgttactggttaacctgaaacgccagtctgcccatacgccactgcgtgcgttgtttgataagcatcgggtatggcagaaccgcaggggcatgatgagcgaggcgttaaatcgcttaagccagtcgcagttacgtcaggccgtgcaactcctgacacgaacggaactcaccctcaaacaagattacggtcagtcagtgtgggcagagcttgaagggttatctcttctgttgtgccataaacccctggcggacgtatttatcgacggttgatatgaaatctttacaggctctgtttggcggcacctttgatccggtgcactatggtcatcttaaacccgtggaaacgctggcgaatttgattggtctgacgcgggtcacaatcatccctaataatgttcctccgcatcgtccccagccggaagcaaacagcatgcagcgtaaacacatgcttgaactggcgattgccgacaagccattatttactcttgatgaacgcgagctaaagcgcaatgccccctcttacactgcgcaaacactgaaagagtggcggcaggagcaaggaccggacgtgccgctggcgtttattattggtcaggattcattgctgacctttccgacctggtacgaatacgaaacgatactcgacaatgcacatttgatcgtctgtcggcgtcctggttacccacttgaaatggcacaaccacaatatcagcaatggctggaggatcatttgacacataacccggaagatcttcaccttcagcctgccggtaaaatttatctggctgaaacgccgtggtttaacatctcggcgaccatcatccgcgaacgtttgcaaaatggtgaatcgtgtgaggatttattaccggaaccggtactgacttacattaaccaacaaggcttgtatcgctgatacctgtcgttacggagggcatgatgcgactgtggttaattcgtcatggtgaaacgcaagcgaatgtcgatggtctgtacagcggtcatgcgcccacacccctgaccgcgcgcggtattgagcaagcgcaaaatctgcatacgctgctacatgatgtttcctttgacctggttttatgcagtgaactggaacgggcacagcataccgcgcgactggttcttagtgaccgccagcaccccgttcatatcatccctgaactcaatgaaatgttttttggcgactgggagatgcgacatcatcgtgacctcatgcaagaagatgccgaaaactatagcgcgtggtgcaatgactggcagcatgctatccccacgaacggtgaaggatttcaggcattttcgcaacgtgtggaacgatttatcgcaaggcttagtgaatatcagcactatcagaatattttagtcgtcagccatcagggcgtactgagtctgttaattgctcgtttaattggcatgcctgccgagtctatgtggcatttccgcgttgaccaggggtgttggagcgccattgatatcaaccaaaaattcgcgacgctacgcgtcctcaatagccgtgccatcggggtcgagaatgcatgacttttctgtttttttacgggtaagccgcaacgaccattgacagccccgggcaggctgatattctccgcagccagactttttccgccagacacgactttgtagaaattgttttacaaaaatggcgatgcaatctgcggcgcggggtgggatgatagcccactttcgaaagccgattcggcgacaattgtcccgaaatcgcctctggttcaggtatactgacagaccatttttatctatttgattcacccagggggaaaacttgcagggtaaagcactccaggattttgttatcgacaaaattgatgacctcaaaggtcaggacatcatcgccttagacgttcagggcaaatccagcatcaccgactgcatgatcatctgtacgggtacgtccagccgccatgttatgtccattgctgatcacgttgtgcaggagtctcgcgcagcgggcctgttaccgctcggcgtagaaggtgaaaacagcgccgactggattgtcgtggatttgggcgatgtgattgtccatgtcatgcaggaagagagccgtcgcctgtatgaactggaaaaactctggagttaatgcgtgaagctgcaacttgtcgccgtgggaacgaaaatgccggactgggtacaaaccggttttaccgagtacctgcgtcgttttccgaaagatatgcccttcgagctgattgaaattccggccggaaaacgcggcaagaatgcggacatcaagcgcatactcgacaaagagggtgagcagatgttggcggccgcaggcaaaaaccgcattgtcaccctcgatattccaggcaagccctgggatacgccgcagttagccgctgagctggaacgctggaagctggatggtcgcgacgtcagtctactgattggcgggcctgaagggttgtcgcctgcctgtaaagcggcggcggagcagagctggtcgctgtcggcacttacccttccccatccgctggttcgcgtgctggtcgcagagagtctgtaccgggcgtggagcatcaccaccaaccatccttatcaccgtgagtgataagtgagctttgagtagaaaacgcagcggatgaaactacagaactcttttcgcgactatacggcagagtccgcgctgtttgtgcgccgggcgctggtcgcctttttggggattttgctgctgaccggcgtgcttatcgccaacctgtataatctgcaaattgttcgctttaccgactaccagacccgctctaatgaaaaccgcattaagctggtgcctatcgcacccagccgcggcattatctacgaccgtaacggtatccctctggctctcaaccgcactatctaccagatagaaatgatgccggagaaagtcgataacgtgcagcaaacgctggacgctttgcgcagcgtggttgatctgaccgatgatgatattgcggcattccgaaaagagcgcgcacgttcacaccgtttcacctctattccggtgaaaactaacctgaccgaagtacaagtagctcgctttgccgtcaaccagtaccgttttccgggtgttgaagttaaaggctataaacgtcgttactatccttacggttcggcgttgacccacgtcatcggctatgtgtcgaaaatcaacgataaagacgtcgaacgcctgaataatgacggcaaactggccaactatgcggcaacgcatgatatcggtaagctgggcattgaacgttactatgaagacgtgctgcacggtcagaccggttatgaagaggttgaagttaacaaccgtgggcgtgttatccgccagttaaaagaagtaccaccgcaagccggacacgatatttacctgacgctggatctcaaactccagcaatatattgaaacgctgctggcgggtagccgcgcagctgtggtagtcaccgatccgcgtacaggtggggtgttggcgctggtttccacgcctagttatgacccaaacctgtttgttgacggtatctccagcaa

SEQ ID NO: 10043 - DNA, 20994 bp, Escherichia coli
actatcgcaatgcacgtcctggctatctggagcacttctgggcgctggtgaactgggaattcgtagcgaaaaatctcgctgcataataactgatggcaaatgcaacattatctgatgcgcttcgcttaccatgccaacgcggatgaggcgttaacagcgcattcggcaagataaatcgcacgttgccagcaactgtaacgcagaaggttatccttctgcgtttttgtttaattagctgttggcaacgcaaactgtttcaggttgttttctgactgacataaacaccagcaataatgccagtcccgcgacaatcgcccccatcaccggcacaaaactgtatcccagcccagcggaaattaccgcaccaccagcagctgctcccagcgcatttccaagattaaaggcaccaatattgactgatgaagacagacctggcgcttcactggcgacacgcatcacgcgcatctgtaacggcggtacgaccgcaaaggttgcagctccccacactaccatgctaatagctgcgccgaactcattgcgggccaggaacgggattaccagcataatcaccatcagcaacaacaaaaagcctttcaacgtgccgttaactgaacgatctgccagtttgccgccgagatagttaccgatagaaaatccgacaccaatcagcaccagcattgccgtgacgaacaccggcgttacgtgggtaatactttgcagtaccggagagatataggtgtagagggtaaacattgcaccagcgcccagtaccgtcgtcagcaatgcagacagcacctgcggacgcattaataccgccagctcttttttcacttcaggtcgcgcccctgcgccacctttaggtaatgagaagaacagacttaccattgaaatcacgcccagccccgctgttgccagaaatgacatccgccagccgatggtttcgcccaaccaggtcgccgccggcacgccaccgatatttgccagggttaaccccataaacatagtggcaactgcgctagcctgtttatgttttggcactacgcttgcggccacgactgaacccaaaccaaaaaatgccccgtgattcaggctggtcaaaatgcgtgaaagcatcagggtcatataatccggcgcgatggcggaaagtacgttgccaagcgtgaaaatcgccatcaggaaaatcaacgcactgcggcgggcacgatgagaaagtagaagcgtcatcagcggcgcgccaaccattacgccaactgcataagcactgattaacattccggcagcgggaatcgagacatccacaccgcgcgcaatgacgggcaacaagcccattggcgagaactccgttgtcccgataccaaacgcgccaatcgccagcgccagcaacggatagttaattttcatgccttatctccacctcttagcgtcattacgcgatattcattaaagtggcgaaagcatgacagtaatcacaaaaaaatgaaaataacaaaaagagaaaacacttttgccattttgctaacaaacaggaaggagatgcgagggagaacgcgctccctcgagaggaaatcagtgcagcgcggcagtcaaacccacggccacgatcaaaccgaggacgataatcgttgttaccagtgaaaatttaaggtcggtgctcatcaagttttctccttttttattaccacacaaaaagtgatattacgcatttttacacactgtgatgaaaaaatctcccgtcatttataatgataagtgtttttactacttccccttttcgtcaagatcggccaaaattccacgcttacattatttgcgtactggccattgaccccttcctgacgctccgtgtcgtttttccggcgtaccgcaacatttttgttgtgcgtaaggtgtgtaaaggcaaacgtttaccttgcgaatttgcaggagctgaagttagggtctggagtgaaatggaatggcaacaataaaagatgtagcgaaacgagcaaacgtttccactacaactgtgtcacacgtgatcaacaaaacacgtttcgtcgctgaagaaacgcgcaatgccgtgtgggcagcaatcaaagaattacactactcccctagcgcggtggcgcgtagcctgaaggttaaccacaccaagtctatcggtttgctggcgaccagcagcgaagcggcctattttgccgagatcattgaagcggtcgaaaaaaattgcttccagaaaggttacaccctgattctgggcaatgcgtggaacaatcttgagaaacagcgggcttatctgtcgatgatggcgcaaaaacgcgtcgatggtctgctggtgatgtgttctgagtacccagagccgttgctggcgatgctggaagagtatcgccatatcccaatggtggtgatggactggggtgaagcaaaagctgacttcaccgatgcggtcattgataacgcattcgaaggcggctacatggccgggcgttatctgattgaacgcggtcatcgcgaaatcggcgttatccctggcccgctggaacgtaacaccggcgcaggccgccttgccggttttatgaaggcgatggaagaagcgatgatcaaagtgccggaaagctggattgtgcagggtgactttgaacctgaatccggttatcgcgccatgcagcaaatcctgtcgcagtcgcatcgccctactgccgtcttctgtggtggcgatatcatggcaatgggcgcactttgtgctgctgatgaaatgggtctgcgcgtgccgcaggatgtttcgctgatcggttatgataacgtgcgcaacgcccgctattttacgccggcgctgaccacgatccatcagccaaaagattcgctgggcgaaacagcgttcaacatgctgttggatcgtatcgtcaacaaacgtgaagaaccgcagtccattgaagtgcatccgcggttgattgaacgccgctccgtggctgacggcccgttccgcgactatcgtcgttaatcacccgttgcgggagtctcttccggctcccgcagccactccttattcagcgtctcactatcgccgagatactcaagcaaccaggttaacgcaggcgacatatcattttgctgccatgtcagacaacatgccgaatccgggaagggattttccagttctagtgctacccacttcccctcattaagccacggtttggcgaaatgtgttggcaccatccctatgcataatcctgccgagatacaggttgccgatgattcccagtcaggcacgacaagtcttttttggttatccagcaaccaggtaatacgtttaggtagcgttcgcgaggtgtcttcgcgcaccaatgacggccagttgcgcaacgtatcatcgctgaacgggccatccatcaacgccagcgggtggtggctggcaacaacgcaactccagcttaacatccccatatcccggaaggcataacgaccgcctaccggaatcgcgcgtgttgcgccaatcgccagttccacgcgcccgtcggaaagtgcatcccagacaccgttgaacacttcctgaaagacaagaagttcgacatcatcaaaatggcgataaaaatcaacgatcatctgccgtgttcgctctggcctgacaatattatccactgcgatagctaactgaccgcgccagccgttcgctatctgctgacattgctggcgggtgatctgcatttttttgacaacagagcgtccttctttgagaaaccacgccccggcagcggtcagttccacatcacggtgacgtcgttcaaaaagcggcaccgccagccactcttccagctgacgcacggtatagctgaccgcagaagggacgcgatgcaactcctgggctgcggcgctaaaactaccattacgcgctaccgcatcaacaacttccagagaatattctgaccacatagtctgcctgcaaaatttttgaaaccaatcatcaaatattaccgtttcacaacactaatttcactccctacactttgcggcggtgtttaattgagagatttagagaaaatacatgcaacctgggaaaagatttttagtctggctggcgggtttgagcgtactcggttttctggcaaccgatatgtatctgcctgctttcgccgccatacaggccgacctgcaaacgcctgcgtctgctgtcagtgccagccttagtctgttccttgccggttttgccgcagcccagcttctgtgggggccactctccgaccgttatggtcgtaaaccggtgttattcatcggcctgacaatttttgcgttaggtagtctggggatgctgtgggtagaaaacgccgccacgctgctgatattgcgttttgtacaggctgtgggtgtctgcgccgcggcggttatctggcaagcattagtgacagattattatccttcacagaaagttaaccgtatttttgcgaccatcatgccgctggtgggtctgtctccggcactggctcctctgttaggaagctggctgctggtccatttttcctggcaggcgattttcgccaccctgtttgccattaccgtggtgctgattctgcctattttctggctcaaacccacgacgaaggcccgtaacaatagtcaggatggtctgacctttaccgacctgctacgttctaaaacctatcgcggcaacgtgctgatatacgcggcctgttcagccagtttttttgcatggctgaccggttcaccgttcatccttagtgaaatgggttacagcccggcagttattggtttaagttacgtcccgcaaactatcgcgtttctgattggtggttatggctgtcgcgccgcgctgcagaaatggcaaggcaagcagttattaccgtggttgctggtactgtttgctgtcagcgtcattgcgacctgggctgcgggcttcattagccatgtgtcgctggtcgaaatcctgatcccattctgtgtgatggcgattgccaacggtgcgatctacccgattgttgtcgcccaagcgctgcgtcccttcccacatgcaaccggtcgcgccgcagcgttgcagaacactctgcaactgggtctgtgcttcctcgcaagtctggtagtttcctggcttatcagtatcagcacgccattgctcaccaccaccagcatgatgttatcaacagtagtgctggtcgctctgggttacatgatgcaacgttgtgaagaagttggctgccagaatcatggcaatgccgaagtcgctcatagcgaatcacactgatctatatcgatatacttatacttaggctgctaacaaaattttgttgtatgattgaaattagcggcctatactaatttcgagttgttaaaactacgataaatattatgttattacggggacaggatcgttcccgactcactatggatggtcatttcggcaagggttcctcctttccctctgttctacgtcggattatagactcgcggttttttctgcgagatttctcacaaagcccaaaaagcgtctacgctgttttaaggttctgatcaccgaccagtgatggagaaactatgagttcatcgtgtatagaagaagtcagtgtaccggatgacaactggtaccgtatcgccaacgaattacttagccgtgccggtatagccattaacggttctgccccggcggatattcgtgtcaaaaaccccgatttttttaaacgcgttctgcaggaaggatcgttggggttaggcgaaagttatatggatggctggtgggaatgtgaccgactggatatgttttttagcaaagtcttacgcgcaggtctcgagaaccaactcccccatcatttcaaagacacgctgcgtattgccggcgctcgtctcttcaatctgcagagtaaaaaacgtgcctggatagtcggcaaagagcattacgatttgggtaatgacttgttcagccgcatgcttgatcccttcatgcaatattcctgcgcttactggaaagatgccgataatctggaatctgcccagcaggcgaagctcaaaatgatttgtgaaaaattgcagttaaaaccagggatgcgcgtactggatattggctgcggctggggcggactggcgcactacatggcatctaattatgacgtaagcgtggttggcgtcaccatttctgccgaacagcaaaaaatggctcaggaacgctgtgaaggcctggatgtcaccattttgctgcaagattatcgtgacctgaacgaccagtttgatcgtattgtttctgtggggatgttcgagcacgtcggaccgaaaaattacgatacctattttgcggtggtggatcgtaatttgaaaccggaaggcatattcctgctccatactatcggttcgaaaaaaaccgatctgaatgttgatccctggattaataaatatatttttccgaacggttgcctgccctctgtacgccagattgctcagtccagcgaaccccactttgtgatggaagactggcataacttcggtgctgattacgatactacgttgatggcgtggtatgaacgattcctcgccgcatggccagaaattgcggataactacagtgaacgctttaaacggatgtttacctattatctgaatgcctgtgcaggtgctttccgcgcccgtgatattcagctctggcaggtcgtgttctcacgcggtgttgaaaacggccttcgagtggctcgctaaaggctattctatcgccccctctccgggggcgatttcagatcaggcttctgtacctggttgattcatggcattttctcgtgccgccagcactcgttctaccgtatctaccactgcctgagtttgtggatcgatttcaatgttgacgcgtgcgccaagttttttcttcccaagagtcgtgcgttccagtgtttccggaattaaatggacgcaaaagcgcgttggcgtgacttcgccgacggtcaggctaataccgtcgatgccaataaatcctttgtacaggatatatttcatcaactgactatcctggactttaaaccagatctggcgattattttccgaggttaatattttcgcgacttcagcggtggtcataatatgacctgacattaagtgtccgccaatttcatcgctgaatttcgccgcacgctcaacgtttacccaatcccccacttttaaatcgccaagattagtaatgcgtaacgtttctttcatcaggtcaaaactgacatggttgccgttaatttccgtcacggtcaggcagcaaccgttatgcgccacggacgcaccggtttccagtccgtccagcatgtggtcgggtaactccaccacatgcgtacgaaaatttggtttttcgtcaatagacaccagttttgcggtgccctgtacaatccccgtaaacatacttacaactcctgaaatcagttaagacattctgttcagcacaatagcaggtggaaaacgcccttaccagtgaaggggcaagaatggctattttttcactggagaattaataaatcctcgctacaatagactgaatttcccctgcttcttctttttgctgcccattcaggcggctttttagtctctcatataactacaaataaaaggtgttcacgtgcagaagtatatcagtgaagcgcgtctgttattagcattagcaatcccggtgattctcgcgcaaatcgcccaaactgcgatgggttttgtcgataccgtgatggcgggcggctatagtgccaccgacatggcggcggtcgctatcggtacttctatctggcttccggcgatcctctttggtcacggactgctgctggcattaacgccggttatcgcgcaattaaatggttccggtcgacgtgagcgcattgcgcatcaggtgcgacaaggtttctggctggcgggttttgtttccgttctcattatgctggtgctgtggaatgcgggttacattatccgttccatgcaaaacatcgatccggctctggcggacaaagccgtgggttatctgcgtgcgttgttgtggggcgcgccgggctatctgttcttccaggttgcccgtaaccagtgtgaaggtctggcaaaaaccaagccgggtatggtaatgggctttatcggcctgctggtgaacattccggtgaactatatctttatttatggtcatttcggtatgcctgagctcggtggcgttggttgtggcgtggctactgcggcggtgtattgggtcatgttccttgccatggtttcttacattaaacgcgcccgctccatgcgcgatattcgtaacgaaaaaggcaccgctaagcccgatcctgcggttatgaaacgactgattcaactcggtttgccgattgcgctggcactgttctttgaagtgacactgtttgccgtcgtggctctgttagtgtctccgctcggtattgttgatgtcgcaggacaccagattgccctgaactttagttcactgatgtttgtgcttcccatgtcgctggcggcagcggtaactatccgcgtaggttatcgtctgggtcagggctcaacgctggatgcgcaaaccgctgcgcggaccgggcttatggtgggtgtctgtatggcaaccctgacggccattttcacggtttcactgcgggagcaaatcgccctgttgtacaacgacaatcccgaggttgtaacgctggctgcgcatttgatgttgctggcggcggtatatcagatttctgactctatccaggtgattggcagtgggattttgcgtggttataaagatacacgttccattttctatatcacctttacggcttactgggtgctgggcttgccaagcggctatattctggcactgaccgatctggtcgttgaacctatggggccagcaggcttctggataggctttattattggcctgacgtcggcagccattatgatgatgctgcgtatgcggttcctgcaacgtctgccgtcagccatcattctgcaacgagcagctcgctagtaaagacaaggcgcaaccttcacgggttgcgcctgtgtttttacgcaggctggagcgttgcgccaatcccgtcttcgtctggctgtagtttcagtgcgttacacagagtttgccgactggcatctgttatctcaacgtgtatatcaccagtaacttcccctttcacattgatgaagtcaggtgaaatttctttcgcactggtttgcaggcaaatcgctccctctccgcgcaggcgtttcactttcagttgcacatgcgttgccgcaccagtgattagccacagttttccgccattgagattgatgttaccaacactgaaagtgacactatcaccttttaccgtactgccgtcgagaatcaatacaccgccctgctgtacagtaatcgttgattgttgcagatctgcgccatagccaataatcattgaagcgccgtccagtaatgcaacactaccggtcagttcaaccggtgcgcgatcttcctctacgacaaaattttcgtccgcgctggtgggtgacaacaggatcactgtcccaccttgtattaccgcattttccagcgtaccggcatgcacttcagcccgaccacccacattaacggacaggttttgcgtcttaccggaactgtagagctgaagaccatccgtacccagacgatagatggctccattctcaacaatagtgtcagagtcttcaccaccgagattattcatggtgccaccagcaagcaacgtatcattggctttccccgccagcataaaaacgccgccctgattaatctcacaattgctggcttccccacctggatacaccaacaattcaccaccttcatctaccacgaccgctgaggttgtcccattgaccaacaggccaccctcttgatcgagaataattttttccgcgcgatgtccttccagtacacgcaggttaccgccattttccagcaacaaaccgcaggcataaccctgatcaacgctgaattcaccttcgggatggcggccattaaccgtagcgagcgtagagagactaattgcgcctccctcggactgaacaatatctgtggcaatggcaccgtcgctgaccgatagcgtgccattgttaccgtactgtgtgcatttggcgatcccaccggttgccactttcaaccagccagcccccgtgaccacggtattttcggctcttgcgccagcttcaactattaactcaccttcagtaagttgcgtcgcgccaatgacctcgccggtcttaacaatttgcacgttcccgtcgctcatcaagtttttcgcatcagatcccatgatttattcctttgctgcatctgtgtgcctttattgctacctaagtgtaaaggctacggaggatttatccacgacagattttgagatggtggcaaacaactctgtttaaactctgatacacagattattgggttgtgtcagatgtaaatgcgatcctgaataaaaatcgcccttgcaaatcaacaaaatatagccaatttgcttaaaagctctgcaaacggtcgaaatagcgcagaaaaatacgttttgcctcttgccaccttcccactctgccgctaatattcgtccccgttgtcacctacaacgttgcgttcatagctcagttggttagagcaccaccttgacatggtgggggtcgttggttcgagtccaattgaacgcaccatcctgcgtccgtagctcagttggttagagcaccaccttgacatggtgggggtcggtggttcgagtccactcggacgcaccagattttcttaatctggtcttctcctttttccctctgtttcttctctgtatccaatacgttaaaagatttacactgtcttcgtatgcgttatcagaaggagaatcgctatggcaactttgttacaacttcattttgcttttaatggcccatttggcgacgcaatggctgagcagcttaaaccgcttgctgagtcgattaatcaggaacctggttttctgtggaaggtatggacagaaagtgaaaagaaccacgaagccggtgggatctacctttttattaatgaaaaaagcgcccttgcctatctggaaaaacatactgcccgactgaaaaatctcggcgttgaggaagtagtcgccaaagttttcgacgtcaatgagccacttagtcaaatcaatcaggcaaaactcgcctgacagaatttaatcaagggcggttagcgccctttttatccctgtctgaaatttctcaaattctaaaaatctcaaccaaacttatctgataacactaaattcgaaagaatgcgtacaggtaagtaacaatgaaaaaaattgctattgtgggtgccgggcctacggggatctacaccttattctcgcttctacagcaacaaacgccactttctatttctatcttcgagcaggctgacgaagccggtgtcgggatgccatacagtgatgatgaaaactcaaaactgatgctggcaaacattgccagtattgaaataccgccgatttattgcacgtatctcgaatggctacaaaagcaagaagccagccatctccagcgttatggcgttaaaaaagaaaccttgcacgatcgtcagtttttaccgcgaattctgctgggcgaatatttccgcgatcaatttttacgattagtagaccaggcacgacagcaaaaatttgcagtggctgtttatgaatcatgccaggttaccgatctgcaaattacaaatgctggcgtcatgatcgctacaaatcaggatttacccagcgagacgtttgatttagcggtgattgccacgggtcacgtctggcctgatgaagaagaagcaaccagaacgtattttcccagcccgtggtcaggcctgatggaagcaaaggtcgatgcgtgtaacgtgggtattatgggaacatccttgagcggactggatgcggcaatggcagtggctattcagcatggttcgttcattgaagatgataaacaacacgtcatttttcaccgcgataacgcaagtgaaaagctaaatattacgttaatgtcgcgcacaggtattttacccgaagccgatttctattgccctattccctacgagcccttacacatcgtcactgatcaagcattaaatgctgagattcaaaaaggcgaagagggccttttggatcgggtatttagattgatagtagaggaaatcaaatttgctgatccagactggagccaacgcatagccttagaaagcctgaatgtcgattcctttgctcaagcctggtttgccgagcgcaaacaacgcgacccattcgactgggcagaaaaaaatctccaggaggtcgaacgcaataaacgagaaaatcatactgttccctggcgttatgtcattctgcgcctgcatgaagccgtacaggaaattgttcctcatctgaatgaacacgaccataaacggttcagtaaaggccttgcccgggttttcatcgataattatgcggcaatcccttcagagtctattcgtcgactactggccttacgtgaagcgggaatcattcatattctcgccctcggtgaagactacgaaatggaaattaatgagtcgcgcaccgtcctgaaaacggaagacaatagctactcgtttgacgtttttattgatgcccgtgggcagcgtccgcttaaagtgaaagatattcctttccctagactacgcgaacaattacagaaaacaggggatgaaatccctgatgttggcgaagattatacgttacagcaacccgaagatattcgtgggcgcgtagcgttcggcgcgttgccctggttgatgcacgaccagcctttcgttcagggacttacggcatgtgcagaaattggagaggcgatggctcgggcggtcgtaaaacctgcatcccgtgcgcgtcggcgtctttcgtttgattaaaggtaaagctatcagcactcaacaaactgatgttgttcattaagacgatagcggactccggctcgaatattgttttcaccttcaatggcgacggcgaagcgaactctttcgccgtcatgatatgcgagtgcggcgcatccccctggcccgagaataattgagtcgaccacgcccgtgctcactactgttgaattttcaccgctggcaatgatgtgtacattgtcgccgcagttggcaattctggcgtttgcgccaaagctggcgatttgcaccaggtcaccattactggcgacatgacaccgttcacccaatgtacaaacgcgtactcgcattccggtattcgcaatccgactgctatctccagcgctgcttatccgcgaagaattaccggttacagcaacccgtgcgcgtgcaccggagctgccaatgtgactgttaaagccgacacttccaatccgcacgctataacccatactggcaatttgcgcggcatacccagcggttgcgattctggcgttatcctcacaacagccgatgcgagcatgatcgtcgctgcgggcaaactgactgcaaaatagtcgttctccgggatctgtggccagtttttgcatagaagaaacttcctgatgcgcgaagttttcatccgccagccattttttccacgcatactcaaccagactctccgcccagtccgtatatccttcctcaatcagtgcatgatgaatatcggcataactaccgccacgtgggaaatggcgcagaaaccagcgatacatcaccgctccgatacgccattctcgcaggtctgctcgtgtaatgatcattcgttagtgccggtgatagccatcgaccatgcttttaaaggtttcgtgtggcgtacgccccgtggtgcaaagataaagatgaccgaagataaaaaagaggcttataaatgccagagcaaaatgcgcctgcaataaccagtatcttacgccaggaaacacatctcccacggcttgcggatagagacacagcagccccgtcaatagtaacaacggcagcaatccatacatgacaccaacataggcaacctgctgtaagggattaaatttagactgggttgttgccgggaaaggatgttcttccccctgcataatgccaaacaaatagaatcgcgtttgttttgccgctcgctccagccacccctgacgacgaatgcgatagtggtgaccattacccccaacggcattgatcagaacaaagccgagccagcatgccagtaacaaaaatccgcaaacttcatgcaccgcaaccagacttttaaccgcagttgcgcccaccagcgcaaagtgatttatcagcccacttgccagcaacaatacaaagagtaacgcattcgaccagtgccataatctgaccgctttgctgtaaagataaaccttctcaccatggtcggtggctgatttcttcacgccacgagcacgaagcaaggcatgcagccccagcaccaaccacatccctaccagcaatagtccggcaatgatcaaccacaccggccaaaattggggagtgaacagtggcacatagttcgccaactggctctgaaactgttcagcatgttgcgacgggttcatacattttcctttttaatcaaatgttgaccgaaccggcgatacaggtgcggtttcccggcaccaggtagctgatattgatagtatttattttcctgcaaccacgcctgaatttctgggctatcttcgcgaccaaagatcaatgcgtgttccggacaggcgctgacgcaaatgggcggaaagccttttgccagtcgggactcagcgcagaaatcacatttatctgccactttagtgacagggttaaggtagcgaacctggtaaggacaagcgccaatgcaataactgcagccgatgcactgcgatttttctacccgtacgatcccctgctcatcacgccacgatgccgctgtcggacaaacgtcgatgcacggagcatcttcgcagtgctgacatgactggcgaaaaaagtgatactgcgtttcgttgtcgttatcggtgactggaatgtgtgctatcgataaacggcttccctgagcggggacgtggttagttttacggcatgcgcgggcgcaaatattacagccattgcaccgtgactcgtcatgaatcatggcataccgaacttccttttcttgcctcgtgttcgctaacagagaagacgcagaaccagtaaaaaagattactgttcccatccccagaacaaatttgcgtcgagtgaaggacatctgattatcccctaatgcagtggctgctactgtccaccctatccatgacatctccctgaaatttcaggggttctgaaactgctctacctcgaaccattcgcataagccatacgccttgccataggtcataaatcgctcgctaaacaagtacaacaccgccgtcgatgactccacctgccgtatatcggcatattcaggtgcaacatccatcgcggcgatcgcggcttcaatctgcgcttcctggaagtaatatggcgcttgcatcagcatggcgactttgtaaggacgaggatacgtctggcactcaaaacgaacggcgtgtgcaatagcgcgacaaatgtcctgctccacaacttgcaaagacatcgccgcgtagttttcactcatggcctgcgttgagtaatagtaatcatcctggcttcccgtcaaacaagcgatatccgcgtggtctccgttctgcttaatgttttccagcaaaactgacagttcctcttctgcaaccgaatagggcggcgagagaaacacggcgcgcgccaccagctgcccagccgcagaatgctgacgaatgaactctgccaggatttcagcaggttctggttcggttaccgtatcaacggggtgacgcatcccctgcaaccattgccgcttcgcctcatcaacttcgctgactttcgctaacggcaattcatcctgatggttcatctcacccattccttacgcaggcagtagattgtgtgctgccagatcggcggcaatatcttccagccccagacgctgcaatgtttcacgggtcggacaaccaagctgtgggtcccagcccatttctttgtagaacatcgtgagcgaagcatgcatatcgtcacgatccattttgtcagtaccttcagtaaagaccgggatctgcggatccttatcgaatacccaggaacagataagatcgtgctcattacgcatatctttagtttgcatcagttttaccgtgtaggcgcgatgcaacgtaaagatacgctctgcagctaaatctaatttttcctgagtcatatcttcgccagtgatcgctttgaagaatttggcttcaagcgccagatcgccccgataattacggcttttcagcggcgaaacggtcattggccagacccagttgcacagggtgacggcgttatgcaaacagacccgcaacagcgaccacttagcatatttaatttttgcgtcattgattggcgtgtagtttttggtttcatcgtaagcatcttcagaaccaaaaagttctttcgccacttcacgttgcagtttcaatggcaagccggaaccaataaagttgatatgggtatgcgtcatgcagtcacggttgaacatacagttaacaatggagccgacctgcgctgacgcttcattggcgtggtgaactggatagccaaacggcgaccagagtttatttttcgcgtagccccagtactcttcacccaaattccagcgttctgcgatggcatatgaaccatcagccaggtgactcagctcacccacgcgatgcgccagacggtagtaaaaatctttaatgaagttaacgtcacccgcttccagttgatcccagcgaatttccgcatactcttcagcaggcagaacacgcttgaacacccctttgctgtaacaataggtaaagtcgcgatgaagctgaccatagttacaccataggccgtagtcatcgaacagattcagaccaaccaggttaccaatcacacgaccatcatctttatcttcaaaatctttcggaccgttcgggaagatggtggtatggacaaagtttgctacacaagtgttaccacctgtgctgggcacgccaaactctttcacccgaggaatattcatttgggtcatacaacggatcgggcaagagtggcagccactcatttttactgtgtatttctctgccgccggacctaagtcaaaaacggatttataggtacgaaagccgaccgtgttctgattgcctggcggaatctcacccgtttcaatcggaccaccttcagccgcgccccaaaacaaccctttacgtgcagtccaacgtgacttgggatctgaatactctgcccacgattgcggcgtacttggcacgacatggttgttattcgcaccgataagttcagtcatcatgtaatcgttgagacgcttcatctcctgacgatcggcaatgttgacccctttcgtcccttcaaccgcaatcgctttcaggtttttcgaacccattattgcgccagttcccgcaccaccgctgtggttacggctattcaacatgccagagagaggaacaaggttttccccagcctgaccaatagccgccacacaggtttcagggctggtcaatcgacaaatctcttccgtcgttgcgcgcgtcccttttccccataagaaatcggctttttccaggctaactttgtcatctttaatattcagccataccggtgatttcgctttcccttcgataataatgacgtcgtatccagcgaatttcatttgcgctgcaaaaaagccccccatatgggcatcgacgactaaatttcctttggtaaaagtagaaagtgaggtgatatttacgcgagaactacagggggcaccagatccagttaatgggccggtagcaaagactaatttaatttattcgcttcatcgaaaggtttcgtgcctggcggtacttcgtcatacataattttgtagccgaagcccatgccaccgacaaaacttttaaacttactggaatcttcgagggtaatatttcctgtcgtgagattgactcttaatatattacctgtccaaccgttagccatgattttttcctttgcaagattcacacagtaatatctttccactcgataatttttaacgcccctgttgggcaggcgtttgcgcattcaccgcataacacacatttcgaggattttttactttcggtatttacggtggccatcatccacgggcacgccgtagtacaggcgctacagccaatacaacgtttatgatcgacggtaatacagccttcttcctgttgccaggtaatcgcaccaatcgggcagacattcatgcattgcggttctttgcattgacggcaggtgtccgcggtatagttgagatcgccatacaggccgccaccagagccaaccccgttatcgccaaagaaataattgcgatggattttgatacgggagaagaatgtccctactgagccatcgttgaagttggtacaagagatttcacagcggtggcaacccgtgcatcgcgcacgatgggtcaccagcacccctttgggtgtatttatcaagcctactgtgccgctatcaatatcttcctgtttgcaacccaaaagtgacagtaacgcaggggcaattgttaaaccagcaaggccttttcctgatatacgcaagaattctaatcgcgttaagccaatatttaatagtggacgatcaaccgggttcatttatttcgcatcctcttcgcaaacacagtgctgacaattcagcagcctgatattaggcactcaactaatacgctgctgactctgtcctcaacaccagatattttccctaacccaatagtgtatgagaaaagatttaacgctgataaactaatcctttatggttaggagaaaaaataatgtgattattctgggctcttaacattgatcgttatcaattaaaatcacaaagcaagaaattataagtgaagtgatatttattatcatttgaaataaatttaacttaaccgacaattatttgtgaagttcatcgcagaaaataaaaataactttatcgctataaattaaaatacacaccgaaattcgtataatttcagcagttgttatttagaatgattaactggaccgcaactgaagcaagaatatcaggatgaagcttaccgcctcatcctgaatggtcattttaccagtgcgttaatgacggtttccatcgcctgcttttccagctcactgcgctgaatgcgtttattggctaatgctgtacgtaatacgcctgcgataacaatatgctttggttcctgccccagatcgcgcatttccagcacaactttaccgacaactctgcacatttctcggtacagttcatcctcttttgtccgatttcccattctttatacctatttatcatgccaactatcagcatatatcaatctaaccaattaaacaaaaatcaaacaaaatcagataaataacgcgataaattattttaactgtagcaattgagcgatgatgtatttatacaccggatgaactttcacttatcttcacagtgacacccccggcacaagacgttgcgcaaacagcgaagtttttgcgtaaccttttccctggaacgttaaatctttgataacaatttattgtctaacaagttgtatattttttgaaacgctgtttttgttttccttttggattaatttcagcgtataatgcgcgccaattgactcttgaatggtttcagcactttggactgtagaactcaacgactcaaaaacaggcactcacgttgggctgagacacaagcacacattcctctgcacgctttttcgatgtcacctatccttagagcgaggcacaaccactttcgtaataccggattcgctttccggcagtgcgcccagaaagcaagtttctcccatccttctcaacttaaagactaagactgtcatgaaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccagaaatccgcaccatgaaactggaaggcggtaacgacgtttctctgaaagcgggtcagacctttactttcactactgataaatctgttatcggcaacagcgaaatggttgcggtaacgtatgaaggtttcactactgacctgtctgttggcaacaccgtactggttgacgacggtctgatcggtatggaagttaccgccattgaaggtaacaaagttatctgtaaagtgctgaacaacggcgacctgggcgaaaacaaaggtgtgaacctgcctggcgtttccattgccctgccagcactggctgaaaaagacaaacaggacctgatctttggttgcgaacaaggcgtagactttgttgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagtcgttatcactgcgacccagatgctggattccatgatcaaaaacccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgtattaccgaagcggtatgccgtggtgccgttgaaactgctgaaaaactggatgctccactgatcgtggttgctactcagggcggtaaatctgctcgcgcagtacgtaaatactcccggatg

SEQ ID NO: 10044 - DNA, 18412 bp, Escherichia coli
gacatttgttggcgaaatctttgcagctttgctgattctccctcatcatttgaaatgtggtttcactttctgcaattaaggtcggctttgaatatctcctctgctttacgccaggttgttcacggcactcgctggcactctaaacgcaagagctacaaagtgttgttctggcgcgagataaccccgcttgctgttcctatcttcatggagaacgcctgtgtcctgttgatgggggtcctgagcacttttctggtcagctggctgggaaaagatgcgatggccggcgtggggttggcggacagcttcaatatggtcattatggctttttttgcagctatcgatcttggtactactgtcgttgtagcatttagtctcggtaagcgagatcgacgacgagcgagggtggcgacgcggcagtcattggtgatcatgacgttgtttgccgtactgttggcaacgctaattcatcattttggcgaacaaattattgatttcgtcgcgggtgatgccacgacagacgttaaagcactggcgttgacttatctggagctgaccgtactcagttatccagcagctgccatcactcttattggtagcggggcacttcgtggtgcagggaatacgaaaataccgctactgattaacggtagcctgaatattcttaatattattattagcggcatattgatttacggccttttctcctggccgggactgggatttgtcggggctgggttgggtttaaccatttctcgttatattggcgcagttgcaattttgtgggtgctggcgattggttttaatcctgcgctaaggatttcgttaaagagctattttaaaccgctgaattttagcattatctgggaagtcatggggattggtattccagcgagtgtcgaatcagtgttatttaccagtggtcggttattaacccaaatgttcgttgccgggatggggaccagcgttattgccggaaattttatcgcgttctcaattgcggctcttatcaacttacccggaagtgcgctcggttctgcttctacgatcattacaggccgaaggttgggggtagggcagatagcgcaagcagagattcagttgcggcatgtgttctggctgtccactcttggattaacggccatcgcctggctaacggctccctttgccggggttatggcatcgttttacacccaggatccacaggttaaacacgtcgttgtgattctgatttggctaaatgctttatttatgcctatttggtccgcctcatgggtgctacccgctggatttaaaggtgctcgtgatgcccgttacgccatgtgggtttcgatgttgagcatgtggggttgtcgggttgtagtcggttatgtgctgggaatcatgcttggctggggtgtggttggcgtctggatgggaatgtttgccgactgggctgtgcgggccgtgctgttttactggcgaatggttactggacgttggctatggaaataccctcgatccgagccgcaaaagtgtgaaaaaaagccagttgtatcggaataaacgacaaaatgcagattatttcagcaaacgatttcaaatttaaaaaacaggctttgacattgtgggtgggcatcgctaatattcgcctcgttctcacgattcctctgtagttcagtcggtagaacggcggactgttaatccgtatgtcactggttcgagtccagtcagaggagccaatttcctgctttcatgcatccttgcgaatccttatgttatttttattcaacaggttagcgtgaaaactcttcccggtgcattttgattttaccctctgcatcgggaaaaattggtagtcaaatctggggtcaggttagttcgataatggagtgacccccatatgtcccttaacgacgcaaaaatccgtagtctcaagcccactgataaaccctttaaagtctccgattcccacggtctgtatctgctggtcaaaccaggcggttcccgtctctggtatcttaaataccgtattaatggcaaagaatcccgtattgcactgggtgcctaccctgccgtctccctgtctgacgcccgccagcagcgcgaaggcatccgtaagatgctggcgctgaacatcaacccggcgcagcaacgtgccgctgaacgcggctcgcgcatgcaggagaaaatgtttaaatccgtggcactggagtggcacagtagcaagaaaaaatggtcgcagaataccgcagatcgcgtgcttgcccgtctgaacagacatgtctttccgaccatcgggcatctaccagttaccgagcttaaatcacgtcatttcattgaattactgaaaggcattgaggaaaagggcttgcttgaagttgcgtcccgctcgcggcaacacctcagcaacattatgcgttatgctgttcatcaggggttaatcgaaatcaacccagctgcaaatcttgacggcgtgacggcttctcccgccagacgacattatcccaccctgccactggagcgccttcctgagctgcttgaacggattgacagttatcaccaaggacgggaactcaccaggcttgcagtcctgctgacgttgcatgtgttcattcgctcaagtgaactgcgctatgctcgttggacagagattaacttcagaaatcggatctggacgatacctgccacacgcgaagcgattgcaggcgtacgttattccagtcgaggtgccaaaatgcgtacaccgcatattgtgcccctttctgagcaggttatctctattctgaaaaggattaaggaaatatctggcgggtatgaactggtgttccccggctatcatgacccctacaagccgatgagtgaaaatactatcaataaggcacttcgccagatgggatacaacacgaaacaagatatctgcggtcatggtttccgggcaatggcgtgtagcgcgctgatggaatccggtttatggtcgcaagatgcagtggagcgtcagatgagtcaccaagagcgcaacactgtgcgtctggcttacattcataaggccgaacatatggaagcccgcatggacatgatgcagtggtggtcggattatctggatatgtgcagtgaaatctgggtgcccccgtacatctggagtcagcaaaacattaatctcgcagtaacctgacttatgaataatcttgtaaagaaccaggccgtatcagcaaacgctgatacggcttttcatccacaggccgtttttcatcttctaagtcgtccaggacatcatggttcttaatacacatgcgttcgcatgtgcttatgttaagtagacttattgtcttacacattttatccgtatcattaaccagaatatgttccggagcagcgggtgatagtgccgccagtccacactcatcgctgcccggaaaaatcatcagtggggaggcaaacggtaagcaccccgctattctgcaagacatttctgcagtttatttaacctccccgaagcatttttataaggcgaggcggtattaaattgaatcatacgacctcgggtccatttattataccaagggtttaccgtaaagctcgtcgttactgaatcgttcaatcaaagccacgagttgctgcttattttcctttaaccgtgccaataaaacttcgtactctgtaatatcctcatagtcacggtagaatttctgtgctaaacgccccaattcattccatttaaatccttcctcaggaaaaataatagtttttccttttgcctcttggtcatgccagtgtaacaccagctctccccagccaatcagataggaaaccagattcgctacgctaatcgtagtccccttcgcgtgcccttccaatagaggttcaaaggcgagttggggcgtaatagattctagcttcttatttaataaagaaaaattactattaatagctttaattaactcttcttttgatgatggaacagccatatctattgctccttgtatagttacacaactatttctaccctactatttcgagtgattcaatcgtctggttcacataacctaccacctgttcaaaatgcttatcgacaaaaaaatgatcggcagcaggaaatataatagtccgcgtctttcgtgtggtgaatttttcccatgcaagtaattcatcctgcattaccagattgtcagcatcgccatgaaatagcacgatcggacaggttaatgtgcgcgccttggcctgaaatacatactgctcatagagccgataatcgtttttaatgatgggggtgaaaattgtcattaactctttattacgaaagacatcaaccggagttccgcccagcttgacgatctcttccataaacgcctgatcgggcaaggtatgcagtattacttcatgagaggcccgatcgggtgggcgacagccggaaaaaaacagcgcgcatggcatgtcatgtccatgatcgagaatataatgcaccagttcgaaggccatgatccctccgagactatgcccaaaaatggcgtagtctccacctgtgtagtgtttcacaaattgttgataaaggtcagcgacggcatccaccatcgtaagacacagcggctggcgtattctagttcccctccccgcaggttctaaaggccgcaaagtaatattgtccgacagcacgctacgccatttataatacatggcggcagaaccacctgaatatggcaaacaatacaaactgatattactcatcgtcccactccttgttgtgtaatagaattcgtttaatttgatgatttaatgtcagaacgaaagctaacaggataattccgaacggtatcgccaacacgctcgatggaccccataccaagataaaacgccagtcaagtcctggagatagtatacccggtgcgacatagagcatggcggccacgagcccaggaaccgccaaggcgatgatatagtcacgtacgcgtaaacgtaacctctgctgttttccagggccatgcgccgttgcgcgataaacacggaaagcaccgcgcactacaaccaccgccccccaaaaacacagcaacaacgtgaggtagacgaaaagggtatcggtggctgtaattgcatcaccagcgccgtcagcatatttgccaatgcgcagataattatcgatatccgcgcaaagctgtagtatcagattcgaattcatatttgccagcgcaacaatgccaatctgctgatccggtcgcaacgcaatgcaagaagaaaagtttggattctgcccaccgtgactgatgtaagggccttgattctggtcgataaaccaaccgctggcatagaggatacgattgtctgcggcaagcggaacatcactattaccacgccaactgttactcatcgcctcacgcagcgttgccggcaaagcctttctgtgcaaccaggcgtctatccatatttccatatcaggcagagtgctatggatataggcggcaggaacatggttccgggccagaggcgcatgaaacagaacgggtttgccgaatcccagtttatagccgcttgccttgttgacaataatctcatcccccttaactgccacagtcgccgacatgcccagcggctgcgtgagtcgttccgcaatgacctctgtaaaggtttttcccgtcacattttcaatcaccgcgcccaacacatcataattggcggaggcatagctaaacttcgcacccggcgcaaacagcagattctcgttgcgcagttgctgtgccacagcgctcccaggcatagggttttccagccgagccagtgttgaaaaaggcaatcctgatgtatgataaaggaaatcagccacggtcagggaagcaggttttccctgataattcaagcgcatttccggcagataggtaatgatatcatccccttgccggagtctgccttcctgaatcagtatttgcaccacaagtccggtaaacgccttactcatcgatcccagctcgtaaactgtgtctagagtattcgctttctgactagccacatcggcaacaccgtagacaaatcgctgacgtacccccttaatggtcacacttacggaaagggctgggaccttggcctcctgcatccgttggtgaattaatgtcgacaggcgctcatcttgcgccccgataggctcatgttcttgcgccaaagcgcacatagcggaaataaagagcagcatacagcacaggagatgatataatgttttaatgctaacgtgttccattattgtcatcctgtgaacacctcataaaataccatcaacacattcggagataaattcactgtgctcacggatagcgggtctggcataaatatcggcggcagtcagtccgattttataaatgtggttacagctgtcgacgaaagagataacgtgcatcgaggtcgctccgtattcgaaaataaccgcgtgttcgtcataatgatcgatgcataacaatgaacgccaggttttctccacaaagtcgctgaccgacaaataactcactggtaacatagcgttctctctcgcatcactggactgaatttcataccggacgcgatcaaacgaataaccgggtaagcctatagtctgcacggctggcatttccggtaaacaaatagtcactcctcgttgccaaagagtgcccaacagcggcaggatgtcctcaggcgtatccgtattcagcatgggggaaaatactgtttgcccaacccactgcgcatgctggtgatacaatatggaaaacgtccccgcgcgaccgatttccagcatcagcgttccctccgtcaccgccagattagccaatatttcgctcagttcactgttgccggccagcgtctgctccggtgtcgtttcagccacaatcacctgctgaacagcgttttccagtgagatgatgcgcgcaacatactgcgctgctgcagcccccgtcaggtaaccgatgtgctgcacaggcgagatactttgttcgatcagccattcactaagactcacctgctggataaactgacgcaatgctggcgtccaatcggctggttcgcagatttgtgcaacatcctgagacaggcgctggtgccgctggcgcaagttaggttgacaagccagcaaatgcgtcagggcactctccagcttatcgtcccggtccggatataggaacaccaaggtagtttccatattgataggggtaaaagacatgtcagcatcccgcagtttcgccaaacttgcacgcaacgctaccacactgtctgccgccagcgcacagcgatacgggaaatgtgcccggcgttgcgcgagagtataggcgatacgatctttatctgcttccgcataggtcgccagagcgtgataatgagcatccaactgttgtctaagggctaatggcgttttggcgctgaagaaaaacaggcggcgctcattttcttgcaccgcttgcgcaggcgtctcgcaccagttttgcagaaccaaatgagcattggtccctcccagcccaaacgaactaacggtggcatggatccttttcgtttgtgggacagaagtcactacatcactgagataaaatggcgaggctggctgcaacagttttttatgtttatttactaggttgatctgcgggggaactaaaccagtatatagcgtcagtgcggttttcattaagctgacgataccggaagcgactcccaggtgacccaagttggcttttaccgcacccaattgaatgctgtgcggcgcacatgccggtgcgaaaacccggtgcagagcttcaagctcaatctcatcacccaacggggtaccggtaccgtgcgtttcgatcagtgcgatatcagtcggtacgacttctgcggcggcaagcgccgtattgatcgcttctacctgtccttctacgctgggggcgacaaaccccagccgacgcccgccgtcgttatttaccgcacctcctttaatcaccgcatacactctgtcttggtcgcgtagtgcatcctcaagacgttttagcaccacaactcccgcaccgctgctgtataccgtgccggtcgcctcagcgctaaacggggcgcagtgtccgtcttgcgataccagcttatcaccttgcggactgtagccgtgcgcctgtaaaaaacccaaggtgaccccacctgccaacgcaacatcggcttgaaaagtcaataacccctcgcatgctaaatatgctgccaccaacgaactggaacaggcggtctgtacactcacagcgggtccggtaaaccccaacttgtaggcaacctgagcacacaagtaatccttttcgttaccaatctgcgcctgaagataatggtgatcgccgctcatcttcaggtatggatagacgcgatcgataaaatagttattggcgtaggtcgccccatagacgccgactcgcttaagttgcgtgggaatatagcccgcatgctcaagagcgttgtagcagcattcaagaaatattcgttgttgcggatccatcaacagggcttcgccaggcggaatattgaaaaatgcagcatcgaagtcatagggagcggtgattatattgcgcagcctaatccaagggttcccattatcgtcttctgtgcatgtcggttgagtgaactcctcacccgccagcaacttatcccaccactcgggcaccgattccgcaccggaaaaacgcccgctcatgccaataatggcaatatccagtgagccacaggtaaaatcatcctttgccattgttgtattccttaagggttggcatcgtgtttatagtgtccacaaagtcggcgcgcccgtcagcgtggcgctgtgttggcacagccaggcatccagatcagtgaggctgttcttgtagcgcgccagcaggagttgcacatcattcagcgcaatgcgcgtgggatcgaaacggcagtggaaggagagaccatcagctgccgagcgcgcaatattaaactccagcacgcagccgagcgcgttttcaggcgcggtatagatatcactattaaagtgatcaatatgaaaatagcggagtgaaggttgcgcctgcacaccgatgtaattcattcggatcccttgcgcaagagagtcttccggtgcatgccgcatttgcagcagaccgtaatctcccccaccatgcgtgcgttttgccaaatcggaagcgatcgcagataacagtgtcgccatatcgccatgcagagggatcgcccaaggataaaatagagtaaaccacccgaccgtatccgcaacgtcaggctcatcgggccagcagccgcgtcccatgccttccatctcgatgcgacaccaaggctcttcgctgtagtaacgcagcaccagcgccaatgccgttagcacataggtttcggcgctgtacgcggtattaccactggattcaaacaacctcctgacgcaaggatggcgaaagtcttcacgccaagcgcgcgtacgaggtaatgagtcatctggcaatgacacgggtgggaaatgcagcggtagcgtttgacatactgtgcgccagctttcgtgtgtggcggaatctaccgttttgctcgccagatagtcattccagcgatgcagtccgctgttgctggtgccattgacagtgctgacggcgtccagcgtgctgaggattaaataccaagagtgcatatcgacgcacaagtgatgggcacagagtaccagcgtgctagacgcaggctgcggggcgtgtaacagagctgccgtaaagactcgaccatttgtcacgtcaagcatgctattgcactgagcgatcacctctgccaacgtccactgcgccgtcgaatattccgtgagcacctcgttgggataacacacattagggtcgcatactagcaaccgcccctcagcgtccagcgcactgtgcaaagctggctgctgctggattaatgtatgcagcctgttgtgtaactgctcgagcgggcagcccggcaacactttcagcacaatgacatggttataaacattgggcactggcaacgccaactgcgtaaaccaacgcaatgcgggtagatcgatacgggtgttatgagcatactgcgcgagctgtgacaccgttgtatgactagcgagaaactcacagatggcgttcactgttccacactccatcacctgcaccgctgacatcgtccagccgtggtgcctgagctgcgctgcaatctggatactcttgatggagtccaaccccaagacataaagattttcgttatcatcaaactcagtttgctccagcgccccttccacacatacccgaactgaatgccttatcgccgcatctcccagccgctcgctacccgatgcaggcgcggtgtttcggaccgttgcgaccatctgacgcacgtccaccttgccattgtgcgatagcggcagttgggcgatagcacagcactgcttgggttgcatgtaggtgggtaattgctgacgcagatgttgcattacggtagctacatcaacagatgacggtgtcacgcaggctagcaacccgctgtgctgcccctgcacatcatcaatcaccgccaccgccgcactttctacctgaggtgcgctcaacaacgcttgttcgatttcgcacagctcaatacgatagccattaattttgacctgatcgtctttacgtccctgataaaccagcgtattaggagcgatggcgtagccaatatcaccgctgcgatagccaatcatcaccccattggtatctttaaggtaggcggcggccgtttgttgcggcgcatcgatatagccctgcgtcactgacgcgccataaatcaccaattcaccagtttcgccttccggtaccggacagccccaaggggagcaaattgctacctggcaaccgtcgatcgccataccgatgggcaatgaaggcagcgtttcttgcccggtgtagcgatagatcatgcaaccaacggtggcctctgtcggcccatattcgttatagatcacggcctgaggaaagagagcagccgccttacgcgccagatcccgcttgaaatcctccccgccaaccaccaaggtacgaatctgctcactgcttatgccagccgcacacaacaaccgcaggtgtgcaggcgtcagtttgatcactgtgttgggctgatcaaccacggccatgcgcagcaatgtttcgctctcggcgtgccgacaaacgctgatgctagcgcccacacataagggggcgaacagcgtagtgatggtcaaatcgaaggacagcgaagagtagagcgcagcccggtcctgcgctgtaaagtaacgttcggcggcgaaatggagatagttagccagattgccatgagagacttgcacgcccttaggctcgccggtcgatccggaggtaaacagcacatatgccagatcctgcggttcaatagctggccaaggttctctagcaagcgccgaagtggctaaggcctggagcaagctggacgcgggaaacgccagcgcctgcgtcaattcatgcatcgccggatcgtaaaggatatgcgctacctgcgctttacgacacatggcgtaaaggcgggtcgttggcaacgcgggatttagcggcagaaatgccgcgccgcagcgcaaaataccataaataaccatcaccgtttgagcgctatgctcagcgataatcccaaccacttgaccgcgtccgatcccctgttggcgcagataacgcgcaacccgctcaacagcgtcatccaactgccgataagtcaaagactgttcattatcaattagtgctgtgcgatcaccatgctccacaacttgcgctgcaaatcgggaagtaaatgagggtttgagtgagccacatgccaatgcgacgtgcggcgcaggatagacttcgagatcgcctagacgagcgtcaggttgccgatccaatgcagtgactaaatccaacagcccatttttcatcgctgtcagttggtgcggagtgaaagcgctacgcagcgcctccagactcaacctaaggctttctttatgattattaacagtttgcaaaacaatctgtagcttataggactgctcgccgctgtagtaactctccacgcgttgcgcggcacctgcaatgtggcgttcataggtaaagttataataattaacgcaataatcgaacgcccgcaacttccctcccccctgttccgccaaatcctggttgaataaggtaatgggatatttgctgtgtttaaaaccgcgtttcagttcgcgctggaaaaaggccacccgttcacagaatcgttccgtgcgcaccagtcgataggccagcggcaattgattagtaaacatgccaaagcaacgccgcgcctcgcgagtatgccgattggctaacggcacgcctattacgcctttttcctccccccatactctggcgcgatagagagcgaagagtgcaataaacagcgtattaagcgtacagccataacgattacacaacctgtagagacggttaatcatggctggctcaagccaagtggaacaactgatgccctcagtagtaacgatgggggaactgtctggaaagcagtcgcggtattcgtcgatatagtcacgccaccagccacgatcaacggcaaagcgcgttgacgcctgataagattgctgctgcgccagaaatgcgctataggctggtgacgcatcatctggtacgtcctgctgttcgtatgctcgcttgacatggtttgacaacaacgccattgaccaaccatcagcaatgccgtgatgggctttaaataaataaccgctgtattgttcaccgcacgtaaaggtgacaaactcgaacaaatcgtgcgccagcagggtaaagggctgccggaaccactcatcaacaaatgtttcgatcgccgctgggcgtaggttctccttgtcataatctggggaaaaagtcaaatggcggatatcgcgccagtgataaggctgcacttggctgaccacttcactctcctctcccatcacaaaccacatacgcaacgcatcaaattgccgaatggcggactggatggccgcgtgtagtcggggcagatcgacaattccctcaatggtgaccacaccaccaatgatgtttacggcactgtaaggatacagttgatcaatgatgtggcactgttcctgtggccacgacaacggattgcccgacatcatggtgccacctccatatccaagtgttgggagcgcaccgcctcctgattccatcgcagcagacgaggtgaaagacgcagcagacgccacgccaacaacgcagccacaaaagtgccgctcatcgccccaaaatagacgccggtaatacgcatctctaacacaatcgccagcaggtatacgacagggacagatataaacacgtgacgcatcagcgtcaacaacaccgaataccaaggcttaccaatggcctgataatattcacttgctaacaggctgatagcgacaaagggtagtgccagtgccatgatacgggtttgcagtaccgcatagtcactcacggcaacaacacgagtaaacaggggatacatccagggtgccagtacaatatgcataacggctaacaccagcacaatagagaaggccagcgcgacggcggcccaataggcattcagcgtgcgggtgacatttccgtgtccccagttttgccccaccacagtcagcaacgcggtcgcgatagccagcatcggcgtgatgatgaaatagtcgatgcgaccagtgagcgtaaacgctgccatcgcgtttacgtccagcctgacgataaaaaaattataaatcactatgccgaccgcaatgatcagttgcatcagcatctgcgccatgccgacggagagaaactctcggtagattttccaggagaatgggcgtaacgcgatgcgtatactcaacccgatatgtaatcccatcaatgtgtagatgaaataggcgaccatactcagttgcgccagaaacgacgccaatgccacccctttcacaccaaaatcgaatacaaagatcatgattggatcgagcataatatttaccaacgcccccaacaatgaggccttcatgatgaccatgatcttacccgcgccttgaaacagccccatcatgacgccaatcaacatgatgctgaacacggtcagcagcgaataataatagaactccgttgcgtagccgatgatgctcttcgtggcccccagtgagcgcaatagcggctgggcataaacatagccaagtacggtgatcacgatcgcaaagaatagcgcgatgatgataccgaccgacaaaatccgctgtgcacgatccaaccgctgcatgccgatggcgcgggacagcaaagatcccataccgatttgaatgccgttggcgatggcaaataaccccattccaacggggaaaaccagccccacaccggcaatgatgccgctgttggtgacatcaatgtggctcagccaaaaaatatcggcgatggcataggtcacctgcgttaacataccgacaaacatcggcaacgccatgcgcaggagtaatttatacagcgagccgtcaaacatacccgccaccgtgaacagctcatcgttcggcgtgccgttgtctggctcaagcttattcaccgtcatacctgctccttattcattaaatgcgccgcacctttattggcgctgtcaccgatatccgcctctagtacccttccggtaccgtgaatccgccactgatgctttcgcagaactcagcaaagttaatcgtcacatcatcgtgaaaatgcccggaaatgatctgtatgccgcacggaagctcatccatcgttttcgccaatgggtaaacggtggcaggcaaaccaaaaaccgttgctaacatgttccagaacaaatgttcgttgtaatcttgcggttcgccattgacgataagcttgcgcttacgcaccggctgctgcatgtgcgcaaacgccagcaccgggctgacaggtgtcaacaacacgtcataacgcgcgaaaagggtttctatcacccggctgtattcgtggcggagtttgtctgtattccgctgttcgccactgtctttcagcatgccctggtaatagctcgttatcccctcaggcacatccgccagcttgcccacaagcctgaagcccagcgcagccagcccggctgtaagacgctggcgtccattgagcgccgtacttaccagccgaccactgagtttgactgctatatcaaacagtgcgtcgggatcgatatcggcgggcatagcatcatcaacctccacgccaggctgtgcgcgtaacttgtcgataaacgattgaaaacgctgtgcgatctgttgatctatctcatggtggggcgcactaaaccacgtgcacacgcggtagtttgctttggcctgataacggctaaaatcgggaatacgcggcggttccacccagaatgtgctcaatgcgcgcatcatcagacgcagatccgccgcgctgcgcgccatggggcccgccgtcgagagatccggctcatcagtcgcttgcggaccaccaccgggcacatgtcctctgaccgacatcaaccccaagctacaacgatgggcatagacacctgtgtagtgtgcgggaatgcgcagtgagccaaacaaatcgctgccaaattccacgggggtgaaatccgccgccaccgccaccgccgctcctccggacgatccgccgggtgaacgttgcctatcccacaggttatgggtggtgccatacagatcgttataggtttgccaatcggcagtcatcatcggcacattggtttttcccatcaggatcgccccggcagcgcgtaagcgtgcgatggaaggagcatcctgcgtcgcccggttatctttcagataatgggcaccggacgtggttaaccacccttgcacgtcaaacgactccttaacagtacaaggtaatccgtgcaacacgccccttgcgcgcccctccagtcgctcacgatcggcgcgcgcggcggcctccaacgccaacgcatagtgctgctgcaccaccgcattcaacggcttgttaaactgcgccatacgtgaaaaatagtgattcaccaacgccactgaggtggtttctccggacgccaactgtgccaacagtgtccctgcgctacgatagctctgctcactcatcgcccttttctccctgttgggcacgtttacgccgcaacgccagattctcgcgcgcagcgctgacctgcgaaacctcagcctgcgctaatacgatatcgtgggcggcgggtagattgtgcagttgctcatcaaggtaacgcgccacatccgcgatggttggcagacggaacagatcgacaatgggaatctcctgcccgataatcgcctcaagtgcctgctgaatacgcaccaattctatagaactgccccccagcgagaagaaatcgtcttcggccgacacgtggctcacgccgagtacctcctgccagagcgccaccagccgctgttgtaacgcactgtccacctggattggacccacgccgtcacgctggtgggcaatttgttcgccctgcagctgtaatttttgccgatctagcttgccgttagcggttaacggaaaatcggtcgctaacatcagatcactcggcaccatatagtcaggcagttgctgacgcaggccgcgcagcatggcatctttgtagctctgcatgtccagcggcgcagcggtttccttcggtttctcataggtggagaaatcgcgcagcaatgctgcagcacttgccgcctcttgccctatcgcgccccccacggtgcaatggacatagcgatgatgtggcgacaattgaaaatgcgatgccacagcggaaaagtctgccatcccaagttggcacagccccaatccgtagcgcggcgcatcttcttccagtaaatggcagagagtacctgcttccatcaccgagaagtgccaagctgcctcttgcccatagaatggcgagatcaccgccatatcagccaccataaacagcgtgaatgccgcccgatcggcaatagactgattaggtccggcatgaaaaccactgttcagctcgacttctggtgctaccggcataagacagctctgtcgcgggtcgaagtagtaaataccggatactccctcttcgatcttgtctggatgcaggtacacgtaggtttgcaccgggtatagccccccggcggacgcataggcatacttggcaaaaggtagaccgggtagacgcatctgccccaagcccgacagcaattgccccaactgtgccagcgtggttttttgcgcgctgaaatgacgatagctgcggcgtttgatgtaacgtgtgctatccgccggtgccgtcagtgcaatgcccagaccatccagcgcgcgaatatgtggctccttgagtttgaacgctagacgctgtgccggattcacaataataccctgcgccagtgccgccgcctccgcttccttagcttgcaatgcctgcgcctggtggcgatcgtgcagtttggcaaaagcgaccagccgacgatgttgagaattacccactgccaccaccactgactgctccacatcgggatgtcgcgcaatgcagcgctcgatttcccccagttcgatacggtaaccattcaccttcacttgggtatcgttgcgccccaaaaaggcgacttgcccgtcagcaaagtagcgcccgcgatccccagtgcggtaaattcgctcaccactcgcttcgcgccagacaaagctcgccgccgttttctctgcgtcgttcaggtagccttgtgccagccccatcccgccaatgcaaatctctccttccaccccgaccggacattcctccagttgcgcatttagcacgtatactggctggttgcgcaggccccgaccgtagggaatactggtccacgtcgattccacctcacctatcgggtagtagaccgaccagatggcgcactcggtcgctccacccagactgatgatgtccatcgtttcattgagccgctcgcgcatctgctccggtaacgttagcgggatccagtcgccgctcaacagtgccagacgcaacgtcggataactcatccgatcgccgctgtggtattcgcacagcatctgcatcagtgcgggcactgcattccagacgcttacatgaccgtgtgccataactgtctgccaatgacgcggatctttttcccgtcctgcttccggcagtaccagcgctgcacccaccataaaaggcgcaaaggcatcgtaaaccgacaggtcaaagctcaatgatgacagcccgaacaccctatcctgcgcattgaggccaaagcgttcgttgatgtcttccagtgtgttcatggccgcacggtggtcgatcatcactcctttcggggtaccggtggagccggaagtgaaaatgatataggccagatccgtgacatccccagccacttcaggcaacggcgcagcaggcgtgtccagcattccgtcgtcgatgatcagcacgggcagcgacggctccaattgcgtgagacccggctgcgttacttgta

SEQ ID NO: 10045 - DNA, 17908 bp, Escherichia coli
gacgcttgcgctccggattaattgctgaaacatccttttcaatacaaataataacgccgttatggtcatagaccattttcaaagtgtctggctggaaattcttttgttcctcataccagttttttccatcatctgaataaagccatttgatgttaaattgctttgttagctgatattgctcttttgttttagggttgccagcagtaatgttttttaagtgcatcatcgttaaatactccccgcgttataccacgtcccattaatgcaatactgaattggccttgcctgtgttgtatcaattaattcatcacggtttccgttaactgaacccgtaacgacataacctgacctgtcagaccagccgggaccattccatgtctgaacagatgacagaccgccaaggcgaatacctgtaataaaccttgagttacattctgcctgcgtatatgcaccaacatctcccgctgaaggttttcgtgtcgtggtatagaaatctgaccaacctaattcaaacccataaccatcacgagccgacctgtaggaaatgccaccatttttataattcacacggaattgtacggcaggacagctaccagcatttatattaaagtgaagaattaatacagatgcaccaccaatcagggcgttatatgcaccactatcccaattccatccaacggatgtatcaccattaacagtattacctgtttgtcggagtgcaaatgcattgacatttttggcactaattgaaatatcgctagaaccatcaaaaccaactccagcaatttttcgtgctgttttcagctttgttgcagtagcggcattgccggacagttccccagaaaggccaccgctgaatgtttgtcgattggtccaggtattcgctgtactgagtaacggtattttctccccgcttgtgccgagttctcgtaaaccgaggtattcgataacggcggcaacggtcgatttcgcaagaatatcccgcccgacttttgtcagggttgccaggctggcgacatcattccccgtaaaatacggaaacttgtctgccgcagtagcaagcccggccagcgccgtcagggtggcatctttcggttgcttacccgcaagcgcgttagtcatggtggtcgcaaaattcgggtcgtttcccagcgccgccgctaactcgttcagcgtattcagtgcgtcaggtgacgaatctacaagggcggcaatcgcagccataacgaaagccgtgcttgcgatttgggtattattcgttccctgtcgcgcagttggcgttgttggcgttccggtcaacgcaggactgtttaagggcgctttcttgttcgtttcacccattaccgccttaaccgctttcgatgtcgcggccagtgtttcagacgtgctgttggtggcactactgagctggactatccctttttgtgccgtcgtagcgtcttgagcggtatattttgcgttagcaaggtcatacgcggccttcactgctttcggcgttgcagcctgcgtttcagacgtgctgttggtggcgctactgagctggacaaggccttttcgcgtcgtgctggcatcctgcgcagtatatttaccgttagcaagatcatacgcggcctttactgctttcggcgttgcagcctgcgtttcagacacgctgttagtggcgctactgagttgaacaaagccttttgcggtcagagaggcgtccgggtgacgtcgtgactgttcatgctctttcagtttgtcatccacgtaatccactgtggccatcaccatggtgttatccacggtaagcgccacggtggcagtgctggatacggtcagaatggtgcgaaatgtttgtgcacgtccggacccttcggcaacggctggcttgtaactttcggcagtatttcccaccgcgattaaatcgccgtgctcatcaaatacaccaatttcccggatccagaatccgcccgtttcaggaggaataaccagctccgcaataatgcggttctgatgtgttgcgtccaggatgacgcgattaacagtatgtcgccacacctcatgcaccagacgggtctgcttactgtctggtgtgggcaacgtgccgccaccgtcgcccacggccatatgagtcaggcggacaggcttaccatctggcgcggctgcctgcgctaattttttggcacccgtatcggtgataacggttttaaatttacgtgttgtggtactcatgcttaatcgtccggataaatggtaatgacttcaccgtcgtaagttgctgccgccgcgaaaatatctcccgggatctcctgaatgatattcagccctgtcatgtggcggctgaccgggcgggcatcagcaatcaaccgctccatttccagatacatttcctccgtcacgccactgtccagcgtgcccacttcaacggtaaatgttcccggttctccgccgaactcccaccactcagacacacgaatgaggtatcccagcggctcaatggcccggcgcagtgcgctgatggttcccttgtgtcggtgtaccagccatgcatcacgaatcacctgtcgttttgtctcttccggccagttgcgatcccagcggtcaacggaaaatgcccaggcgagataaggcagcaggtgcaccgggcaggtgtccggcgaccacagcgtgttgaggtctaccgggatgtctgtaatgcgcgttccgacagcttcggcacaacgcatgaaattgctggctgatggcggtaacagtgaattactcattacgcccaccttcgctgatggtgaatgactcacagcgcgccgcctgtatgtcgctgatggccatattctgtgtgggttcgattatctccacgcgttgcacgccgtgtacatgaagtgcggcagcaatggcggacaacgccacgtcctgaccgataagcccctgttcagccagccacttcctgaatgacgattccgccgcggccagaataggttcggattccggaccggggtaaaagtacagttttgcattcagccgccatgtcacgatgctggcgctctgtacggtcaggcggtcggccaccgggcgggtatcctctgcattcagaacggcgcgaacggtattaagcaacgcctccgttgctgtgccgtcgccttcagtggacaggattgaaaccgtcacatttgccggagacggactgatagcccgcgcatcacgcaccagaccgctggcgctgcgggcaaaatactcgtatgcacctgacgggccagcaacactcaggccgtcgtacgcccgctgcgcccgcagtctcagcgaggtgtcgctctccatcaccgcgtcggtggtatccgttgccggagtgataaccaggcgctttgtgttcatattgcccgcgaggttgtccaggtctgttccggcgctgtggcttaacatgcaggcgcgtgccccctcgttaacccgctggcgtaacagcatttcacgaaaagacatggtttgagcgataacgttcaggggttccgattccagctccagcgcggcggagacggcttcacgctgttcggcaggataggacgcaatcatcatggcctttgtgtcagccagaattgcctcaaagtcaggctccgctatgatggcgggttccggtaactgggaaaggtcaacggcaggcatgatttactctctcagcgtgatggttaattcaacattctgcatggtctgcatgacagtgcccgacagcgtcaccccagcgcggcctcctgctttccagacaacatcgatggcatccagggcaatgcggggttcccatcgtgtcagtgcaatcacggtagcactcatgcattgcagacgcgtggtgttattcatgggttcgtcaatcaaatcaggcacaaggctgccatattcccgtcgcataacccggcttgccagcggggtggtcaggatgtccctgactgactgtttcaggtgctccatatcgttcaggtttcccgttccgtccgggttcattcctgtgtagcgggttgtcactgcgggcctcctgtcgaatcgctgccacctttaacgccaccgtgtttatgcgtatgcactgtgatgccgtttgaggtgaaattgccgccgctgtgcgtgatattgccgctcatctttcccccttttgtgacgtcaagcgtcgccgttctcagaaggtttgtgcattccacgacgggcgtgtccagtgtcacgctgacggatgcctgtaaagtggccgttttcatgccgctggcgctcagtgcgcctgcgtccgcgtcgtagcggaacaccgcgccatccggcgcactgaccacgatttctttcaggctttcgccgggggccggactggcatcactccacaggctgccaattatcatggcggtttccgggttgccgccaatgcaggctattaccacctgttcgcctggtgatggcggcagccacacattgaaggctcccgcgcgcgtggtgttccagcgcagccagcctgtttccagttcgccgctgcgaacgcgcacgcgccaggacttctcatcaacttcagagatgatcccggtgcggatgatgttgctcagcagtcgcatgagttctgcgctcaccgtatagcctccgcaatccggcccagcaccgtgttataaatcaggcgctcatctgcctggctgatacccagcagctcacgtaccgggtaatcggtgaaaatgcccggcataacctgatcgcgctcaccgaactgatgaacgcgtgcaatacgtgcggccacgccgctgtaacccaccgtcacaccggaagcatctgcacgggctttcaggtagcgggcggtgcgcagttttacgaacatggggacgcgctttgtgctgtcctggttgatgcgccgggtgcgtatttccagaaaacggtcgatgtcatcccggtaaaacgtgcggatattatttttatcctcatcccacccggtaatggttcgcccgtatttccccgtgtcgtgatgccagtttttcagcgtgcgtgcttcgttattccagataaagcgaatgcgttcctgtatccgggttacgcggcgtctgcgtggtgtccacgcggtcccgtccggcgctttctgtgaccggatacgcgcctgctgggcgcggcgtaaatcctgtgccagctttctggcgatgttattgatggcctgctgattcaggctgtcgcggatggcctcaaaggtttcatccacgcgggtgaatgccttatccatcgctttcaccccacgtcacatcctggaatacatgcgaccagtcgccttcggaagatggcaggcggggttttggctccggcaggtgttctgcctgcggcgtgccctgactgctgcgcgtgatgcgaacgcgttcccgcagagggagcgtaaacaggagatcggcgctgtcatcgtcattgataacggcggagaatttgatgtcctgattacgctccggattgagcaacaactgtggctgattttctgataaccacgccagtagcggcagcgtgaggtcgtccagctccccggcgtaatccatgacaaacatcaccatctgatagcggtaaacaaacgagggcgtttctccggtcgtttcaatgttgccgctctccacgaaaatggtgaatttttccgggttggcctgacaccatcggcatgaacgggtcatggcttcacgcagggaatcagttttcagcatggttgttgtcctcgttgttcagtcgttgcagcctgcgctgttccagtaattcaatggcccgtttatctgcgttacaggtttccagtgcatccagaaggcggtcgccccatataccgagatttccccatgtgggagtgtcagggaaggggggaggcgttaccggtatggtcagcgtctgcggtataagccggactgacggcgctggccgtggcgcgttctgcgtgcctgcgcaacctgtcagtaaaacgagcatcaggcaaagcgtgggcgcattcatcttttgcaatatcgttgcgtagctgttcacgtctggcttctccgtcctgattgcgttgctgattttccacgcggagttgcgccagcacctgctgcatatcctgtaccccggtgctgatgatattcagggtgtcgacggtacttttcagggtgctggcctgcgcttcgtttctggcgttctcccggcccagcgaccacgacagacgcatggatgttccccatgcggcaatcagaagaaaagcgacgcccagagaagtccataacttcatgctgccacgcgttcctttatccagccgtagacaaacgattcgttggcttcgcgtttttccgccagctccagatagcgttcaccctgtgtacagttcagtgctgttaacatcaccatctcgccgtcccgaccgcgtttttccagatatgcacgcaatgcgttaatcgtgcgtgggccagtgcgtccgtccgtgtccatatcgggatacagtttcccgccctgattgaatgcgttcagccagcgctgaagcattctggttgccacagacggtcccatatttactccggagtcacacagttctgcggcaatatccggggacagcttcgctatctgatcaaaacgcggtccgtaccagtaatcagcttcaaggatttccagtgcctgtccgcgcgttaaatcacgcatatcgccacggtatccgtgcgcccgtgccaccttttcagtgatgccccattttgtcggaccgcctctgtcatccgggtgattgacgtagccgccttctttgccaagaacggcatcaaaaatttcgtctttcgatttcatttcgtcacctctgtgaatgatttttatggtgattaccggctttaagcctgcgatttattcatctcccttttgggttatgcggttaaaggcggcaatgatcttgtcgcgtgctttttctgcgcccataaaaccgatagatgcgccgaaaaacgtcacggcatcttcaggaactccgaagaagcgcaacgacccggccacggccatggcaagaacgccgcacgccagcgatcccgttacggtctgaaccagcgttcgtccgtcataaagactcatcagcgcggaaatgctgaccgccgcgcctgctgcatacaccgttggcaggtggtcaaagagccacgcaataacctgctctgtgatccctgtttgaatggtgctcactactactccccccacaactgaatcatttctcgtttcttcttctccggctccggcatctccacttcctgcccggcgtccagaaatacctgctgacagagtccggggttggcatccagcaccttttcggtgacgccctgcgtcgtgccgtagtaccggaaacagagcgaatccacggtgtcgccttccagtgccttcactttcatcagcacaactccgcaaagattcgcgggcggcacagaatgtcagagatggcccagctcacatcgcgccacaaatccgatgtctgtatatccagtgcgtccgcccggcggtcgcccttgtccgttgtgtctgcatcacgataacgctccagaatcagggcgcgcgtggcggtataaacagcattgcgccagtgccagagattgacgctttctccgttaattacgggtgccggaacatcggccagcgtctgatggccagccgcctgctgttcctgctgccatgcttccagctcgcgggtaacgtgtgccacagctccggtggcggtatgcagcaggcgggaggtggtcacgcgccccggcagtcgtaccgccagacgcagctcacgcagcacaatatccggccagaatgcacccgctgaaatacgggtatcaccatcatcggtatcggtgatgtcgtcctctgcgggtccggggttggtcctggcaaccatactcatggggttcactcctgaaaaaatcgggcggtgggtgcgcggtgtaaacggtcacggagtcaaaccggaacaccgcgcacgccgcccgctgacggggtcagtcgttaaccgcgcttcgccttctgcgtcgcggtggtttttcgtgttgcaggcttccgcgttgtctttttacttttgctgctttcgtcctgcgcctgcggtgtgctggcgtcttctggtgcggctgcggaatcggcttttttcagggcgcgggaaagggttgcaatctcgcgtttcacacctgcgttcgggttcaggtgcattgcttcgcgcagcagcttcagtgacagggccatgctgtccgcatcactcaggccacggcggacaaaggcgcacgctttgcataatttggcgcgcacttcgtccggcatgtcctggtcggtgacaatctcccggagggtgtccagtggttcgataaaggcggacaaatccgcgtcggcatccgtcccggcctgcgtcagtaccggattacagatttcttcggtcagtaccgtggcagcagtacggccaaagttatccggcatgatgaggttgtgacggaccacatacgcgccgatacgcagcgcaagcggaagatcgccacagtcaatcgcccacaccatcagcgtggcaatcacttcatcctgctgcccgccgtcagcctccagcgttccctcaatccagccggaaaaatccggcaacaactcttttttgatggcggctttcgcgcttctggcctgtacgcccttaagccgggcctgtgccagacgcagacgatacagcacctcttcatgcgcggtacgcgcggcgtggtccacgccttcattcgcccggcctgcgcgctgtgccatcacgttctgccagtgttgctgtgcaggagtaatcatttgttctctccgttactggcgggcatgatgcccgccgtgagttgattagctgtcggcgaacttcaggccagtgaccatcgcgcacttgccatagtcttcaacgacataagcgtcattgatggactggtaggtggcgatgcggttgtattccggctcgtctttcatcaggcgacgcattgaacctttctgccagtaaatcgacaggttgttgaacgaggtgatcagcatcgttgcatccgggaagaacggcgcaaggaacacgcccagcccgccaatggtgcgcgatgacaggatgagctgcccggcaagtaattccgcattgggattctggccgctgatgctgttcagcacgggcagacgcagcgagttaaacaggttgcgccccataatcaccacaaggtcgtcagcttccttgtgccattcatccagcagggatgaacgcgcgtcctgtaccagtgcatcagcgttcgcatacttacccgcgtgcgccacggtgttatccatgttgcgggaggtcagcgtcacgtcattcataacgcgttcgctggcgtcggttctgatgtgctccagccatcccacgttaacgtcctgaagcagcttgttggtgctgaagttggactcatccgcgtgagacgtgccgttgaaaccgatcatgatgcggtcaagcgccacctgtcgggcaatctgtgcgctgatgcgggactgaaaatcagggtgtgccgcccaggcatcaagctgcggatatgaaataaacgtgtcgtagttcacctgttcgcactggtatttgcggtttttcagatcaaccacgttattcgggttacggcgttttgtgccgtcataactggtattcgtgcgtgcaattggcccggtggtgtccaggaggattttttcgcctttctggtcggtcacgccgatcacgttaattctttttgtaaattcggtgctttcctttgaggcgttttcaaaacgctgctgcaccgagggttccacggtaaatcgcgataccagtgcggaaaccggaatattattaagcgacgcctgctgcgccatatagcaacccagcttgttgcgggtaatatctgacatcaccagattcataaaaaatttgctcctttgtcttatcagaagtcagccagctggtcggaggctgcacctgttgcggtgaaccggttctgcggatcgccgtcctgcgtgcgcagtttttccttcagtgctgccagctctgtggtcagtgacgtaattttctggcggtcctgctgatggcgggtttccagcacattaaaacggtcgataatgtcggcctgtgacgttgcgacgccttccaccgcttcctgaatacgggaaaaactggcgtcatccgctttgcggccacggccaataatccccattacgcggttaaaccactgggtgccttcttcctggcgttgttctgccatttcgatgatttcagactcgatggcttcggagataagcggcgcttcaccctggatactgttgaacgtcatcaccgcctgacgttgctgtgccgtgaatttcaggcgctcagtgcccaggcttgccggggtgtcggtcatcgccagcccgaccagataggcgcgcccgttaacggagaactgcgggtgcagttcgatactggaatagattttcttgccgtccgcgacaagctgcttcatgcgctcggtcggttcgatttctgcatacagcgcagtacgtccggccagcggaccttccgtaatgtcttccgtactcagtgcggtgacatcgcccattgcggaaaattcgcttgacgggcatggcgagagatagtgctcaacgttcacgcgggcagcgtaaacatccgggttgaagttctcggcggcttcacgcagatgcaccggactgatttcacggccatcaacagttgatccggagacagccacgcgaaactttttgcgggatgtctttttttcattagccatagtttttgcccctctgactggttcttcagtcatgatggcaaagcgtaacaggctgatacaaagggcttttgttgtaagaaaacagtcagaacagagggttaaggagaacagtttcgcgcgcgggtaatcttcctgtaattactcagggggagcaatgattcaggacgcttttgtgcgccagcgtgcgcggcaactttactggcagggttatccgcccgcagaaatatcacgtctgatgggaataaacccgaacacgatttatgcgtggaaaaaacgtgaccagtgggatgaaacgccacccgtgcagcgtgtcacgcagtccatcgatgcgcgcctcatccagcttactgaaaaacagaataaaacaggcggtgactttaaggaaatagacctgctgacccggcagcttaaaaagctgcatgatggccagccggatgtgatggccgcaggaaagaaaggccgggcgaaaaaactcaaaaatcatttcacgccggaacagattgccgcactgcgggaaaaaatcatcagcaggctggagtggcatcagcggggctggtttgactccctgaccctttgcagggaagccgggatacgtaacaggatgatcctgaaatcccgacagattggggcgacctggtattttgcacaggaagcactgctgatggcgctgcgtgacgatgtggcgcaaccttaccagcgtaaccagatttttttgtctgcgtcgcgtcgtcaggcgttccagtttaaaagcattattcagaaggccgcggctgaagttgatgtggagctgaaagggggcgataaaatcatcctctccaacggcgcagagctgcattttctcggcacttctgctgcgtcggcacagtcctatacgggcaatttttattttgatgaatttttctgggtcagtcgctttgctgaactgcgcaaggtggctggcgctatggcaaccctcagcggactgcggcgcacctacttctccacgccatccaccgaaacgcacgaggcatacgcctactggaacggcgaccgctggaacgagaaaaaggcctcgcataaacgccagcgtttttctgtggactggaaaacgctgcataacgggcttatctgccctgaccggacgtggcggcaaattgtcacgctggaagatgtggttaatcacggctggaaacacaccgatatcgacgaaattcgtgatgaaaacaccgaagacgagttcctcaatctctatatgtgtgagtttgtccgcgaaggggaatcggcatttaacctgaatatcctgattggctgcggtgttgacggatacgacgactggaaagactggaaaccttttgctccccgcccgatggggaatcgtccggtatggattgggtatgacgcaaacggcagtagtggcaacggcgacagcggcgctgtctccgtggtggttcctccggctgttcctggtggccgttttcgaacggtggagacgcgacgcgttcaggggctggagtttgaagaacaggccagagtcattgaagagttcacgtatcgctacaacgtggaacacatcggcattgatgtgacgggcgggaacggggaggctgtttatcagatagtgaagcggtttttccctgctgctattccgtacaccttcacgctgtcatcaaaacggtcgctggtactgaaaatgctgcaaataatgcgtgccgggcggtgggaatacgatcgcgccgaacgcgagctggtcgcggcctttaacgccgtgcgtaaggtgaaaacaccgggcggctttatcacttacgaaacggaccgagcgagggggatcagccacggcgaccttgcgtgggcaaccatgcttgctgtcattaacgaaccgattggcggcgaaggagaaaacgagcgtttcacggttatggagttctgatgagcagaaaaaataaaaaagtgcgcatgagttcacgcattgatctcgctgatgcgctcaggaaagagtcatcgctcagtgcattcacatttgatggtccttatcgcctgaccgggcatgacctgctggacaatatgtactgtgctgataacgggcggtggtatgaaaccccggtggactggtacggtctggcaagagctgcccggcaaacgtcctggcatcagtctgcgctttactttaagcgcaatgtattactcggttgctacatcccgcacccgctgctttcccggcaggatttctcggcgctggcgctggactggtttgtgttcggtaacgcattccttgagcttcgaagcaatatgctcggcgaaccgcttaaattacggcacgccctggcgaaatacatgcgacgcggaagcgatcttgaatcatggtggtatgtgcaggatggcaaggacgcgttccagtttcgtcctggcaaagtgtgccacctgatgaatccggatattaaccaggaaatctacggcatgccggaatatcttggcgcattactctcggccagcctttctcattcggcggacatgttcagaaaactgtactacgacaacggatcccacgccgggtgcatcatctacatcggtgcagcgcaggtaaaccgcgaaagcatggactctctgaaagaaacgctacagggggcacgtggtggtggtgcgtttaaaaacgtgctcattcatgcgcccaacgggggcaaagagggggtgcaaattttgccgttccagcagatcaccgcaaaagatgagtttatgaatgttaaggcggcatcccgtgatgatgtgctggctgcgcaccgcgttccgccgcaactgatgggggcgatgccgggcgaaaaaagtgcgtttggtgatgtggagaaggccgcgcgggtttacgcaattaacgagctgatgcccgtcatggaggccatgaagcacatcaatgactggcttggcgaagaggtgatccgctttaacccttacgcactgttagatacccagcccacatcctgacgcgcttcgcttgtctgctgcttcgccggggcataaaaaatttatgccccgactctccagctcctgtatcaatcagataatttcacgacgctttcctgcttattgccatcatcgacggtcagactcttacgcaatcccactgcgctgactgcatgttctcgccgcctcagtgcgattttgacggccttatctgccaccccatcaaagcaaaagccctcacgtctttttcatgctcagcgtgagaaatacagccattctgttgtatctctgcgacaccgttcaggggatgctatttaccccctgaagcgcgggctgttcccccgtcacctgcgcgcagaaaaagcgcgtttttttgtgcacgcacggatccttgacggatccagccgccatgcgggccggaagggtaaaaagtcgttcaaaaaaattgtgcaaatttgtgcactattgtgcagaagggcgatgcgcgattatcgccctggtttgagggggatcaggtgttatttttatctgtcgtcagtgagctaaaccatccacgatttacatcgcaggactgatgcgttctgtcctcgtgtttctcctgccacaatgcttttccgccagcctttatgatggctctttcaacatcccgctcgtatcgcaagggctgaaatacgtcattaatgaaatattcgcttatgtccggaagcgatactgcaaaattatttgtttgttgcgccgtcctgctatgcagcaaagcggcatgctttaatgcgtcctgtgctttctggaatttaagtgcatagtcagtggcgattttttccagttcagcgattcggttgtctttggtttccagccaatcaagtagcgccaatacttcaggatccccgacatccaacactgttacgcgtgatttttcataatgttcgtcagcaagagttcggccaattttgaaatctccatcatcaccataaccggagcaggcataaacaacctgtgctccagatattcgctgaattgacatttcctcgccgcaaatagggcatttcggtacaggcacaggtgaataacgttcacgtaatgcctgatagttgatttcgctcattaagtcgttctccttgtttatgttctgaggtggagagcagggcgaactcgccctgatgttgtgttattcaggaaataacgcccggatatttccggccatctgactggttatctgtgcggttgatactggctgtgatgcggggcgttctgtcctggtttgtgtcactgataatgcttcatcaccagcccatgcagccagtcgataagcctctgccggattcattttcagaagtgccagcccggccagaaaagccacgcgttggccgcttttgcgggcttctggtgtaaggctgtccagccaggcgcatgcttctccttcgttcttgacggcggtgggcttcagatagaaacttatccgtctggttggagtcgtcattggtttactccttgtccattgcgtacagcccattaaccagagcaaactgtggcaccccgtccgcgatgaaagtcgcattaactccgcaggcttcgcggatagcgggtgccacaatctccgcccctccaccgacaaccatcacccgcccgtaacccgaaaaacccgccagcgcgcggatcacgcgttgtttcagtgtttcttccttttcacgaattaccgccatcaggctggcgtaatgcgcgtcattgtggatgtgctggcgcagccaggcttcatcatggcgatgttcgataatggtattggcgatgtggtgactggtgcgcataccgttagtggccatcaccgacagtacggcatcggccatcagagaaacgcccacgtgtggatcgcaaaacacctggctgatacctgccagttgcccctgaacctttgccacatccagcgtggttccgcccaaatccacaatcagcagggattcaaacggactcatgtcagccagtgccttaaagccagccggaatggattcaggcataacccgtacgttacggatagtgaatgcttcgccgttctggtactccaccgggcgcatgacgttcgcttttttgcggttgatgttggccatgtccggctgtgcgtttgtatcgaaatactcgctcagtggcagggtgacaaccacatccacttcctgtggtgtgatgcctgatttgaccagcgcgtgatgaatggcaattatattcacatcgctgtactggtattgcgtgtcggtcgtctggacaaagcgatcgctgaccggatcaaaaccatagcgcacgccatcaagcatgtagttcgcgggctgcgtgccaccgaacggcgcagaccattccgacttgaagctgttcgggctgatggcgttgcggcgttcgccgttctcagtccatgccagcttgatgttggtggagccgtcgtcgatacaaattttcatgtcgcttttccttatgttgattaattaatcggttacaggatttttaaatcccgcttttgcctgttttgtgcgcgcttcatatatcgcggcacgttttttgctcatttacgggatttgtgagtcccgtttctgtctgttttttgtttccactggtcaggctaccccgcagcaggtctgctttgcggtgggcgcgttcagtggtttcactgattctctgtgcgtgctctgcgtcacggatggcgcgcagcatgtcagaaagcacggtaacgggggttttcatggtgttctggtcctgctgaagtgtggatgccaggtgtgcggcggcttcggggtctgatgcccccagctgttccagatagctggcgaccgggttatggcggatctccgtgctgcttacgccgtgattacggctcaggcgctgccagagttgcgtgattcggctgtccgggcgggtatctggtttgcgtacaatttcaaatccctgcggtgcaatgatgctgccgtcaacgtacagactgccgccccgtaacaggtgctgcatctgctgttcaccgatatgcaggccgagagattcagcagactcccgccattctttagcgagtaactcgtggttatcaggcaaaggccgtggctgtttgcggctctgtgtccagttctgcatttcatcactgctgttttttgcctgtttgtcacgcagcgaacgcatcagcgcccggcgttcgtgccgtttcagtgagcgcatccattcattcacgtcaacgccgtcaggaagctgcggccacggtgctggccgttcttccggctgttctgtcccgttgttgtccgtttcctgtacacggggacagttattgccacgagtccaaggggcggcggggccgccctgaaggtcaaaaccattttcgtgggagctgtcttccgcttccggtttgcgtcttaccagcttccagttatccggatgcgtgcatacgcgggaagactccccgatgagcggcgaccagatcccgtaaatctgtacgctctgttcgccgtaatcgttcagctcatctgcgaggtcgtaggcggtgcgaatcaggtagtcttggcgtggaacaagtacgccgccctgtttctctatgtaggtggcaaaacatccggcatcagcggcagcgagtaccgcatccattgcgtcatccttcagccgttgcgggccttccgggttgcgtgccatctggctggcaaggcggcggagttcacgccacacctgacgggaggggataccaaagaactggaactggcggacacggtgaaggcgcgcccagccgatggcgcgttccacgctctcggccattgattttccggtttcgtggtcaacgcgtggcttgcccgttttcgggtcgatgccatctacggcgcggctgtccaggttctttccgatgtaggtggcgatgtagctggttggcgtgccttttgagccgtcgacgtactccgccttaaagcgtggggtaatatcatcacccagctcgtgacgatcttcctgaatggcaatatcgcgggtgtgggacacaatggtgtcgatttcttccggatgagcaaagaccatcatatgccagtgcacggtgccgtcatggtgaggctccaccgtgcggatgccataccagcgcaggccgtcgcggttcagtttcttgcggaccgccgcaaaaaacgtgttaaccaggtaatcgctggagtcgcgcatggtggccccgttccatttgggattcggatgaccgttctctgttgtggcgtggtattttgacgggcaggtgatggtcagaaacaccgctttgtcgccacgggcttcggccagaagttccagccccttcatggtggccatca

SEQ ID NO: 10046 - DNA, 13570 bp, Escherichia coli
cgttgcctgcgtcggattaggtcgcgcggcctgcacgcagcccccaggacgcgcaggttccccaggcgataatcgcactggctccagcggcggcacgcttgagtttctcaataaacggtcgtccgctgctgatacagaacatcccctgctcgcccagcggcggattaccttcaacggcgaggatatatttgccattgtattgcgcgatgatgtcttcaaagacttcttccgcctgggttccggcggcagccatcaaagtatcgtcgtaatcgagggaaatcagggaaaggatgacgtccttcgccagtgggtgagcggagcggataaaagattcggtacagcaggtgcattcaagaccgtggatccacaccaccggaatgcgcggtttattctccagcgcccaggcaatctttggtgccattcccgcgcctaatcccagcgacgtggcagccagactacaatatttgagaaagctgcgccgggtaacgccctgacgccgcatggcctggtaaaatgtttcctcgttattcatatcgcacgtctcttctccttgcgacaccggcaggacaccgggcgcacatggtcggcaagcgacgtccctgtagcaaggcaaaccatcgcttcacgtgagatgctgaaaacgaaagctcatccttctgcactggcgcacgtcgccagaaagtattgttaataaagcgtagtgaaacttttgcacaaaacaatacaaactgtgtggatttatcttttagcgataaaaatggacctatttttctttttgccgggcagtggggatgtttagccggttgctaaacgagtaaaagagaaggaattcatggtgatgaaatgatcagtctgctgttatttcacgctaacaatgcacttttggctgtttttcaggcaaacaaacaaattaggggtttacacgccgcatcgggatgtttatagtgcgcgtcattccggaagtgtggccgagcggttgaaggcaccggtcttgaaaaccggcgacccgaaagggttccagagttcgaatctctgcgcttccgccaaataagataaggggttagctaaatgctaacccctttttcttttgcctgtcgaaattctcagggcgttatatttgcttaatgacctgataatccgctgttaaacctgttccagatcaaatgcgtaaagatgggtaaaacttctgtgtaccttcccacattatcattatgctgcttaattaattacatctgtcatagagagtgactcaatggatcgtatagttagttcttcacatgaccgtacatcgctgcttagcacccataaggtgctgcgtaatacctattttctgctgagcctgacgctggccttttcggcgattaccgcaactgccagtacggtgctgatgctgccatctccgggtctgattctgacgctggtgggtatgtatggtttgatgttcctgacctacaaaacggcgaataagccgaccgggattatctccgcattcgcctttaccggttttctgggatatatcctcggaccaattctgaacacctacctgtctgctggaatgggtgacgtaatcgctatggcactgggcggaacggcgttggtgttcttctgctgctctgcgtatgtgctgaccacccgcaaagatatgtcgttccttggcggtatgctgatggcgggtattgtggtggtgctgattggtatggttgctaatatcttcctgcagctgcctgccctgcatctggcgatcagcgcggtcttcattctgatctcctctggcgctattttgtttgaaaccagcaacatcattcatggcggtgaaacgaactatattcgtgccacggttagcctgtatgtttcgctgtacaacatcttcgtcagcctgctgagcattctgggcttcgccagccgcgattaatctcgcccagggttacttaccgagcctcgctttatgcggggctttgttttttgttacactgccgccagtctgattaaggtagtaaagaattatgctgatcttcgaaggtaaagagatagaaacggataccgaaggctatctcaaagaaagcagccagtggagtgaaccactggcggtggtgattgcagagaacgaagggattgcgctgtcgccagaacactgggaagtggtgcgttttgtgcgtgatttctatctggaattcaatacttctccggcgattcgtatgctggtaaaagcgatggcgaataaatttggcgaagaaaaaggtaacagccgctatttataccgactgtttccgaaaggtccggcaaagcaagccaccaaaattgctggcctgcctaaaccggtaaaatgcatttaacggatacgaaaatccgttaactccccggagggatgatgcggctcgctaagcacccgttccacacgcgctgaacgcgggccgccactttttaaccactgtattaatttttccacctgcccttcgtcaccgcaggcaaccacttccacgctgccatcgtcaagatttttggcgtacccggttagtcccagttttttcgcttcgtactgcgtggtgtagcggaatcctacgccctgaactcgcccgtaaatccaggcaattatgcagactttcgacattgctgctctccttatccttaatggacgcgttgcaaatccatggaaaactccggacaatgacgcccatttctttgcatcgacagaaaagtaaattatgagtgtacgtttagtgttagccaaagggcgcgaaaaatcattacttcgtcgccatccgtgggtcttttccggggccgttgcccgcatggaaggtaaagccagcctcggtgaaaccatcgatattgttgatcatcagggaaaatggttagcacgcggcgcttattcgccagcttcgcaaatccgggcgcgcgtctggacgtttgacccgtctgagtctatcgacattgctttttttacccgccgtttacagcaagcacaaaaatggcgtgactggctggcgcaaaaagatggcctcgacagctatcgtttaatcgccggagaatctgatggcctgccgggtattactatcgatcgtttcggtaattttctggtgctgcaactgctgagtgctggcgcagagtatcagcgcgcggcattaattagtgccctgcaaacgctgtacccggaatgtgctatttacgatcgcagcgacgtcgcggtacgtaaaaaagaagggatggagctgactcagggccccatcaccggcgagttgccgcctgccctgctgccgattgaagaacacggcatgaaactgctggtggatattcagcacggacacaaaacgggctactacctggaccagcgtgacagccgcctggctacccgccgctacgtcgaaaataaacgcgtacttaactgtttttcctataccggtggtttcgccgtatcggcattgatgggcggttgcagccaggttgtcagcgttgatacctcccacgaagcgctggatattgcacggcagaacgttgagctgaacaaactggatctgagcaaggcagagtttgtccgtgatgatgtctttaaattgctgcgtacttatcgcgatcgcggtgaaaaatttgatgttatcgtgatggacccgccgaagtttgttgagaataaaagccagttgatgggcgcgtgtcgtggttataaagacatcaacatgctggcgattcagttgctgaatgaaggcggtattctcctgactttctcctgttccggtctgatgaccagcgatttatttcagaaaatcatcgcggatgccgcaattgatgccggtcgtgatgtacaatttatagagcagttccgtcaggcagccgatcatccggtgatcgctacctacccggaagggctatatctgaaagggtttgcctgtcgcgtcatgtaacttgaaatgtggaattttacccttatatcaaaggtaaagatttcccgggaggtgactatgattgccagcaaattcggtatcggccagcaggtccgccattccctgttaggttatctcggagtggtcgtggatatcgacccggtttattcgctctctgaaccgtcgcctgatgagctggcggtgaatgacgagcttcgcgccgctccgtggtatcacgtggtgatggaggatgataacggcctaccggttcatacctacctggctgaagcccagctaagtagcgaattgcaggatgaacatcctgaacagccatccatggatgagctggcgcagaccatccgcaaacaactccaggccccgcgtctgcgtaactaatccctgaacaaatccccggaaggtttttgccttccggggattttttatttggccaggcccaggcgagggatctcaatcgccgggcagcgatccatcaccacgtttagccctgcatcacgcgccagcactgccgcttgctcattaatcacccccagttgcatccagagggttttcgcgccaatggcgatagcttcctgcgccacgccccacgccgcttctgaattacggaaaacatcgaccatatcgactttttccggaacgtctgccagcgtgccatacccctgctggcccagcagtgttttgccggcaacttttggcgaaacaggaatgacgtgatacccctggtcgagtagatatttcatcacgcgatagctgggacgatcgggtttgtcgcttgcccccaccagcgcaatggtgtgagtggacgttaaaatgcctgcaatatcggtttctttcattatttcctccagactgtttaacaaagtgtacgacaaagccgacatgccaaccatgcagctaatacgaatgaatgagagcaaaagcgggaaatatgtctatatgttagtaagtatgattaaagaaaaattttgacacattattattcgggcggtcttttaacaggagctatctatgaaaaccggcatcgtgaccaccttgattgcattatgtttgccggtatccgtttttgccaccacgctgcggctttctactgatgtcgatcttctggtactcgacggtaagaaggtttccagctctctgctgcgcggtgcggacagcattgaactggacaatggaccgcatcagttagtgtttcgcgttgagaagacgattcatctttccaatagtgaagaacggctctatatctcccctccactggtggttagttttaatacccagctcatcaaccaggtcaattttcgcctgcctcgcctggagaatgagcgggaagctaaccattttgatgccgcgccgcgccttgaattgttggatggcgatgcgacgccgattccggtaaagctggatattctcgccattacctcaactgcaaaaacgattgattatgaggtcgaggttgaacgctataacaaatccgcgaaacgcgcttcactaccgcaatttgccacgatgatggcagatgacagtacgctgctttcgggtgtttccgagctggatgctattccgccgcagtctcaggtgctcacagaacaacggctgaagtattggtttaaactggctgacccacaaacgcgaaatactttcctgcaatgggcggaaaaacaaccatcctcctgagatttttgtgcctgtgcgcaggctttttcagtctttatcttgcagcgataagtacttacagtaatctgtaggaaagttaactacggatgtacattatggaactgacgactcgcactttaccttcgcggaaacatattgcgctggtggcacacgatcactgcaaacaaatgctgatgagctgggtggaacggcatcaaccgttactggaacaacacgtactgtatgcaacaggcactaccggtaacttaatttcccgcgcgaccggcatgaacgtcaacgcgatgttgagtggcccaatggggggtgaccagcaggttggcgcattgatctcagaagggaaaattgatgtattgattttcttctgggacccactaaatgccgtgccgcacgatcctgacgtgaaagccttgctgcgtctggcaacggtatggaacattccggtcgccaccaacgtggcaacggcagacttcattatccagtcaccgcattttaacgacgcggtcgatattctgatccccgattatcagcgttatctcgcagaccgtctgaagtaatattgcacaggtggcaaacgccacctgtttcttacggttttctcgccaccggcacatccagatttttcagtatatccacaaagggagagggattctctttgttaaacagtgcccatacccgatgacgtgcccgggtcagcgccacgtacattaaccgccgttcttcagcgtccgggaaatcctcaaccggtggcagtagcgcctcttccataatcgactcccgcgccgcagccggaaaaccatcactcccctcctgcaagccaacgatgatgacgtaatccgcctgttgccctttgctggcatgaatggtcataaagtcgatttgcaacttcggccagcgtgttgctgctttttccaggctggcaggcctcatgtgatggtaacgcgccaggatcagaatgcgctcttccggtttggcataaccagagagtttatccagcaaagcgtcaagttgaccctcatccaataacgtgacggcttttttgtctccattggttaagctgtttagcggctttttaagctggcctgggttctgctgaataaacctgtttgccacctcaccgatacgactgttaaaacggtaggtcgtgtctaaatcacagcgatcaccttcaccaaagttttcatggaaagccgtggtaagcgacatttgcgcaccgctgaatcggtaaatcgcctgccagtcatcaccaacagcgaacaacgtcgtttgactattttgcttgcgtaatgccgctaacaacgctgcacgctgcggcgagatatcctgaaattcatcaaccagaatatgcttccacgggctgataaagcgacctttctccagaatcacaatcgcctggtgaataaggcccgaaaaatcgacagcgttttctgccttcagcgcacctttccaggcttttaataacggggccatcaacttgatacgtttactgaacagatcgcgaatctcttcgggtgcactggcaatcatttctgcctgtgcaccaccgtgcatccgcatcagacttacccagcgatcgaggcgagaggcaagacgacgctgtaatttttcatcatcccagaaattaccttctggcactgaccactgcatttcttccgtcagccattgccgccagcccttcgcctgcgctttcttttcgctgcattgcttgcgccactcagcaataaaaagttcatgacgggcagcggtatcattttccagtttgctgactatcggaacttttttgctgccctgctgaataatatgcagcgccagcgcatgaaacgtgcgtgcggtaatgtcttcggtatgtagtcgttctcgaatacgctcgtgcatctcttcagcggctttgcgaccaaacgccagcaataaaatttgctcaggggacgcttcaccacgcgccagtaaccagccagcacgggccaccagcaccgacgtttttccgcttcctgcacctgccagcactaacagagaatgctcgccattaacgactgcccgggcctgcgccggattcagcggtgaagactcgacctggcggaaaaaatccgcatactcggtaagcatggcttcggtatacgcctgattatgctgcaaccgagcgccttcaatgtccttcaaccaggcctgacatttacgccacacctcacggcagttatcgaattcttccagtcggttaaccggcaatggtaacgccgacaaagcctggcggatttgttgctgcacgccagaggtttgctcacgcgtcagccatttattttctccggtgcgcgtggcaatcaaatccagttgctgacgtaaaacgccagacgcaatttcgctcatctcgccactccaccgccgccagtgagcatcaagatgatggtaaaaacgctgcgtctcgccccattcggtgccgtgcagacgcaccactttttcgtccggcagtacaaattccagctcgccccataccagaccgcgcttacagtgaatcgccagtaattgattgaaaggaataaggtattcgtggcgatcgccggagactttaatcccggcattgaggatcaccgcccgatcgtaagggtgctgtgccagacgttttccaagcgttgtcgctttcagttccatgactctgtagatccacacgaaattatttcttatcagtgtaaccgtcagagaaaacgtgctccagcccaaaaaaacgttacaattgccgcccattactgaaaaccacagtaaagcgaggttttatgcgtaccgttttgaacattctgaactttgtgcttggcggatttgccaccactctgggctggctgttggcgactctggtcagtattgtgctgatttttaccttaccactgacacgatcctgctgggagatcaccaaactgtctctggtgccttatggcaatgaagctattcatgtcgatgaactgaacccggctggcaaaaatgtgctgctaaatactggcggtacggtattgaatattttctggctgattttctttggctggtggttatgcctgatgcacattgcaacgggcatcgcacaatgtatttccatcattggcattcctgtcggtattgcgaactttaaaattgccgctattgcactatggccggtcggtcgtcgcgtggtatcggtagaaacagcgcaagctgcgcgcgaagccaatgcacgtcgtcgtttccaataatccactaatatggcctttatgctaagtcctttgctcaaacgctatacctggaacagcgcctggctgtattacgcgcgtatttttattgcgctttgtggaaccacagcgtttccgtggtggctgggtgatgtaaaactgacgattccgctgacgcttgggatggtggcagcggcgctgaccgatctcgatgaccgactggcgggacgtttgcgtaacctcatcattacgctgttctgcttttttatcgcctcggcctcagtagaattgctgtttccctggccctggctatttgcgattggcttaacgctctctaccagcggcttcattttgctcggcggtctgggtcaacgctatgcaacaattgccttcggtgcattgctgatcgccatttacactatgttgggaacatcactgtatgagcactggtatcagcagccgatgtatcttctggccggtgccgtctggtacaacgtcctgacacttattggtcatctgctgttcccggtccgcccgctgcaggacaacctggcgcgttgctatgaacaactggcgcgttatcttgagctcaagtcgcgcatgtttgatcctgatattgaagatgaaagccaggcaccgctgtacgatttggctctcgccaacggtcagctgatggcgacattgaatcagacgaaactctcgctgctgacccgcttacgtggcgatcgtggtcaacgaggaacgcgtcgcacactgcattattactttgtcgcacaggatattcacgagcgtgccagctcttctcatattcaatatcaaacattgcgtgagcattttcgccacagcgacgtgctgttccgttttcagcggctgatgtcgatgcagggccaggcgtgccagcaactgtcacgctgtattttgctgcgtcagccttatcaacatgatccgcattttgagcgcgcttttacgcatattgatgctgcgctggagcggatgcgcgataacggcgctcctgctgatttactcaaaacactgggatttttactgaacaatttacgtgccattgatgcccaactggcaacaattgaatcagaacaggcccaggcactgccccataataatgacgaaaatgagctcgctgatgacagcccgcacggattgagtgatatctggctgcgtcttagccgtcacttcacgccggaatccgccctcttccgtcatgcggtaagaatgtcgctggtgttgtgcttcggctacgccatcattcagataaccggaatgcatcacgggtattggatcttgctgacaagtttgtttgtctgccagccaaactataacgccacgcgccaccgcctgaagttaaggattattggtacgctggtaggtatcgcaattggtattcctgtgctgtggtttgtgccatcactggaagggcagttggtgctgctggttattaccggcgtgctcttttttgccttccgtaacgtgcaatacgcccatgcaacgatgttcatcacacttttggtgctactgtgtttcaacttgctgggtgaaggttttgaagtggcgttacctcgcgtaatcgatacgctgattggttgtgccattgcgtgggcggcagtgagctacatctggcctgactggaagtttcgcaatctgccgcgaatgctcgaacgcgccacagaggccaactgccggtatctcgatgccatactggaacaataccatcaggggcgtgataaccgtctggcgtatcgtattgcccgccgcgatgcacacaaccgtgatgctgaactggcgtcggtggtatcaaatatgtccagcgaaccgaacgttaccccgcaaattcgcgaagccgcgtttcggttgctgtgccttaaccatacgtttaccagctatatctcagccctcggtgctcaccgggagcagttaactaatcctgaaattctggcgtttcttgatgacgcagtttgctatgttgatgacgcgctacatcatcaacctgctgatgaagaacgcgtcaatcaggcattagctggcctgaaacagcggatgcagcaacttgaaccacgggcagacagcaaagaacctctggtcgtacaacaagttgggttattgattgcattactgccagagattggtcgtctgcaacgccagattactcaagttccgcaggaaactcctgtttcggcgtaagagagtcagcccattctgcaagctcctggcggcgtgccaccgggagcgcagcttcatgaatgccgataatggccccttcaagcataaacagaatcttttctgtcaccagactgttttgctgccgcagtcgcaaccaacacatttttgccccaagtatacgtaacgcccgtacatccttaatccccacctccccgagaatcgcttccagatgaaaagacatattgagcaaatctttcagtctttcccgaatattgcgcgtacttttctctttcagcgctgcatcgagagaatatttcgacagacgcaccagcttcagttgatttcgccatagactttcatcaacccgatagtaattgagggtaacggatcggccacactttttatatgtcagccagacaggcggatgttttacacagtacggtgcactttgctcacaagcccgaagatacaactcaccatcagaaaccatcgcaaacaccgtgtcgtcaacggtcaggctgtaactaccaaacaatgatcggtattcaattgtgcccaacgttgccaggtattcttgtgatttatagatccgcttataggagaggcttttcataaaattccttttaaaatcataaaataaaagaatgattcacattaacggatccgttaactacgaaaataggcaacttattcttaaggggcaagattaatttatgttttcccgtcaccaacgacaaaatttgcgaggctctttccgaaaatagagttgatctttgtcgtcactggatgtactgtacatccatacagtaactcacaggggctggattgattatgtacactgcaggctatgcacatcgtgattcgtcgttctcatccacagcaagtaaaattgcgcgtgtctctacggaaaacactacagccgggcttatcagtgaagttgtctatcgcgaagatcagcccatgatgacgcaacttctactgttgccattgttacagcaactcggtcagcaatcgcgctggcaactctggttaacaccgcaacaaaaactgagtcgcgaatgggttcaggcatctgggctacccttaacgaaagtaatgcagattagccagctctccccttgccacaccgtggagtcaatggttcgcgctttacgcacgggcaattacagcgtggtgatcggttggttggcagatgatttgactgaagaagagcatgctgaacttgttgatgcggcaaatgaaggtaacgctatggggtttattatgcgtccggtaagcgcatcctctcacgcaacgagacaactttccgggctaaaaattcactctaatttgtatcattaagtaaatttaggattaatcctggaactttttttgtcgcccagccaatgctttcagtcgtgactaattttccttgcggaggcttgtctgaagcggtttccgcgattttcttctgtaaattgtcgctgacaaaaaagattaaacgtaccttatacaagacttttttttcatatgcctgacggagttcacacttgtaagttttcaactacgttgtagactttacatcgccaggggtgctcggcataagccgaagatatcggtagagttaatattgagcagatccccggtgaaggatttaaccgtgttatctcgttggagatattcatggcgtattttggatgataacgaggcgcaaaaaatgaaaaagacagctatcgcgattgcagtggcactggctggtttcgctaccgtagcgcaggccgctccgaaagataacacctggtacactggtgctaaactgggctggtcccagtaccatgacactggtttcatcaacaacaatggtccgacccatgaaaaccaactgggcgctggtgcttttggtggttaccaggttaacccgtatgttggctttgaaatgggttatgactggttaggtcgtatgccatacaaaggcagcgttgaaaacggtgcatataaagctcagggcgttcagctgaccgctaaactgggttacccaatcactgacgatctggacgtatacactcgtctgggtggtatggtatggcgtgcagacactaaatccaacgtttatggtaaaaaccacgacaccggcgtttctccggtcttcgctggcggtgttgagtatgcgatcactcctgaaatcgctacccgtctggaataccagtggaccaacaacatcggtgacgcacacaccatcggcactcgtccggacaacggcatgctgagcctgggtgtttcctaccgtttcggtcagggcgaagcagctccagtagttgctccggctccagctccggcaccggaagtacagaccaagcacttcactctgaagtctgacgttctgttcaccttcaacaaagcaaccctgaaaccggaaggtcaggctgctctggatcagctgtacagccagctgagcaacctggatccgaaagacggttccgtagttgttctgggttacactgaccgcatcggttctgacgcttataaccaggctctgtccgagcgtcgtgctcagtccgttgttgattacctgatctctaaaggtatcccggcagacaaaatctccgcacgtggtatgggcgaatccaacccggttactggcaacacctgtgacaacgtgaaacagcgtgc

SEQ ID NO: 10047 - DNA, 10390 bp, Escherichia coli
gtgcgcggtgactgaataaatttgccgtgccgacatacacgcgacatgatcggctgtaccgcgtcctgagtacggaagaagaccaggtcgccgttttcagttcactacgttcgattggcgctgcatcgcgcaggtgatacatttcattcgccgtacgcggaatacgaattttcaccaaatctttataagcgtaataaaccagaccgctgcaatcaaaaccggtacgcggtgaactgccaccccaacgatatggcttaccaatttgctgcatcagtttattcattgccacttttgtggctttttgcaccttcgctttgtgcgcgtcggcaagggttcctgacgcggcatttttgactttcacacaatgcgatttatagcccttacgtttggtacacttttcggtaaagttggctgaggccgttttattgacggtgtgtttgctgcgagttttggcgtttttagaagcggtaatggaagattttttaacggaagaagcggttttgcttttggtcgtacttttactggcggcttttttcgctgttttctgggtctttttggtggttgccgtgcttttctttttatctgcttttttggtgatatgagtagtagcagaactctccctggcttgctttgaagcatgggccataggcgttaaaggcagggtggtaaaaagtaaagcacagagcgtgatcgaaatacggtttatccgcgccactgagcgtccctctgttaaggcaggtctatcatgcctgcgtctgatttacaaaacttgatgattctaatgcatagaagaagagaaagttaatagcttttattgttaaaaaatacgtttcgtcggcgagcgcaaaaaaatgcagcagtgaaagctaaaaatggttataaatacgccagtttgccgtgcatcagggaagaaacgaatatttgaaatgcaacaaatagagcaaagggataaaatagcaaaagcgtgatgaaaatgttattttccgatgccgcactgacccgctacaatgtcagattactgccgtaaagaagtttgaggaagcaagacaatgagcaccactatcgaaaaaatccaacgccagattgctgaaaacccgatcctgctgtacatgaaaggttcaccgaaactgccgagctgcggtttctctgcccaggcagttcaggcgcttgccgcatgtggcgaacgttttgcctatgttgatattctgcagaatccggacattcgtgcggaactgccgaaatatgcgaactggccgaccttcccgcaactgtgggttgacggcgagctggtgggcggttgtgatatcgtgatcgaaatgtatcagcgtggtgaactgcagcagctgatcaaagaaactgccgctaaatacaagtctgaagagccggacgcggaataatccgtcctgcaatactgacggatgcgaacgggcatccgtcagtcctttctctatccccaatccagcccttgtggcgaacttgaaaatcccgcctcacgtaaccgcgtaaacatcggcgtttgccggaccggtaggtcattcacttctgttagcgtaaagcgcagccgtggttcgcgactggacagctgtcggctgtttaaaggcgcgaagaaaccagtcgcgggtcgccggtgaaaacacgtccggcaggggcgatgaagggtttggattatttgccattaacgctattccccgtgaataacatgcatgatgcgtagaatagcctcactatagatgcctgattcattgcatgtcatcaggcatcgactcgattacacctcttcggcggcaggcagcggccagcctcccagacgtttccagcggttgacgatttcacaaaacagcacagcagtgcgttcggtgtcgtacagcgcggagtgcgcctgggtgctgtcgaagtccatgccagcggtctggcaagcctttgacaatacggtttgtccgagtgccagcccggccagtgcagcagtgtcaaaagtggcgaaagggtggaacgggttacgtttcagtgaggcgcgttctgcggcggccatcataaagctgtgatcgaaattggcgttgtgcgccaccataatggcgcggttacagccgctcgctttaatacctttacgtacaactttaaaaatttcgtgcagcgcctcgtactcgctgaccgcgccgcgatcgggatcgttcggatcaatgccattgaaggcaagggcctctggttgcaaatttgcgccgacaaatggttcgacgtggaaatgtaatgtggtgtccggcatcagccagccttgttcatccattttcagggtgatggcggcaatctcaagcagcgcatcggttttggcgttaaatccggctgtttcaacatcgatcacaacaggataaaaaccacgaaaacggtcgcacagaccggtaagttgagcgttatcggacatctgattctcttaatacggataaattgcagcgcgcattatgacaaatattacttgtcgatgcagtaaagatgcgggcgcgatgagttcacgcccggcaggagattagttgcccagaccgcgaccggcgtctttctcttcgattaattcaattttgtaaccgtccggatcttccacaaatgcgataaccgtagtaccgccttttaccggacccgcttcacgggttacgttacccccgttttgacggattttttcgcacgcttcagcggcgttatctacgctaagcgcgatgtgaccataagcagtgccgagttcgtatttatccacgccccagttgtaggtcagttcaatcactgcttcttcggtttccgggccgtaaccaacaaacgccagtgagtatttgtattccgggttttcgctggtacgcagcagtttcatgcccagcacgttggtataaaaatcgatggagcgttgcagatcgccaacgcgcagcatggtatgaagaagacgcatctttatatcctcaaaatggctaacagattcaaaaagttgttttagtatagcggcggctttgcgccgctcgcaatgttggattacagcgtcgggtaatcagtgtaaccttcagcaccgccaccataaaaactttcggcacgctgtgggttaagctcagctttgcgctgcaagcgggcgaccagatccgggttcgcaatccagtcacgaccaaatgctaccgcatcaattaaccctttgccgatcagcgtttcagctttttctactgtgtatgcacctgcgccgataatcggaccgtggaaacgggcgcgtactttttcgcgaaacgcatcagtatatggttcacctcccgcccaatctggttctgacatatgaagataagcaatgccgcgtttacccagttgttcaatcagatacagtgcatcggcttcttcattcgggccgttatccgtgttctggaaagtaccgattggcgaaatgcgaatgccaatgcgatcggcaccccattcttcaatcccggcattgaccacttccagcaccagacgcgcgcgattttccacgctgccgccgtactgatcggtacgatggtttgaagaaggggaaaggaactgatgcagcaaataaccgtgagcagagtggagctctaccagatcaaaaccggcttcacgcgcgttagcaatggcctgacggaaatcattgacgatacccggaatctctcccagttcaagcgcacgcggcatggatgtttcaacacggatcgcctgaccattttcatcgcgcagagaagtacgtgttcccgcgctaagtgctgaaggcgctaccggtgcctgaccgccaggttgcaggctggcgtgagaaatgcgtccggtgtgccacagctgtacggccatatgaccattttcagcatgaacgccagcggtaatttttttccatgcggcaatttgttccgggctatggatgccaggtgcacctgcgtatccttttgcctgggcagaaatttgcgtggcttcgctaataatcaaaccggcactggcacgttggcgatagtattccgccatcaacggggtagggatgtcacccggttcgatactgcgcagacgcgtcagcggtgccataaaaatacgatttgccgccgtgatcgcgcccactttcagtggggaatacagtttttcagatgacataaaggctcccggtcgtctggtgataaaaaatgcctgctaaacggcaggcgtcgcaataatgttttttacatgggccagcgcgttttccagtggctcgaaactgcgcgaaattttggcctgcagattcgcgccaagccacagtgcgtaaagcacttgtgcctgttgcagcggttcgccacaaaaggttaaacaatggttctcacggccattttccagcgcctgagagagcagggcgatcacgccgcgagcccctttatccattgcgctgcgcatatcttctgacagatcgcacacttcggcagagagttttactgtcaggcaaccactgatggttccatgttggcaaaactggttcagtgtttgctggtaataagccagtatgcggtcgcggtagttaccttcgccggattgcagcaactcagtcagtcgctggtgatatgcggcgtaatggcgctcaagcatagcaacgccaaacgcttctttagaacgaaagtagtgatagaaggaccctttcggcacttcagcggtttttaggagttcgcttagccccatcccggtgaatccacgttgcaggcaaagttgctcgcccgtcgccaggagatgttcgcgagtatcatgttcggtgtgtttgttcatgcgttggagtgtagtagaccagtcggtctagtgcaagcaaagttgctactttggacattaacagcttcaataatggtaataatcttatctgaggagggcgaggtggcggagcaattagagttctttcccgtccagagcccgtgccggggaatttgccagtctgacgaacgcggattttgtcgcggctgttttcgtagccgggatgagcgttttaactggaataagatgagcgatggcgaaaaacaagaagtgttgcgcctttgtcggcagcgattaatgcgcaaattacgtgtaaataagtcagcgccatcagacgaacctgagcaaccatcactcttttgagcctaatcttgcgtatactcctctcatatctgataagaggaagcaattatggttcagcgtattactattgcgccgcaaggcccggagttttcccgttttgtgatgggctactggcgattgatggactggaatatgtccgcccgccagttggtcagttttattgaagagcatctggatctaggcgtgaccaccgtggaccatgctgatatttatggtggctatcagtgcgaagcggcgtttggtgaggcgctgaaactggcacctcacctgcgtgaacggatggaaatcgtcagtaaatgcggtatcgcgacgaccgcgtgtgaagaaaacgtcattggccattacatcactgaccgcgatcacatcattaagagcgccgaacagtcgctaattaatctcgcgaccgatcatctggatctgctgttaatccaccgaccagacccgttaatggatgccgatgaagtggcggacgcctttaaacatctgcatcagagcggcaaagtgcgtcattttggtgtatcgaactttacacctgcgcaatttgcgctgttgcaatcacgcctgccatttacccttgccactaatcaggtggaaatatccccggtgcatcagccgttactgctggatggcacgctcgaccaactgcaacaactgcgtgttcgtccgatggcgtggtcctgccttggtggtggtcgtctgtttaatgatgattatttccagccgctacgtgatgaactggctgtggtggcagaggagttaaacgcgggctcgattgaacaggtagtttacgcctgggtattacgtttaccgtcgcagccgctgccaattatcggctcaggtaaaattgagcgcgtacgggcagcagtcgaagcagaaacactgaaaatgacccgtcaacaatggttccgtatccgtaaagcggcactaggttacgacgtaccgtaagcacttttaggaatagccgccgttcaaaaatgtgtcactggtttacacttattcaggaatgcacaatgaacggaggtcctatgaaacgttttagtctggccattctggcgctggttgttgcgaccggcgcacaagctgccagtgaaaaagtcgagatgaacctcgtcacgtcgcaaggggttgggcagttaattggtagcgtcaccattactgaaaccgataaaggtctggagttttcgcccgatctgaaagcattacctcccggtgaacatggcttccatattcatgccaaaggaagctgccagccagccaccaaagatggcaaagccagcgccgcagaatccgcaggcgggcatcttgatccacaaaataccggtaaacatgaagggccagaaggtgccgggcatttaggcgatctgcctgcactggtagtcaataatgacggcaaggcgaccgatgccgtcatcgcgcctcgtctgaaatcactggatgaagtcaaagacaaagcgctgatggtccacgttggcggcgataatatgtccgatcaacccaaaccgctgggcggtggcggtgaacgctatgcctgtggtgtaattaagtaattaagaagccagcgtaccttgcggcggtgcttgctcaagttgcgaaagcgagcagtacagccgccagacaattgccgccagttctcgggcggcaggttgatgatgacgggcaaggctgtcgcaaattcgctgtaattcttcaagtgtggccgccagtgatttttgctgaacgccacgctcactcatcactccccgcaacagtgaaatacagttatcccgtactcgcgataacggatcggaacgcgattcccagtcgcgcaattgccagacaacatgagaacagttcagcaacactacaccccagcgtaataaccaacggcgagccagcgcatcctggctgttactcaactgactgacgtgatgataagtgagcgattcaaattcgctttcactcagtgttggatggcggcttagttgatcgacaaaatcccggcgtagcgcgcgaatatggcggcggcttttacgagcatccgatcctggacgcagaatggcgaacgctaaccacgccaacgcgacgccaacaatttttgccagattatcgttaagaaaatcagcaaaatcatacaccgggggattagtgacagcgataaacgaacccataaaaacaatcagttgcccccacagtgcggcaaatttgggcatctgcaatttaagaagctgcattgtcgccagcagtggaaagagaaacagtaaaaattgccacagatcgctaatctgcaccatcaggccaaatttgaccacaaagctgaatagcgaaagtaacaccagcgtgcgcatcagcagtgacaacgacttaaacggtgccgcgacggcggagtagagtacgcagctaattgctgccagcgttaaagcattggcaccggcatcccattgcgaagcaatactccatgcgccaatcatcatcaacgtacaaaatgtacgcagcccgctccacatagcttcggcgttatcggtatgacgagccaggccggatgtccgtgggagtctggcacgatcatctacaccgctttgcagacgatgtaattcctgactactttgcagataaaggcggcaaaaataacgtagtcgctgccagaaggcgacgtgccggtagtcggcgacgttggtcgggcgtagcggggagataatacgtgcgacggtgtaaacatctgtttgcgaactggcgagcgccgtcagcagctgttcgagaatttctcgcgtggcatctggcggtgagggccagttgagcaacatacgtcgcaggctggagatgacactggtcatacgtaattgctggtggagtagcgcattaaggcgcgcgttttgctggcgaaaacgatagtggctccagaaagcctggatacgcagcaaattcatggtcagtatctgcccaatcaccccttcatgtgctgcacgaatggcatcggttgtttcaggctgccagagtaaactggcatgttccagtaatcgggcgtgcatgtttttcaatgcggttaaaagggctgtagcatcggaactgctcggcaggatcatcatcatcatgccgccgcacaaaataccgactatcacctcgcaaacacgcgcctgagcgatatcccacagctggctggcctcagtaatattaaccatcggaaaggcgatgatggcagccgtgtagcccgccagttgaaatgcatacgcgacgttattcgtgaagtgcgcacaggcccaggtacaaaagccaagccacgccgacatgctcaatagaaaaaaccacggctcattgagcgtatgtccggcaagaagcagtgccgcaatggctccgagcaaactgccagcgatgcgtccgaggcttttgctgatgacaccgccaacggtgggaaagctaaccaccgcagccgaggtcatcgcccaatagggctcatcaagattcaaataataggcaaccgtcagcgccagacacatggcaatggtattgcgtaacgcataacgccattgcgccagcgtggccctgaaccagggcaaattgcgcaaggaccatgacgatgcgttcattattgacctacggcaatgctacaggtggtgcccgacaccagcgtgacatcgcctgggactttatccagcgtaaagcggacgggaacgcgttgggcgaggcgaacccaggggacgttaggtttcacatccggaataaggcttgagtcactttcaacgctctgatcataaatcgcccgaccgatactggacacgtgaccctgtaacgttttgttatcactatagagggtaatttgtgctggtgcaccttcgcggatatggcgcaacttggtttcttcaaaataaccaatgacgtaaaacgagtggctgtcgacaagggcaaacagcggtttcccggtgtcagcgtagtcgccgatgcgggtagtgagattagtcacccatccactcaccggggcgcgaatttccgtttgcgccagttgccattgtgcctgtttcagcgtcgcctgtgcggcatcaacgctggcctgcatcgctttaacattgaggttagcggtatcgagttcttcggcagaaataaaattttgtgagagatgacgacgacgattcgcttcgttattggcttttgcgaggccagattgcgctttcgccagctgagcctgtgcgttcagctcggcgatctgaaagggcgttttatcgatcgtgagcagaagatcccccgcgttaaccagctggttgtcttttatattcagctcaataatacgtcccgacacctgtggggtgatagaaacctgttctgcgcgtattttcccgtcgcgtgtccacggagattgcatgtaataattccacaaccaccatccggcaagaaccgcaactaccgctacaatgattgttgagaaatacttaattgttttaattgacatagttatcacgcaatcagtattgccagagcaaggcaaacgcaaatcgcaaacagcgataaatccattaacaagggatgccagatgtcaccggcgtagatccagcctcgaagcaggcggtgtatgacaagccagatgacgaatccaaatgcgaatgctttgaaaaacggaggaaagtagacggacgcaccgaacaccagatcttgtaagggcaatcctgttgcattgagcataaacttcacaaagtagattcctttacgacagaatatattgcgttagattaataaatattctttaagtgcgaaaaatttacgcgcaatttctgaaaaatatgtctgacggtaaccaaatgcagcaatacatttgttttagcaatacaattgctgcacactattctaaaagccgcataatatcttagcaagctaattataaggagatgaaattggaatcgccactaggttctgatctggcacggttggtgcgcatatggcgtgctctgatagaccatcgcctgaaaccgctggagttaacacaaacccattgggttacgttacacaatatccatcagttacctccagaccagtcgcaaattcaactggcaaaagcgattggcatcgagcagccatcactggtccgtacgctggaccaactggaagaaaaagggttaatttcgcgtcaaacttgtgccagcgatcgtcgggctaaacgtattaaactgacggaaaaggcagagccactgatcagcgaaatggaggctgttattaacaaaacccgcgcggaaattttacatggcatctccgcagaggaactggaacaactgattaagctcatcgcaaaacttgagcataatatcattgagttacaggccaaagggtgaaatgaagggggcgtgtg

SEQ ID NO: 10048 - DNA, 9420 bp, Escherichia coli
gggtggtgttatagcataaccgcacgatcggatcatctcgcaatgtatgctgattcgcgcgggaaatatgggtattatacgcaactcaattacccacacatgtctaaacggaatcttcgatgctaaaaatcttcaatactctgacacgccaaaaagaggaatttaagcctattcacgccggggaagtcggcatgtacgtgtgtggaatcaccgtttacgatctctgtcatatcggtcacgggcgtacctttgttgcctttgacgtggttgcgcgctatctgcgtttcctcggctataagctgaagtatgtgcgcaacattactgatatcgacgacaaaatcatcaaacgcgccaatgaaaatggcgaaagctttgtggcgctggtggatcgcatgatcgccgaaatgcacaaagattttgatgctttgaacattctgcgcccggatatggagccgcgcgcgacgcaccatatcgccgaaattattgaactcactgaacaactgatcgctaaaggtcacgcttatgtggcggacaacggcgacgtgatgttcgacgtcccgaccgatccgacatatggcgtgctgtcgcgtcaggatctcgatcagctgcaggcaggcgcgcgcgttgacgtggtcgatgacaaacgtaacccgatggacttcgttctgtggaagatgtcgaaagagggcgaaccgagctggccgtctccgtggggcgcgggccgtcctggctggcacattgagtgttcggcaatgaactgcaaacagttgggtaaccactttgatatccacggcggcggttctgacctgatgttcccgcaccacgagaacgaaattgcccagtccacctgtgcgcacgatggccagtatgtgaattactggatgcactccggtatggtgatggttgaccgcgagaagatgtctaaatcgctgggtaacttcttcaccgtgcgtgacgtgctgaaatactacgatgcggaaactgtgcgttacttcctgatgtcgggtcactatcgcagccagctgaactacagcgaagagaacctgaaacaggcgcgtgcggcgctggaacgtctctatactgccttgcgcggcacagacaaaaccgttgcgcctgccggtggcgaagcgtttgaagcgcgctttattgaagcaatggacgacgatttcaacaccccggaagcctattccgtgctgtttgatatggcgcgtgaagtgaaccgtctgaaagcagaagatatggcagcggcgaatgcaatggcgtctcacctgcgtaaactttctgccgtattgggcctgctggagcaagaaccggaagcgttcctgcaaagcggtgcgcaggcagacgacagcgaagtggctgagattgaagcgttaattcaacagcgtctggatgcccgtaaagcgaaagactgggcggcggcagatgcggcgcgtgaccgccttaacgagatggggatcgtgctggaagatggcccgcaagggaccacctggcgtcgtaagtaattgcgctattgccggatgcgagttttcgcatccggttatcgtctgcgccaccacaacattcccatcagtagcatccccggcaaccacacccacatcaattcagaaataatcacctgatgcccgtacggcgtggtgtaacgagacaatgcaaacggcgcgactttaatcacctgccagggagcgaaaaagcgttcatctgaccacggccacagccagccaacccctttaccgccagtggttaccgaatccagcaagctgtgcgatagcaacgagacggttaaaaacagccagcagcgaatcagcccagccctgaaccatcgacgtccaatcagcacacataacagcgggacaacaaacgcaaacaccagcgaatgggtaaacccgcgatgaccaaaaacattgccgtaagcaacgccaaatttaaacgacaatacatcagcatcgggcagcatcgccaggatgattccggcaaataacagacgcggagggatggctttcgaacccaaccctaaaccaatgcataggggaacggcggcgtgcgtaataacggttggcatgatggtcgcttcggcaaaatgtcgatgctatcagcatggatgaacggggcgtagagggcaaaagtctgaaaagagaaccggcctgttgatacaggccgggaaagggatcaggcaacaacctgtacgctgtgacctgcaaaactcactgtctgaccggcgacaattttgcagcgtttgcgcgtttcaaccgcaccgtcgactttcacctggccttctgctatcgcgattttcgcctgcgcgccgctttcgctccagccttccagtttcagcaagtcgcacagctcaacgtgcggatgtttacctaaagaaaatgtcgccatgttactcaccctgtggatcatgatattcaacgcacgcctgtagcgtgttttcaatcagcgtggcaaccgtcatcgggccaacgccgcccggaacaggcgtaatgtatgaggcgcgtttagccgcgtcttcaaacacgacgtcgcccacaactttgccattttccagacggttgatgccgacatcaatcacaattgcgccttctttgatccagtcaccaggaataaagcccggcttgccgacggcaacgatcagtagatcggcattttctacgtggtgacgcagatttttagtgaaacggtgagtcacggtggtggtgcaacctgccagcagcagttccatgctcattgggcgaccgacgatattcgatgcgccaatcaccacggcgttaaggccgaaggtatcaatgttgtaacgctcaagcagcgtgacgataccgcgcggggtacagggacgcagacgtggcgcgcgctggcacagacgaccgacgttgtaaggatggaaaccgtccacgtctttgtccggatgaatacgttccagcactttgacgttatcaatacccgccggtaacggcagttgaaccagaatgccatcaatggtgttgtcggcattcagcgcatcgataagctccagcagctccgcttcgctggtggtttccgggaggtcataagagcgggagacgaacccgacttcttcacaagccttgcgtttgcttgcgacataaatttgcgatgcagggttactgcccaccagcacaacggccagtcctggtgcccgcagtccggctgcaatacgcgcctgaactttttgagcaacttcagagcgcacctgctgcgcaatcgttttaccgtcaataatctttgctgccatcagagagaggattccatctgttacgtaggtcgaaggggatgcgtctattttgtcagaagcgtggcgcgctgtcagttttcgttttctgaaaagtaaaaccttctgtacctggctgattcacacctatcatgataaccgtcgttggtttgccgccatagtgagctacatcagatgcggtcgtacacttgttcagcaactggttcaaaagccattgactcagcaagggttgaccgtataattcacgcgattacagcacaccgtggtatcaatgcgcccttagctcagttggatagagcaacgaccttctaagtcgtgggccgcaggttcgaatcctgcagggcgcgccattacaattcaatcagttacgccttctttatatcctccataattccacagtgggacatatttgggacattatcaccaaaaatgtcgtctattttccttgcatgctctgtcaaatgattaggcgcaaggtgagcatacctacgaaccatttctatggactcccatccgcccatttcctgaagcacagataatgggacgcctgactggatcagccagcttgcccaggtgtgtctgaggtcatggaaacggaaatcttcaattcctgcacgacgacaagctgatagccatgatgtcttgctgtcgatgcgcatcttcctgaccgcaggcgttgatgttccatctgctcgcttagccgccttggtatgtacaaacacccatttgtgatgcttgcctatttgatcacgcaacactttacaggcggtatcgttcagcgccacaccaatggcgcggtttgatttgctctcttctggattcacccaggcaactcgtcgctgcatgtcgatttgttgccattccagatttatgatgttcgactttctcagaccagttgccagcgcaaacttgacgacagatttcagtggttcggggcactcatcaataaggcgttttgcttcctccttttccagccatctgactcgcttgtttctgaccgctggtatcttgatgacaggcgctttttccagccacttccagtcgcgttctgcagcacggagaatggcctttatcatggcaagatgctttgcctttgtctgagttgatactggctttggttcataaacaggcggttctttacctttcctgatggcggcctgaactttctgtttccatatttctttcgtctttctgttatgcattctgcttacagcagagtaaatctttgcctccgagatatctttaagccttataccctcaaaatgttcaagccagaactcaatccggcttttatctgaatcgagagattttttatcagctttttcctcaagccatcttaggcaggcctcttcaaaagtgacatcaggtaaatcccctagcttttctactcgccagagttctgcttttcgcttgtcgtgcaactcctgagcttgccgcttgtcctttgtgccaagagattccttaattcgtttcccgcccgggagcgaatacgaggcataccatatttcatttctgcggaagagtgacattttctttcctctgttatgccatcacccgcgctcacctggacagtatgcagcggagactgaagcgccgcaatgcaagcttgccgtgttgtgaggtaaggagattttggcttggttggatctttacgtgttgcctgtaggcggcctgttcgtatccagttggtggcggttggtctggatatcttaagaaactgacaggcctcatcgagtgtgaggctgtatggctccattatttcacctcttgctgtgtcattgttgaaaaatggataccagctcgttgctgccagacgatccaaccgagagtcatatcccatgccatgtattcgttatcgccgttttttactctccgacgatctactaagtcaccgaaacgcttttccatgaataattcataggcttcgcgttcatctggctctacttccagagatacgagtgcgatttcataagcacggcgctcaatatcgtctcgaacctctaggctgctgattcgttctttgatttctttaatcagttctttattggtaaatgtggtcattatgctccagcctccggtgcttttggcattactgcccagtgagtgatattgacgttttcaaggtccccgacctgaaatgtccactgccattctccggtttctttttgtccccaggtgtaccagagagaacgccagccaatcagccagccttctccattagcatcaaataacagaacactttcatttgctggtggcagttcagctgacactggtattattttgttttccagtgccgcacatttagcttcaagcgcgtcgaatttacgtaacaggtactcagcatttgtttcattcactttcagatctcgcggtacacatttcccgcgaagaaacccttccatttcgaaaacattcatgcgcatttgcgtaactccgataaatcgttaaaacgttccataaacatcccgtagacatgacccggtgccagtggaatcacgttgaacatctctgttgccgggatgccttccagtacaggccagaaagagccatcatcaagcccgagatcgcggcgttcggttgccagcatgatgagatcggcatatttcacgggtgtactcataactgggggtaacccgtatttctcacggattacggcgtctattttttcttccatccgtttatagtcaggaagaaggcgtttcagcggcgcggggatgtcctggcaatacgcttctgttgcatcatgcattaacgcttcaaaagcaaattcctgcggcaccagctggctgcaaagcaccgcatgttgggcgacactgtagaagtgtgaaagatgaccggcaaagcgacagatatttgaaagggaaaccgcgatatcgttaatcacgatgtcgtctttatttatcctgtcataataaaaatgcttcccggaaaaagttttaataaatgacattttgttctccgcgtatatgtgctgcaccacgctgaattctggtaaaaggaagccctcaccatccggcgattattgagtcaattacgtttccataaatgcccccgcaggggcatttgcagtaatgaaatcaggcggtgaaagtaccaataaaggtttctactttgctgtctttgaatttctcaacaagcagatcacgaaattcgttagccatttcttcctgcactgcttccagctgaataatgcgcagaaccagtacaggacgatcgccagtgataatgctgaggcgtaatttaaacggacgttctttcaggccttcaaacggaacgcatttaaattcaaatgccactggcataatatctttggttttcgcttcgacagactccatcagggagcgtttgccgctgaagtcattgtcttcaaaatcagcggtctggtttgcttcaatcgtgattttacggacagccgcagccgcttttgttgcctgaatggcgtcaccattagcatcaaagcccacaaggtagtcggcccagtcttcaatccattctgccagtgacttctgggagttacgctcgccgttaacagacaacagagcagagaacggtgctgtctttttcagtttgagagtggcggtgttatctgcgtgacctggttcatcaatagtacccaggttaagcacactgacggcacgcatattatcggcatcgataaagcagcgggtgccttcatctgcaagatctttagaataacgggtaaagtcatcgatgctggcagtggaaagcgcaccacggaaacggaagcgatttaaattaaatttttccagatcatgaatgcggaaattctcaggcaatgccacagcatcggcaccaatcttactgataatttcattaacaccctgagcagaaataagggcatggatttgattaattgcggttgcgtctaagttctgagacataataagtcctcactatataaagatattcagtgatgagataaataatcagtttattacgaacgatattaacgactgctgcgcggagttttccgtcaggttcaccggcaagagtcagtaattgtccctggtcttcctgcagaatagtcaggcgaccaccgcgattgacatacatcggcgtttcggtggtgtcttcttcggaaattttcccgcggttagttgggcgaacatatgagagtttgtgtttgattttcacacggttctcatcaaacggttcgatttccagattgagtgagaccttccctttggttttcgtgttcatcacaccggaagcgacctcactgagaactgcgccgattttggtttcaaatacgccgccgtccagctccccgataaatgcctgcacatcagtactgcgttcgctagccattttgctgctcctcatcatatcgaccctgcaaggtcggttggtttctccacaaaacagagaagaacacctgcggtggcagccgcccggatggattgggttatgagcccgtcgtccggtgatgctcttctctgttttgcaaaaaaggacggtaccagccggaagcaagggtacaaactggtaccgccaggactacacacagcataaagttgtggtgccgggtgcctcccggtgcctggcgaaggttgcacaccaggcgggtgggtatccacagaaggtcgactgtcagcctcaaccttaacccgcgtgcgctgagccgcattcaccacaacgctaaggattctctctggttgaaaatacttagctgttatgtgcctgcttttagccacatcaggcgaggtggacctggttattccccaacaacaaggattcggttaatctggatatccccaacaacaataagagtattcaatgtgatcgctgaattaacggcagcaatgacggctattcgtgaaacagcccagattgcaaaactaatgaacgaggcaaaaactcaagctgaagtaaatgcggctattggtgagctgaactcaaagcttgcgtctattcagcgcgaatgcgtgtctctcgttgaactggtgggctcttatcaagaaataaatgcttctctcaaagctaaaattgcagaattcgaaaactttgaggctcagacggaaggctatatccttaaccaacttgagtcgggtacttttgtatactcgaaggaggtaatcgtgaacggtggcagcataaccatgcatctttgcccaaaatgttttggacaaaagatagtatcgatacttcaaccattcccggttagcgaagatgagctttttcataaaagcaggtgcctccactgtgaaaataagtttctgatgaataaaaatccggattacgtatcgcctccatccattgaggagttgtccagaaaacttaacggcaatctgtagattactactgttgtggatatccagattgttaaagagctaagcgtcctgtagggcgcttttttgttgctaacgaatcatccggtcattcatacgccaccggcggctacttcgtgggcgtcctgcctgtccgtgatagcttacattatgttgctacttaaagtagcaaaaatcaacaacaaaaagtagatatttgttgttgtctatgatttttctataattaattgaaagttaaatgtttttgctgatttactatgctgtaaactgaaaatatcgcacgaagttggagtaggtattgagcatagtgaattatgaggagggagttttttatgagattaatcagggagaaagaagagtaaagcccggttatgcggccgggcacatgcattactttgtaagttctagaactcgttgagccagccctttaaattgttcgttaaaggcgtctctgcttgatttcattgtatttaaggcatgcccaaattgccctgaatcgcgaatttgctgatcactgatggagaaaacaggtgtcgctagttgttggcttattgcgattaatgagttgaaatcggaaatatgcgcaagatcataggctgataaatctccactgactgttgttttgttaattgcatgttgcactttatctcgtggaattatgcaggtaattttttctagatttggcactaagatcgaatcaacagcatcacggatagctgccatccatttttcgaaagattttacaggtgctcctttacgcggcctgtatctctgctgaatcatacctagaaactgcggtgcatttttaattgattgtgaagagttaccatcattattttctttaaataatgctaattctttgtg

SEQ ID NO: 10049 - DNA, 8829 bp, Escherichia coli
tcttatccgtggaatcgaacgcgcactactggctggttaccaacctgtaccagaacatgcgggccaatgcgctgactgacgcggaattacgacgcaaggctgccgatgaactgacctgtatgacagcgcgaattaaccgtggtgagacgatacctgaaccagtaaaacaacttcctgtcatgggcggcagacctctaaatcgtgttcaggcgctggcgaagatcgcagaaattaaagctaagttaggactgaaaggagcaagtgtatgacgggcaaagaggcaattattcattacctggggacgcataatagcttctgtgcgccggacgttgccgcgctaacaggcgcaacagtaaccagcataaatcaggccgcggctaaaatggcacgggcaggtcttctggttatcgaaggtaaggtctggcgaacggtgtattaccggtttgctaccaaggaagaacgggaaggaaagatgagcacgaacctgatttttaaggagtgtcgccagagtgccacgatgaaacggatattggcggtatatggagttaaaagatgaccatctacatcactgagctaataacaggcctgcaggtaatcgcaggcctttttatttgggggagagggaagtcatgaaaaaactaacctttgaaattcgatctccggcacatcagcaaaacgctattcacgcagtacagcaaatccttccagacccaaccaaaccaatcgtagtaaccattcaggaacgcaaccgcagcttagaccaaaacaggaagctatgggcctgcttaggtgacgtctctcgtcaggttgaatggcatggtcgctggctggatgcagaaagctggaagtgtgtgtttaccgcagcattaaagcagcaggatgttgttcctaaccttgccgggaatggctttgtggtaataggccagtcaaccagcaggatgcgtgtaagcgaatttgcggagctattagagcttatacaggcattcggtacagagcgtggcgttaagtggtcagacgaagcgcgactggctctcgaatggaaagcgcgatggggagatcgggctgcatgactatcaaatcaaatacgccagcacacgacaaggactgctggcaaacgccgctttggctttttgatgcactggatattgagtttggattctggctggattcggcagcgagcgacaaaaatgctctgtgcgctcactggctaactgaggacgacgacgcgctcaattctgagtgggtaagccacggtgcaatctggaataacccaccgtacagcaatatcaggccgtgggtggaaaaagccgctgagcagtgtatacaacagcgacagacggtagtgatgcttgtgccagaggatatgtctgtcggatggttcagcaaggctctggagagtgttgacgaagttcgtattatcactgatggacggattaattttatcgaaccatcgacagggctggagaagaagggaaacagcaaaggctccatgctgctgatttggcgaccgttcatcagtcctcgacggatgtttactaccgtatccaaagcggcattgatggcgatcgggcagggcgtcaggagggctgcatgagacgacagcgacgaagcatcaccgacataatctgcgaaaactgcaaataccttccaacgaaacgctccagaaataaacgcaagctaatcccaaaagaatctgacgtaaaaaccttcaattacacagcccacctgtgggatatccggtggctaagatatcgtgcgaggaaatgacaatggattattcacagttaagtgattttgaaattaacagaatggtaggagacataatttttaaaggcctttgggcaagtaaaccggaaacatcagggaataacaccaacaaatggtattacggaaatgctgatacaacttttgagccattaaatcatttgcctgactactgcaatgatccgagcgcttcatggccgattattgagaaatacaggatttctatcttagaccagttaactgaatggtgtgtggatgcaaaaggcgtaagcccaatatttgataccagacctctccgcgccgccatgattgtctttctcctgatgcaggaggccaataatgcttagcccatctcaatcccttcaatacctgaaagaaagcatagagcgggcttcaatgtgcacagagtggattctatctaggtttagcgcatacagaagattgccggtaaagggcatgccaagcaagtcgatgctgcatatgcaaaagaatgcgcgctggaaggtatggcgagaacacaggttatgtggctgaaagagggggttattaaggcgtgaatacctacagcatcacattaccctggcctccgagcaataatcgctattaccgccataatcgcgggcgcacgcacgtcagcgcagaggggcaggcataccgcgataacgtcgcccgaatcattaaaaacgcaatgctggatatcggcctggctatgcctgtgaaaatccgcattgagtgccacatgccggatcgccgtcgccgtgacctggataatctgcaaaaagccgcttttgacgcactcactaaagcaggtttctggctggatgatgctcaggtcgttgattaccgcgttgtgaagatgcctgttaccaaaggtgggaggctggaactgaccatcaccgaaatggggaatgaatgatgtttgagtttaatatggcagaacttcttcgccaccgctgggggcgtctgcgcttatatcgtttcctcggttctgttttgaccgattaccgaatactgaagaattacgccaaaaccctgacaggaacaggagtatgaagtcagagataacaatcaactaatactgttttgttgatttttgcttgtaattggcgttctggtctgatttttgtggagtaagttgatgcgtgatattcagatggttcttgagcgttggggtgcgtgggcggctaataatcatgaagatgtgacctggtcgtccattgccgccggttttaagggattaattccttcaaaagtaaaatctcgcccgcaatgttgtgacgatgacgcgatgatcatttgcgggtgcatggcccgtctgaaaaagaacaacagcgatttacacgatttattagtagattattatgtatgtggtatgacattcatgtcactggcaagtaagcattgctgctcggatggttatatcgggaaaaggttacagaaggctgagggcataattgaagggatgttaatggcattagatatccggttagatatggatatcgttgctaataattctaattgatatgcaattgtttactaaaagttattaaaaatggggcgtggaaacgcccccaaaataaagggtaatatataacagaaggtttatatagtaagaagcaaggtagtgcttctaaaggaagtggcttgagggctccacttatatgttgcggaggcaaagcctcccgcaacatatctttttcgtaagtcagattagaactgataaaccagacctacagcgacgatgtcgtcggtatcaataccagctgttttggtaaacttactatcgtcaattaagttgattttgtaatcaacaaaagtggacatgtttttattaaagtagtaagtagcaccgacatcgacatacttgactaagtctcggtcaccatgaacaccaaggtctttaccttttgactgaaggtaagcaacagatggacgcagaccgaagtcaaactgatattgtgctactgcttcaaagttttgtgctttgtttgcaatatggttattaccaaaaacggtcatattctgagtttcagaatatgtggtagccagatagatattgttcgcatcatatttcaggcctgcagcccatacttccgcatttttgccggaggcattgaatttgctcttaccataggcgacctgaccgtcagtgcgatctgatttagcataggttgcacccacgccgaatccttcatactcataagtagtggagaaaccgaaaccatcaccattggcttcagttacgtcagtgcggtcatttttaccctgatactgagcagcaaagttcaggccatcgaccagaccaaagaagtcgttgttacgataagttgcaacaccagtagtgcgaccagtcatgaacacatctgtttgggtccaggtatcaccaccgaattctggcagaacgtcagtccacgcaccgatgtcgtatgctacaccgtagttacggccgtaatcgattgagccgtaatcaccaaatttcaggcctgcaaatgcaagacgggttttgtctttggaagaaccttgagattcagcacggttgcctttgaattcatattcccactgaccgaaaccagtcagttgatcgttgatttgggtttcacctttgaagccaagacgggcataagtagtatcaccatcatctgcatcattagaggagaagtagtgcttggcattaactttcccgtatagatccagcttgttactgtctttattataaatttcagctgcctgagcagacatcgccatcagtactgatgcagctacagcagaaattgccactgttaattttttcattgtacgccctttttttgaactattattaaaaaatgatgtcactgcgcgataaatattcatctaatcaatgtgattatttcaagatgtaagttttagtttctcatttaatttgtgaagtagatctctatttttatctgaaccttttctatctaatcctattcatggctcttgtctgaacaaaaataaatctattagctaatttatattaatggcacttatttataagtgctctataattctttagcttaatttaaacaaactaaaaataacatcggaaattattaactggttatttgttgaagttttcttatgcatttgtggtggtgttttgaacactcggtggcattctcacaaatatcatttagtagtttacgtacgtaaaaaattggttatgctgttaagagtggttacttcgtcacacagcttaaacccgccgtcgagcgggtttttccattttttgagtctcgatattagctgataacccaatacctgagttattcactgactccgaatctgttacgtttctgcctttattgcgatacgtagtatccccttaatttacacccgctttgtctgcgaggtggggttatgaaatccatggataagttaacaacgggtgtcgcctatggtacctcagcaggtagtgccgggtactggtttttacagttgctcgataaagtcacgccctcacagtgggcggcaataggtgtgctgggtagcctggtatttggcctgctgacgtacctgacaaacctttatttcaagattaaagaagataagcgcaaggctgcgagaggtgaataatgcctccatcattacgaaaagccgttgctgctgctattggtggcggagcaattgctatagcatcagtgttaatcactggcccaagtggtaacgatggtctggaaggtgtcagctacataccatacaaagatattgttggtgtatggactgtatgtcacgggcatacaggaaaagacatcatgctcggtaaaacgtataccaaagcagaatgcaaagccctcctgaataaagaccttgccacggtcgccagacaaattaacccgtacatcaaagtcgatataccggaaacaatgcgcggcgctctttactcattcgtttacaacgtgggtgctggcaatttcagaacatcgacgcttcttcgcaaaatcaaccagggcgatatcaaaggcgcatgtgatcagctacgtcgctggacatatgctggcggtaagcaatggaaaggtctcatgactcgtcgtgagattgagcgtgaaatctgtttgtggggtcagcaatgaacagagtaaccgcgattatctccgctctggttatctgcatcatcgtctgcctgtcatgggctgttaatcattaccgtgataacgccattacctacaaagcccagcgcgacaaaaatgccagagaactgacgctggcgaacgcggtaattactgacatacagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcagtgcagatagagctgcccatatcgatgggcaactcatgcaattattgtgagcaatacacacgcgcttccagcggagtataaatgcctaaagtaataaaaccgagcaatccatttacgaatgtttgctgggtttctgttttaacaacattttctgcaccaccacaaatttttgctgcatcgacagttttcttctgcccaattcccgaaacgaagaaatgatgggtgatggtttcctttggtgttactgctgtaggtttgtttccaacagtaaacgtctgttgagcacatcctgtaataagcattgccagagcggcagaaaacaacatttttttcatcttattatcctgcattgttaaaaacggcagaatcctatgtgacaacaattaaacgatagttaaatggattgatgaaaattaaaactacacaggtgggctcagactattggaggaagttggggacactcagaatcctgtggaatgaaataaaccggtctatccgtccattacccttttagctgcgctgtatcgtcgccgtattcccgcattaaccatgaccgtagcccgacggggaattccttctgcgtgagtgtgcgggaataattaaaaacgatgcacaccgggtttttaccgcgttaatgattcgcgggtttatcccggtgcgatggtggaagaaacaggaagctgtattacagaaagtgctactactgtatcccgatgcgatgtatgtaatgtgagtcagataatggcacaggatgtggtgatgtggcagtctggaacacaggatatattgtcagaataagacccgtaggaataaaaatgaaaagacgccttttactactttttctgttatctgtcctggcagtgggatgctcgcagcaaaaagctgatgagccccggcaattagtgacggtgtatccacgatatccggaatatgctgcagcaaattatatcaaggggctggttgaggttaagttcgatattggtgctgatgggactgtgacacggatcgtttttctccgctcagagcctcataatttgtttcgtgatgaagtggtgaaggccatggcgaaatggcgatttgaaaagaatcgcccctgtcagggagtgaagcgacaatttatctttacgccgtcacgtccctgatgcttccaggtagagaggggctggaagcaggagaaaaatgaaagagccagcggttatatttttgtcatggctgacgaggaatgatggaagaaggcgttgtatgccacacaacgcctcactgttcatttcttctttttctctagtggaacccgatgaataagagttgcactggtttccgatgagatggcgatatactcgggcaaagtatgctggcagttttccaactggtcaaaaatacctgctctcgtctgttgcaatgcctgcagcatgcggcggcaatgcgccttgcttttactaaccatctttccttcctctatcagtcgctgcgtgaactcatcatggaataccaggtaaatgcggatgttatcggttttggctacgcagcatagtacaaaacggacaggtgcatcccgggacgggggaggcgtcacatgtccctgtgatggttgttccgggtaatgtactgtgtggggcataaaaatgtccgataattttactttctaccgcagttagttgattcgttggtcctggtagcacattgggcgaggatttaaatgccaggcaactgaaggatgatgtcgcaagggagatagcgagaatatttctgattttcatttgatgatgcctctgtgtgaaatgacggtaaacgacgcacttgtgccggcacataatagcaagcaccataatagatcagattcgattcttgctgtaagtgataattattctcgttttcgggtcctttccgtcgatccaacaggttacggggcggcgacctcgcggtttttcactatttatgaaaatttttcagggaaaatcgtgtcggtacttctcgaatataactttttgttttttttaatattgcatccgtaaaggtccgacatgaaagtgtccgaaaatgcctttttctggcgttttcatgtcgggccttgtatttgataatgggttgttttcatgaaggttaataaaaagaggcttgccgaaattttcaacgtggacccgcggacgattgaacgctggcagtctcagggactcccttgcgcctccaaaggtagtaagggcattgaatctgtatttgatactgccatggcaattcagtggtatgcgcagagggaaactgatatcgaaaacgaaaagctccgcaaagaactggacgatttgcgtgcggcagcggagtcagatttacaacccggcaccattgactatgaacgctaccggctcacaaaagcgcaggcagatgcgcaggaactgaaaaatgcccgtgaagacggagtggtgctggaaactgaactgtttaccttcattctgcaacgtgtggcacaggagatttcggggatacttgtgcgtgtgccgttgacattacagcgtaaatatcccggacatt

SEQ ID NO: 10050 - DNA, 6772 bp, Escherichia coli
cttcacggtagcgcgtttccgggttaccaatcagacggataacgccgtctttcagatccttcatgccgccaacgtaatcacggacggtaaaatctgccacgctgtaatacaggctgttgatagtgaaatcgcggcgctgggcgtcttcttcgatggagccgaaaatgttgtcgcgcagcaacataccgttttgcccgcgttgggaggtcgtgcggtcgctgacgttaccttcgtgatgtccacggaaggtcgcaacttcgataatctccgggccaaacatcacatgagccagacggaaacggcgacccaccaggcggcaattacggaacagtttgcgcacctgctctggcgtggcgttggtggtcacgtcaaaatctttcggctttttgccaagtaacaggtcgcgcacgccgccgccaaccagccaggcttcgtatcccgctttattgagcctgtacattaccttcagggcattttcactgatatctttgcgggaaatagcatgctgctcacgcgggatcaccgtcacctgtggacgggcgactgcctgttcagcctcgctttcctcgcggcttagcaccttgcggcaaaaattagcgactcgggtaaaaatagtacacctcggtagtgtcaaacatcattcaggacaaaaaaatagcggctaatcatagctcagcatgacgcatttgagaatgttgaatttacaattgccgactcaggcacggcggtcagcgtccagtttttgacggctgactgaaggatttgctcgacgctgaaatcctgccagtgtgtttctacctgctgacccagaaaatgaagtgccgcgattaacaccgggcgcggatcgcctttcggcaacgcaggcgcatgattctgcttggaaagtttagcgccttgtggattaagcgccagcggtaaatggatgtaatctggcactttccagccaaaaagctggtacagcgagatttgccgcaccgtcggttcgatcaaatctgccccgcggacaatttcgctcacgccctggaagtgatcatccaccaccaccgccaggttataggcaaacaaaccatcacggcgatgaataataaaatcttcccgtgccagtttttcgtcggcgtgaataatgcctcgcagcagatcagtaaactgggtgaccggatgctgctggcggatacgtactgcggcgttgtctggtccatgatgcaaatcccggcaatgaccgtcgtaaataccgccaatgctttgaatacgcgcacgcgtgcaggtgcagtaataacttagtccttgctcatgtaaccaggcgagtgcttcgcgataggcgtggtgacgttgcgattgccagagaacgtcgccgtcccagtgcaggccgtaatgttccagctggcgcaggatagtttctgcggcaccgggaacttcacgaggcgggtcgatatcttcaatgcgtaccagccagcgaccttgccgggcgcgagcctgcaaatagctgccaagcgcagcaatcagagaaccaaaatgaagctcgccggaaggagagggggcgaagcggccaatatagtgtgtgtctgtcatctctttgaacaaaaaataaggcgggagcatttcccgcctgtggtaaacgtgatggaacggctgtaattagccagccatctgtttttcgcgaatttcagccagcgttttgcagtcgatgcacagatcggctgtcgggcgcgcttccagacggcgaataccaatttcaacaccgcaggattcgcagtagccgaaatcttcgtcttccacttttttcagcgtcttctcgatctttttgatcagcttacgctcgcgatcgcggttacgcagttcgaggctgaactcttcttcctgggctgcacggtctaccgggtccgggaagttggctgcttcatcctgcatatgtgtaacggtgcgatcgacttcatccctgagttgattacgccatgcttccagaatacgacggaagtgcgccagctgggcttcattcatatactcttcgcccggcttctcctgatatggttccaccccagcgatggcgagaatactcagggacgatgttttacggttttgcccttcttgcatgttgcttctccttaacacgcactatcgatccccatgttcgggggaaaaatgaggccgctataaatagcagatgcttttccggatagcaattatctaaacgtaacacttgacaactgtgtgaggaaaagcgtatttgcgcacgcgaccagaatgtaaattaaccagttacttactctactacaatgtaaccggtagtgattttttaagagccatgccttcggcagaaagttccgctttgtaagccagaatttctacccccctctgttgagcttctgacaatagttgcgcgtatttctcatcgatgtggcgcgcgggtgaaaaccgtgtaatggctgaatgcagcacggcgaaaaagataaccgcacgctggccttcagccgctacgctcatcaactcccgaaggtgtttctgacctcgttcagtgaccgcatcgggaaaatatccctgttcgttctccgctaacgtaaccgatttcacttcaatatagcagtctggacgcgaatccgcctgcaacataaagtcaatacggctgcgttcggcgccgtattttacttcgcttttcagcgagctatagcctgccagctctgaaattgattcattaaggatagcctctttcgtcaacctgttagcccaaagcgtattgacgcaaataattgcgccgctctggctttgagttaattcccaggtgtgtgggtatttccgtttggtgttgtctgaagtcgaataccagacggtatcgccaggcgttgcacaaccggtcatcgcacccgtattcgggcagtgtagcgttaattcgcgaccatcgggtgtgatcacatcggctaaaaaacgtttgtaacgctgaattagcgtcgcgcgctgtagagggggagaaaattccattgcgacaatccttgttattgcgttagcgcccagcgttttagcggcgtgtagcgtgtgcgtccacgggcaaacgaggaggcgtaaagggtgaactccgtcaccgtatacgaccagttaaaacctggcggcgggattgtcaccgcctcgctggcgtcgcgcaataaggtaatatgtggatgaaacggacgattgctttgaaaacaaccgctgcgggcagcctgtgaacggagcatattcgccagctggattaagccgcgtggcggctgtcgcatccctaaccacaccacacgcgaacgcagccattgaccggcgtcatcaagcgtgagtgtgaaaccaggttgacgaatccgtccggctaaaagagaaagcgccttctctttctctgcgctcacttcgcctaaaaatgccagagtcagatgcaaattatcggcggcgaccggacgtcccgcctcaggtgggaagtgtgtggcgcgccagcggataatctgttcgcggatttctgcaggtaagtcgatagcaaagaacagccgttgcggttcagacatgtgaggcactcggttatgaattaccgcgatgctacaatgtggcgcgaagaatgttaaccctctggagcgttttgtgtcgtcgttgcccgttgctgccgtcttacctgagttacttgctgccctcgatggtgcatcgcaggtgttattaagtgcgccgaccggggccgggaaatcaacctggctgccgctgcaactgctggcgcatcccggcattaacgggaaaattatcctgctggagccgcgtcgtctggcggcgcgtaacgttgcgcaacgactggcggagctgcttaacgaaaagccaggcgataccgttggctaccggatgcgtgcgcaaaactgcgtcgggccgaatacccgcctggaagtggttaccgaaggcgtgctgacgcggatgatccagcgtgacccggaactgagcggtgttggattggtgatccttgatgaatttcatgagcgcagcttgcaggcggatttggcgttggcgctgttactcgatgtgcaacaaggtctgcgtgatgaccttaaactgctgattatgtcggctacgctggacaacgaccgcttgcagcaaatgctgccagaagcgcccgtcgtcatctcagaagggcgctcgtttccggttgaacgccgttatttgccgctgcccgctcatcagcgttttgacgaagccgtcgcggttgccaccgccgaaatgctgcgtcaggaaagtggatcattactgttatttttacctggcgtcggagaaattcagcgtgtgcaggaacaactggcttcacgcatcggcagtgatgtgttgctctgcccgctgtatggcgcgttgtcgctgaacgatcagcgaaaagcgatcctcccggcaccgcaagggatgcgtaaagtggtgctggcgaccaatattgctgaaaccagtttaaccatcgaaggtattcgtctggtggtggattgtgcccaggagcgtgtggcgcgttttgatccgcgtacagggcttacgcggctggttactcaacgcgttagtcaggcgtcgatgacgcaacgtgccgggcgtgccgggcgtctggagccgggtatctgcctgcatttaatcgccaaagaacaagcagaacgcgctgccgcacaaagtgaaccggagatcttacaaagcgatctttccggtttgctgatggaattactgcaatggggatgcagcgatccggcgcagatgagctggctggatcaaccgccaacggtgaatctactggccgcgaaacgcctgttacggatgctgggggcgctggacggtgaacggcttagtgcgcaagggcaaaaaatggcaacgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaacccgcctggcagcaacgtagtcagcaactgttaaaacgcttaaacgtacgcggcggtgaggcagacagttcgcttatcgcgccgctacttgccagagcgtatgccgatcgcattgctcgtcgccgtgggcaagatgaacgctatcaactggcgaacggcatgggggcgatgctcgatgccgacgatgcgctaagccgccacgaatggttgatcgcaccgttattattgcagggcagcgcctcaccggatgcacggattttactggcgctgccggtcgatattgatgagttagtacaacgctgcccgcagctggtacagcagtctgacactgtggagtgggatgacgcgcaaggtacgctgaaagcctggcgtcggctgcaaattggtcagttgatggttaaagtgcaaccgctggcgaaaccctcggaagacgagttgcatcaggcgatgcttaacggcattcgtgataaaggtttaagcgtgctcaactggacggcggaagcggaacagctacgcttgcgtttgttatgcgccgcaaagtggttgccggaatatgactggccagcggttgatgatgaaagtttgttggcgacgctggaaacgtggctactgccgcatatgacaggcgtacattcgctacgcggcctgaaatcactcgatatttatcaggcactgcgtggattacttgattgggtaatgcagcaacgtctggatagtgaattgcctgcgcattacactgtgccgacgggaagccggatcgccattcgttaccatgaagataacccgcccgcgctggcggtgagaatgcaggagatgtttggtgaggccactaatccgactatcgcccaggggcgcgtaccgttggtgctggagttgctttcccctgcccaaaggccgctgcaaatcacgcgtgatttgagcgccttctggaaaggagcgtaccgtgaggtgcaaaaagagatgaaagggcgttatcccaaacatgtctggccggacgacccggcaaacaccgcaccgacgcgacgaacgaaaaagtattcgtgaagaccaaagcaaatttgagagatatcttcttctgtcttgcaacagaagaacagaaaatcgggcttttgcgcctgaatattgcggagaaaaagcatggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctgctgctaaaactggctatcgtttttgccgtgctgatcgccatttacggcgtttatctcgatcaaaaaattcgtagccgtattgatggcaaggtctggcaattgcccgcggcagtttatggtcgaatggtcaaccttgagccagacatgaccatcagcaagaacgagatggtgaagctgctggaggcgacccagtatcgccaggtgtcgaaaatgacccgtcctggcgagtttaccgtacaggccaacagcattgagatgatccgccgtccgtttgatttcccggacagcaaagaagggcaggtgcgcgcgtgtctgacctttgatggcgatcatctggcgacgatcgtcaatatggagaacaaccgtcagttcggtttcttccgtcttgatccgcgcctgatcaccatgatttcttcgccaaacggtgagcagcgtctgtttgtgccgcgcagtg

SEQ ID NO: 10051 - DNA, 6586 bp, Escherichia coli
gcattctatggagacatgcgagttcatgcaactaaaaaattgcataatttgttttattggtcacattttatgcgacacgatgaagaaacagccgaacggagggcagattagcacactttttcaacatcattgtgctcaacaatgtgctcctgctaaaccataattctttttatcagatggaatatctgtcacattgcttttcaacgatagcttcctgggagagattttttcttattattcctccccatctggtgttaccctcctgcccattaacccattcaacagaactgtgacgcgccatggcaaatatcgctttgccgatagagctatgaccgccagaaacatgcttatgagtataaaagagcaaacgttaatgacgccttacctacagtttgaccgcaaccagtgggcagctctgcgtgattccgtacctatgacgttatcggaagatgagatcgcccgtctcaaaggtattaatgaagatctctcgttagaagaagttgccgagatctatttacctctgtcacgtttgctgaacttctatataagctcgaatctgcgccgtcaggcagttctggaacagtttcttggtaccaacgggcaacgcattccttacattatcagtattgctggtagtgtcgcggtggggaaaagtacaaccgcccgtgtattgcaggcgctattaagccgttggccggaacatcgtcgtgttgaactgatcactacagatggcttccttcaccctaatcaggttctgaaagaacgtggtctgatgaagaagaaaggcttcccggaatcgtatgatatgcatcgcctggtgaagtttgtttccgatctcaaatccggcgtgccaaacgttacagcccctgtttactcgcatcttatttatgatgtgatcccggatggagataaaactgttgttcagcctgatattttaattcttgaagggttaaatgtcttacagagcgggatggattatccacacgatccacatcatgtatttgtttctgattttgtcgatttttcgatatatgttgatgcaccggaagacttacttcagacgtggtatatcaaccgttttctgaaattccgcgaaggggcttttacagacccggattcctattttcataactacgcgaaattaactaaagaagaagctattaagactgccatgacattgtggaaagagatcaactggctgaacttaaagcaaaatattctacctactcgcgagcgtgccagtttaatcctgacgaaaagtgctaatcatgcagtagaagaggtcagactacgcaaataatttaaaggggagttaatgctcccctttcttatttttctgcactacgcagggatatttcaccgcccatccagggttttattattccatcctgctcaagtaataaagcaccctgtttgtctattccgcgtgaaatgccaaatatttctttatcaccaatgataagtttcactgggcgattaataaaattatccaacttttcccagcgcgaaagataaggtgtcaatccttcttgctcgaagagttccagcgccgcgcgtaattcacgtatcagcatggccgcaagagtattacgatcgagattgatcccggcttcctgcagcgtgatccacccttgattaacgacactctcttcaacacgacgcattgccatgttgatccctgcaccaatgactatttgcgccgcatcgccggttttgccagtcagctccacaagaatgcctgccagcttgcgatcctgcagatagaggtcattaggccatttaacacgaactttatctgcacccagcttgcgtaatacttccgccatcacgataccgataaccagacttaaaccaatcgccgccgccgggccctgttccagacgccagaacatcgacaaatataagttcgcgccaaaaggcgaaaaccatttccgaccacgacgaccacggccagcatgctggtattctgcaacacaggcatcgccagatttaagctctccgatgcggtccaggagatactgattcgtggagtcaataactggcagcacggctacactgccgtcatccagctgactcaatatcttttcggcattaagtaactggattggctcgggcaagctgtatcctttacccggaacagtaaatacatcaacgccccagtcacgcagtgtctgaatgtgtttattaatagccgcccggctcattcccagcgtttcacccaactgctcgccagagtgaaattcgccattcgctaacagggcgatcaatttcagtggcacggtgttatccttcatgaaattgtctccactgcgctcacttcacctgatgcaccaataaagcggacttcaggctcaagccagacattaaatttttcacccactttttgtcttacatgatgcgccagctgtacaacatcttcgctttttgcatcgtgctcatttatgagaaccagcgcctgttgacggtgtaccgcagccccaccaatttgcgtccctttaagctggcactgatcaataagccaacccgcggccagttttactgaaccatccacctgggggtaatgtggggctgttggaaattgtgccaacaacgcgttagcagtttcggcagaaacaacaggatttttgaagaaactacccgcattaccgttcacttttggatcagggagtttggtggtgcgcatatgacacaccgcatcaaatacttgctgtggcgttaccgttgaaggatccaggcgagttaagtcaccatacgtcagtacaggttgccactcttttggcagacgcagacctacggctacaatggcgaagcgatcctggtattcatgtttaaaaatactgtctcgatagccaaaacggcactctttggcagttaagcgtacttgcttgcctgtcgccagttcaacacaatcaacataagcgcaaactcgctgtaattctacgccataagcaccaatattctggataggtgatgagccgatacaaccaggaattaatgccagattttccagaccaggcataccttcctgcaaagtgtattttaccaggcgatgccagttttctccggctcctacatgtaaataccacgcatcaggttcatcatgaatttcgatacctttgatccggttgatgatcaccgtgccgcgatagtcctccagaaaaagtacattacttccttcacccagaataagaacgggttgtccttctgcggttgcatgctgccaggcattgagtaattgttgttcgtcttcggcacatacaatgtgctgagcattatgatcaatgccaaatgtgttccagggttttaaggagtggttcatagctgctttcctgatgcaaaaacgaggctagtttaccgtatctgtggggggatggcttgtagatatgacgacaggaagagtttatagaaacgcaaaaaggcccagtcttccgactgggcctttcgctaaatttgatgcctggcagttccctactctcgcatggggagaccccacactaccatcggcgctacggcgtttcacttctgagttcggcatggggtcaggtgggaccaccgcgctaaggccgccaggcaaattctgtttcattaacccgcttgtcgccggttaatctaatctgtatcaggctgaaaatcttctctcatccgccaaaacatcttcggcgttgtaaggttaagcctcacggttcattagtaccggttagctcaacgcatcgctgcgcttacacacccggcctatcaacgtcgtcgtcttcaacgttccttcaggactctcaaggagtcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggccaacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcgttaccgctaaccccatcaattaaccttccggcaccgggcaggcgtcacaccgtatacgtccactttcgtgtttgcacagtgctgtgtttttaataaacagttgcagccagctggtatcttcgactgatttcagctccacgagcaagtcgcttcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgtcgcttcagcaccgtagtgcctcgtcatcacgcctcagccttggttttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcaaccctcacaggccaccttcacaggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcaccccataaagaggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacaatatgtgcatttttgtgtacggggctgtcaccctgtatcgcgcgcctttccagacgcttccactaacacacacactgattcaggctctgggctcctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcacctcaccgacgcttatcgcagattagcacgtccttcatcgcctctgactgccagggcatccaccgtgtacgcttagtcgcttaacctcacaacccgaagatg

SEQ ID NO: 10052 - DNA, 6341 bp, Escherichia coli
cacgggcacgttttgatttttatcaggcgcgatcagcctggtcacgggcagagtggattggtgccggaagaatggccattgacgggctcaaggaagtccaggaatcagtgatgcgcattgaggccggactgagcacgtatgagaaagagctggcgctgatgggcgaggattatcaggacattttccgccagcaggtcagggaatctgctgagcggcaaaaagccggactctcacgtccggtgtggatagagcaggcgtatcagcagcagatagcggagagtcgtaggccggaagaggagacaacaccacgtgagacgtaatctttcacacattattgccgcagcattcaatgaaccgctgcttctggagcccgcctatgcgcgggttttcttttgcgcgctcgggcgcgagatgggggcagcaagtctttcggtaccacaacagcaggtacagtttgatgctcccggaatgctggctgaaacggacgagtacatggccggaggtaaacgaccggcccgtgtttaccgggtggtgaacggtattgctgtactgccggtgaccggcacgctggtgcaccggctgggggggatgcggccattttccggaatgacaggctatgacggcattgtcgcctgtcttcagcaggcaatggcggcattgtcgcctgtcttcagcaggcaatggcggatagccaggtgcggggcgtactgctggacattgacagtccgggcgggcaggccgccggcgcgtttgactgcgctgacatgatttaccgcctccgtcagcagaagccggtctgggcactgtgcaatgacacggcctgttctgcagccatgctgctggcgtcggcctgctcccgacggctggttacccagacatcccgtatcggctccattggcgtgatgatgagccatgtcagctatgccggtcatctggcgcaggccggtgtggatatcacgctgatttactcaggggcgcacaaggtggatggcaatcagtttgaagcgttgccggcagaggttcgccaggacatgcagcagcggattgatgcggcgcgccggatgtttgccgaaaaagtggcgatgtataccggtctgtctgttgatgccgtcacgggaacagaggctgccgtttttgaaggtcagtccggcattgaggccgggctggcggatgaattaatcaatgcgtcggatgccatcagtgtgatggccacggcgctgaacagtaatgtcagaggaggcactatgccgcaattaactgcaacggaagccgccgcgcaggagaaccagcgagtgatggggatcctgacatgccaggaagcgaaaggacgtgaacagcttgccacgatgctggcaggacaacagggcatgagcgttgaacaggcccgggcgattctggccgcggcggcaccgcagcagccggtggcatccacgcagagtgaagccgatcgcattatggtgtgtgaagaagcgaacggtcgtgaacaactggcggcaacgctggcggcgatgccggagatgacggtggaaaaagcccgcccgatcctggctgcttcaccgcaggcggatgccggaccatcactccgtgatcagatcatggcactggatgaggcaaaaggggctgaggcgcaggctgaacagctggctgcctgcccgggaatgacagtggagagcgcccgggctgtgctggctgcgggatcaggtaaggcagaaccggtctctgcatccacaaccgccatgtttgaacatttcatggcgaaccattcaccggcagcggtacagggtggcgtggcacagacgtcagcagacggtgatgcggacgtgaaaatgctcatggccatgccatgaagtcagtgctgaccatcaataggaggtttttacaatatggtgacgaaaaccatcactgaacagcgtgcggaagtacgtatttttgccggtaatgatccggctcataccgccacaggcagcagcgggatttcctcgccaacaccggcactgacgcccctgatgctggatgaagccaccgggaaactggtggtctgggacggacagaaagccggtagtgcggttggcatactggtactgccgcttgaaggcacagagacggcgctgacgtattacaagtcgggaacctttgcgacggaggcaatccactggcctgaaagtgtggatgaacacaaaaaggccaacgcctttgctggcagtgccctgagtcacgcggcgctgccgtaacacgttatcaggccaccgcggtggcctgactgatttctgaatgaaaggaactgatttatgggattgtttacgacccgccagttactcggttataccgaacaaaaagttaaatttcgtgcgctgtttctggagctgtttttccgccgtacggtgaatttccataccgaagaggtgatgctggacaaaattaccggaaaaacgccggtggcggcctatgtctccccggttgttgaaggaaaagtgctgcgtcatcgtggtggtgaaacccgcgtgttgcgtccgggctacgtcaagccgaaacacgaatttaattaccagcaggcggttgagcgccttcctggtgaagatccatctcaactgaatgatccggcttaccgccgtctgcgtatcattaccgataacctcaaacaggaagagcacgcgattgtccaggtggaagaaatgcaggcggtaaatgctgtgttgtatggcaaatacaccatggaaggagaccagttcgagaaaattgaggtcgattttggcaggtcgacgaagaataacatcactcagggtagtggtaaggagtggtcaaaacaggatcgtgacacgttcgatcctacacatgatattgacctctactgcgacctggccagcggtcttgtgaatattgccattatggacggtaccgtctggcgtcttctgaatggttttaagctgttccgcgaaaaactggatacccgtcgcggttcaaattctcaactcgaaacggcagtgaaagatctgggcgcagtggtgtccttcaaggggtattacggcgatctggccattgtggtggcgaaaacgtcttatatagcagaagacggtatcgaaaaacgttatcttccagatggcatgctggttctggggaatactgctgcagatgggatccgttgttacggtgccattcaggatgctcaggcgttgtccgaaggtgtggtggcctcttcccgttatccgaaacactggctgacggtaggggatcccgcccgtgaatttaccatgacgcagtccgcgccgctgatggtgttgccggacccggatgagtttgtggtggtacaggtgaaataatccgtgagcgggggcgaaatgcccccgtgtcttttttcacagggggctgatatggcaacgaaagagcaaaatctgaaacggcttgatgaactggccctgattctggggcgtgagccggatatatccgggagtgccgcagagatagcgcagcgggtggcagaatgggaagaggaaatgcagtcatccggcgatgatgtacaggttatgaatatggatatccgggagcgggaaaccgcggctcatgatgttcgtgaggaaacatccggcgcgttaacgcgcatcagagttctgacctgcctccatctctgtggcgttgatggtgaaacgggggaatccgttgagcttgcggatgttggtcgggtgattctgattatgtcctcagatgcaaaaacacacgttgatggtggaatggctgtttatgcgtgattttcagaatgcctttgatgccgcccttgccggggtggacagtacgattgttgaagtgatgggcatcagtgcgcagttcacctccggtgcacagcgtggcggcgaggttcatggcgtttttgacgatccggagtcgctgggttttgccagtagtgggatccgtattgaaggaagtaacccgtcattatttgtgcttacggatacggtttgtgctgtacggcgtggtgacacgctgaccattaacggcgagatgttctgggtggaccgtgtttctccggatgacggagggagttgttatctctggctcaaccgggggcaaccacctgccgccagccgtcgccgctgaaagggggatgtatggccataaaaggtcttgagcaggccgttgaaaacctcagccgtatcagcaaaacggcagtgcctggtgccgccgcaatggccattaaccgcgttgcttcatccgcgatatcgcagtcggcgtcactggttgcccgtgagacaaaggtacgccggaaactggtaaaggaaagggccaggctgaaaagggccacggtcaaaaatccgcaggccagaatcaaagttaaccggggggatttgcccgtaatcaggctgggtaacgcgcgggttgtcctgtcccgacgcaggcgtcgtaaaaaggggcagcgttcatccctgaaaggtggcggcagcgtgcttgtggtgggaaaccgtcgtattcccggcgcgtttattcagcaactgaaaaatggccggtggcatgtcatgcagcgtgtggccgggaaaaaccgttaccccattgatgtggtgaaaatcccgatggcggtgccgctgaccacggcgtttaaacagaatattgagcggatacggcgtgagcgtcttccgaaagagctgggctatgcgctgcagcatcaactgagaatggtaataaagcgatgaaacatactgaactccgtgcagccgtactggatgcactggagaagcatgacaccggggcgacgctttttgatggtcgccctgctgtttttgatgaggaagattttccggcaattgccgtttatctcaccggcgctgaatacacgggcgaagagctggacagcgatacctggcaggcggagctgcatattgaagttttcctgcctgctcaggtgccggattcagagctggattcgtggatggagtcccggatttatccggtgatgagcgatatcccggcactgtcagatttgatcaccagtatggtggccagtggctatgactaccggcgcgacgatgatgcgggcctgtggagttcagccgatctgacttatgtcattacctatgaaatgtgaggacgatatgccaacaccaaatcctctggcaccggtgaaaggggccgggaccacactgtgggtttataacgggagcggcgacccttatgcaaacccgctttcagacaatgactggtcgcgtctggcaaaaattaaagacctgacgcccggcgaactgaccgctgagtcctatgacgacagttatctcgatgatgaagatgcggactggaccgcgaccgggcaggggcagaaatccgccggagataccagcttcacgctggcgtggatgcccggagagcaggggcagcaggcgctgctggcgtggtttaatgaaggtgatacccgtgcctataaaatccgcttcccgaacggcacggtcgatgtgttccgtggctgggtcagcagtatcggtaaggcggtgacggcgaaggaagtgatcacccgtacggtgaaggtcaccaatgtgggccgtccgtcaatggcagaagatcgcagtacggtgacggcggcaaccggtatgaccgtgacgcctgccagctcctcggtggtgaaagggcagagcaccacgctgaccgtggccttccagccggagggcgcaactgacaagagcttccgtgcggtgtcagcggataaaacaaaagccaccgtgtcggtcagtggtatgaccatcaccgtgaacggcgttgctgcaggcaaggtcaacattccggttgtatccggtaatggtgaacttgctgcggttgcagaaatcactgtcaccgacagttaatccggagagtcagcgatgttcctgaaaaccgaatcatttgaacataacggcgtgaccgtcacgctttctgaactgtcagccctgcagcgtattgagcatctcgccctgatgaaacagcaggcagaacaggcggagtcagacagcaaccggcaggttactgtggaagacgccatcagaaccggtgcttttgtggtggcgatgtccctgtggcataaccatccgcagaagacaaagcagccttccatgaatgaagccgttaaacagattgagcaggaagtgcttaccacctggcccgcggaggcaatttctcatgctgaaaacgtggtgtaccggctgtccggtatgtatgggtttgtggtgaatgatgcccctgaccaggcagaggactccgggcctgcagagcctgtttctgcgggaaagtgttcgacggtgagctgagttttgccctgaaactggcgcgagagaaggggcgacctgactggcgcgccatgcttgccgggatgtcatccacggagtatgccg

SEQ ID NO: 10053 - DNA, 6196 bp, Escherichia coli
tcttgctacacggcggagactacataaagtagttggtgggtgatgacgggatcgaaccgccgaccccctccttgtaagggaggtgctctcccagctgagctaatcacccccgctgtgtggagtcgcattatagggagagttcaaaatgagtcaacgcattttctaaagaaattgttcgttcgtcgtaaatttaagcaagatgatcgcaaaacagaccgtgttgcgcaatttgtcaacgaaaacaataatgcgtaaggttgcaacccgaactacattgaggaatcagacgggagtgatagaatatcgcccactcaatttttccaggatttgccggttgtcggcatctttctaaacgtaaggccatttcatgaaaatcaaaactcgcttcgcgccaagcccaacaggctatctgcacgttggcggcgcgcgtactgctctttactcctggctttttgcacgtaaccacggcggtgagtttgtgctgcgtattgaagacaccgatcttgagcgttccacgccggaagctatcgaagccattatggatggcatgaactggctgagcctggagtgggatgaaggtccgtactaccagaccaaacgttttgatcgctacaacgcggtgatcgatcagatgctggaagagggcacagcttataaatgctattgctctaaagagcgcctggaagcgctgcgcgaagagcaaatggcgaaaggtgagaagccgcgttatgacggtcgctgccgccacagtcatgagcatcacgctgatgatgagccgtgtgtcgtacgttttgctaacccgcaggaaggttctgttgtttttgacgatcagatccgtggtccgatcgagttcagcaaccaggagctggatgatctgattatccgccgtaccgatggttccccaacctataacttctgtgtggttgtcgatgactgggatatggaaatcacccacgttatccgtggcgaagaccatatcaacaacacaccgcgccagattaacattcttaaggctctgaaagcgccggtaccggtttacgcgcacgtttctatgatcaacggcgatgacggtaaaaaactgtccaaacgtcacggggcggtcagcgtaatgcagtatcgtgatgatggttatctgccagaagcactgctgaactatctggtgcgtctgggctggtcccacggcgatcaggaaatcttcactcgtgaagagatgattaaatacttcactctgaatgccgtcagcaaatctgccagtgcgttcaacaccgacaagctgctgtggctgaaccatcactacattaacgcgttgccgccggagtatgttgctactcacttacagtggcacattgagcaggaaaatatcgatacccgtaacggcccgcagctggctgatctggtgaaactgctgggcgaacgctgcaagacgctgaaagagatggcacagagctgccgttatttctacgaagattttgctgagttcgatgccgacgccgcgaaaaaacatctgcgtccggtagcgcgtcagccgctggaagtagttcgtgacaaactgactgcgattactgactggaccgctgaaaacgttcatcacgctattcaggcgacggcggatgagctggaagtgggtatgggtaaagttggtatgccgctgcgtgtcgccgtaaccggtgcggggcagtctccggcgctggatgttaccgttcacgcaatcggtaagacccgcagtatcgagcgtatcaacaaagcgctggcttttattgctgaacgcgaaaatcagcactaattagcgcataaaagataaacggcaggagagatacccctgccgttttttatttatgctgattcatctatgtcgagacgagcaagaaaattacgaattccttcgcgtgacaaaaattgcgcaactttttcttgctcactgtgagtcatgttgtctattgcgctgatgatttgccgataagcaggagtgcgaatacccggtgcgtattcggcaaggggttcttcggcttccagaagcatcggtgtgttatggaaggctggcgtgttctgaataaactcgcaaacttgcgtatcgaccagaataagtctggcacgaccgcctttcacgccgggaaatttttccgttttccagcctttttctctgatccaacggttaacagtttgtttagccacgccgaggcattcagccagttcttcggtggtcattttattgcgtaatcttttcatattatttgctatcgcgaatccctaagcgttgtaacaatccgataatcccttcccgcagaagcaaggatgtaaactgtttttgttcaactggcgtcatctctttcgccagtgtcaccagcaacacttcaagcggcgcatcaccagaaagggctggcgcttctccctgaccttctggacgttcagcattgcgaatatattcacgaacctgttcattgacgtgaaccagtcgagctttgccaccctggacgcctggttttggtgacgttgtccagccttccttgcgtacccatttattaatggtctggcggctatagccggtcagtctggcaagttcatctggcgtcatcctctccttgaacataacaattccctgaatgtatgtgggtctattagtagttcattttataacaccactttacaggaaaccgtgacatgaataactactgaatgcgagcggttttccaaaattgttcatttgcctgatttttcagcgattgaaactacacgtggcaatttgccgttgacacattcgggcggaattcatatgatgccgcccgtcaactcgacaagctttacgtgatggggctatagctcagctgggagagcgcttgcatggcatgcaagaggtcagcggttcgatcccgcttagctccaccaaattttgcacccagcaaatttggtacgtaaacgactcgtggggctatagctcagctgggagagcgcttgcatggcatgcaagaggtcagcggttcgatcccgcttagctccaccaaatttcaaaccctcgctgcaaagcgggggttttttgtctctgccttttgccgcttttgtaatacagtctatatcctggcagtgccgtgtggtgaatgcatcactgactgaaaaaacagcaacaggctggcccctgtttgcttcgcgatgcgaataaacttattatttgtgtgcctgaaaaccccgatcagtgagagtagtgtactcatgtttgtggagcataacctgataaaaaatatcaagatattcacactagcgtttacgctcaccgtggtacttattcagctatcccgtttaatttcgccacttgctgttatccattccaattatatctttctggcgtggatgccactgtgcgtaatgctgtcaatcttgtttatctttggctggcgtggtgtcgttcccattttatgcgggatgttttgcaccaatctgtggaacctgcatctctcttttttacagaccgccgtcatgatcggcagccaggcgtttgcagtcctgtgtgcctgtgcaatattacgctggcaattggggacgcgttggcgttatggattgaccagccgatacgtctggcaacgtctgttctggcttggtttggtggcgccgattggcatcaaatgcagcatgtatcttgtgggaaatttctttgattttccgctaaagatatctacctttttcggcgatgcggatgccattttcacggtcgttgatttgctaagccttttcaccgcagtgctgatttacaacatgcttttttactatctcacccgcatgattgtaagtccccactttgcacagatattgtggcgtagggatatcgctccgtcgttgagcaaagagaaacgcgcatttaccttaagctggctggcagctcttagcgtgctgctacttctgatgtgcacaccgtatgaaaatgactttattgccggttacctggtacctgttttctttatcatctttaccctcggtgtcggtaagattcgctatccgtttttaaatctcacctgggctgtttcaacgctttgccttctgaattacaaccagaactttttgcaaggggtactaaccgaatattcgctggcatttattctcgcagtactgatttcctttagtgtttgcctgctctatatggtgcgtatttatcatcgtagtgaatggcttaaccgccgctggcatttgcaggcgctgaccgatccgttaacgcttctacccaactttcgtgcgttggagcaagcgccggagcaagaggcgggcaagagtttttgctgcctgcgcattgataatcttgagtttatgagtcgtcattacggcttaataatgcgcgttcactgtatccgctcaatttaccgtacgctgctgccgttgatgcaggaaaacgaaaagttgtatcaattgccgggtagtgaactgctgttagtgctgagcgggccggaaacggaagggcgactccagcatatggttaacatcctgaatagtcggcaaattcactggaacaataccgggctggatatgggctatggtgctgcctgggggcgttttgatggaaatcaggaaaccctgcaacccttgttggggcagttaagctggctggcggagcaatcctgcgcacatcatcatgtgctggcgctggatagcagagaggagatggtttccgggcaaaccactaaacaggtgctattgctgaataccattcgcacggcgttagatcagggtgatttgctgctctacgcccagccaattcgcaacaaagagggtgaaggttatgatgagatcctcgcgcgactgaagtatgacggcggcattatgaccccggataagtttctgccccttattgctcagtttaaccttagcgcgcgttttgatttgcaagtgctggaatccttgttgaagtggctggcaacacacccttgcgacaaaaaaggtccacgcttttcagtcaatttaatgccgctcacgctgctgcaaaagaatattgccgggcggattattcgtctgtttaagcgttattacatctccccgcaggcggtcattcttgagatcaccgaggagcaggcgttttctaacgcagaaagcagcatgtacaacatcgagcagctgcataagtttggtttccggattgcgattgatgactttggcaccggatatgccaactacgaacggttaaagcgtttgcaggctgatatcatcaaaattgatggcgtctttgtgaaagatatcgtcacgaacacgctggatgcgatgattgtgagatcaattaccgatctggcgaaagcgaagtcattgagtgtggtcgcggagtttgtcgagacgccacagcagcaggcgctattgcataaacttggggtgcaatatctgcaaggatatttaattggtcgtccgcagccattagctgattaacaggcgtaaaaaagccggggaattatccccggcttttttatgtatggtcttacagcaccagtgctgcgattgacgcagacagcacactcaccagggtagagccgtaaaccagtttcagaccgaagcgagaaaccacgttaccttgctcttcattcaggcctttaaccgcacccgcgataatcccgattgaagagaagttagcgaaggaaaccaggaacacagagatgatgccttccgcacgcggagagagcgtggaagcaattttctgcagatccatcatcgcaacgaactcgttggaaaccagtttggtcgccatgatactgcccacttgcagtgcttcactggaaggaacacccatcacccatgcaatcggatagaagatgtagcccaggatgccctggaaggagatgctgtagccaaaccagccagtcacggtggcaaacagtgcgttcagcgcggtgatcagggcgataaagccgatcagcatcgcggcaacgataatggcaaccttgaaacctgccagaatgtattcacccagcatttcgaagaagctctgaccttcgtgcaggttggacatctgaatattttcttcactggcatcaacacggtaagggttgatcagcgacagcacgataaaggtgctgaacatgttcagtaccagcgccgcaacgacgtatttcggctccagcatggtcatgtatgcaccaacgatggacatcgacacggtggacatcgccgttgctgccatggtgtacatacgattgcgggagattttgccgaggatatctttataggcaataaa

SEQ ID NO: 10054 - DNA, 5274 bp, Escherichia coli
tgaccagccagagtattaggtttttcgccatgtcactcaagggattaacctcttattacaactgtgttaaaaacagcgtcaggatactctatatccagcatctttcaaactttcgtctgaaatctcccggttagggtttacgcccggtcgctacaatatacacttcccgcgaacgtgcacgagaagagtccggcttacgaactttgaccttcgtaaacagggagcgaatttcccttagatactcatcgaaaccttcgccctggaacaccttcactacaaaactgccacctggcgctaatacatcacgacacatttctagcgccagttccaccagatacatggcacgggggatatccaccgccggtgttccgctcatgtttggtgccatatcggacatgacaacctggactttgctgtcgccaacgcgctccagcagtgctttcatcaccagttcatcacgaaaatcgccctgaagaaagtccacaccaacgataggatccataggtaaaagatcgcaagcgatgatgcggcctttgccgccaatttgggtgaccacatattgtgaccaaccacccggagcagcaccaaggtcgacaaccgtcattcccggtttaaagagtttgtcactttgctgtatttcatcaagtttaaaccaggcacgggaacgtaacccctttttctgtgcctgttgaacatatttatcgctaaagtgttcctgaagccagcggctggagctggcagaacgcttcttacctgtcatttaactttcccatggggataactcatcgtaaccaattgcgtaaatttttacgcgcctatttggtgatatatgggagatggcggtagaatgacccgttttcaatcccaacgtaagcaaaaaatacgatgaatctgagtactaaacaaaaacagcacctgaaaggtctggcacatccgctcaagccagttgttctgcttggcagtaatggtttgaccgaaggggtgctggccgagattgaacaagcgttagagcaccatgaactcatcaaggtgaaaatcgccaccgaagatcgcgaaactaaaaccttgatcgtggaagctatcgtgcgcgaaaccggcgcctgtaatgtacaggtcatcggtaaaacgctggtgctttatcgcccaactaaagaacgtaaaatctcgctgccacgctaagattatcctaaagttacacacattcgctgtgtaaaacgaggggttttccgcaggcaggagagcaaaatgccacgctctgttcgttgataaaaggccgcatagcggcctttttcctttctttacaatacatcaacatcttgagtattgggtaattcttacaggtattccaccttaattacttcaaattctacttcgccgcccggcgttttgatgaccacaacatcatcttcttctttgccgatcaggccacgagcaataggcgagtttacagaaatcaggttttgtttaaagtcagcttcgtcatcgccaacgatgcgataagtctgttcttcgtcagaatcgagattcagcaccgttacggtagcaccaaaaataacgcgcccattgttgggcattttggtgacatcaatcacctgcgcgttcgacagcttggcttcgatgtctttgatacggccttcgcaaaagccctgctgttcacgagctgcgtggtattcggcgttttctttcaggtcgccatgctcacgcgcttccgcgatagcagcaatgatttcaggacggcgcacagatttcagaaaatccagctcttcgcgtaatttttcagcgccgcgtaaggtcatcggaatagcttgcatttgttatacctcttgaatattcctgatggggcaagtcttcacccaccccggctgttcggcctgcccggcataactcctcaccgggaccagaagcaaaaaaataccgacccgggtacaagtcccaggtcagctacaattcacattttgatagtcattttaccctgaagttcccgaagggtcatcgtttactttatagggcgttgcgccgtagtatgacggctcgattccaggttgttagcgcgagattatgcgattttccagatttatcatcggattgaccagctgtatagcgttcagtgttcaggccgcaaatgttgatgagtacattactcaactccccgctggtgccaaccttgccctgatggtgcaaaaagtcggcgcgtcggcccccgctattgattaccacagtcagcagatggcgctgcccgccagtacgcagaaagtgattactgcactggcggcgttgattcaactcggccccgattttcgttttaccacgacgcttgaaaccaaaggcaatgtggaaaacggcgtacttaagggtgacttagtggcgcgatttggtgccgatccgacgttaagacgtcaggatattcgcaatatggtcgcgactttgaaaaaatctggcgtcaaccaaatcgatggcaatgtgttgatagatacctccattttcgccagccacgataaagcccccggctggccatggaatgacatgacacaatgctttagcgctccgcctgccgccgccatagttgaccgcaactgtttctccatctcgctctacagtgccccaaaacctggtgatatggcttttatacgcgtggcatcttattaccccgttacgatgttcagccaggtacgcaccctcccccgtggttctgccgaagcgcaatattgcgagctggatgtggtgccaggcgacctgaaccgctttacgctgaccggatgcctgccacaacgttctgagccgctcccgttggcttttgccgtgcaggatggagccagctatgccggtgcaattctgaaagatgagttaaaacaggcaggtatcacctggagcggaacactgctgcgtcagacgcaggttaacgaacccggaacggtagttgccagtaaacagtcggccccgctgcacgatctgcttaagattatgctgaaaaagtcggacaacatgattgccgatacggttttccgcatgatcggccatgcgcgcttcaatgtgcctggaacatggcgggcaggatcggacgccgtgcgtcagatcctgcgccagcaagccggtgtcgatatcggaaacaccattattgccgatggttcagggctttcgcggcataacctgattgcccccgccaccatgatgcaggtgctgcaatatattgcccaacacgacaatgaacttaactttatctccatgctgccgctggcgggctatgacggctctttgcagtaccgtgcaggtctgcatcaggcgggcgtggatggaaaagtctcagcgaaaaccggttcgttgcagggggtatataacctggcgggattcattaccacagtgagcgggcaacgaatggcgtttgtgcaatatctttctggctatgcagtagaaccggcggatcagcgtaatcgccgtattccgttagtgcgttttgaaagccgtttgtataaagatatttatcagaataattagcctaaagagaaaccccggcacatggccggggttttgctgattaacgcttgtaaatgaactcaacgccttcttcgtcgtcttcgtcccagtcgtcatcccagtcctcatcatcctcttcagcaatctcttcaagctgctgacggtgataatcatcccacatgaattcgactttctctggctgtttcgcttcttcagcctgcacgaccgggttttcaatgataaaggtcatcacatcccagcagagatctttcacgcccagtccgctcgccgcagagatcagataatatttatcttcccagcccagcgcttcagcgatcgctttcgctttctcttcggcttctaccttatccagcagatcgatcttgttgaagactaaccaacgcggtttcgccgccagatcttggctgtatttttccagctcactgataataatacgcgcgttttcaaccggatcggtgccgtcaatcggatcgatatcgatgaggtgcaacaggacgcggcaacgttccaggtgcttcaggaagcgaatgcccagacstgcgccttctgcagcgcytcaatcagtcctggaatatcggcaacaacgaagctcttttcgttgtccatacgcaccacgcccaggcttggtaccagagtggtaaacggataatccgccactttcggtttagccgccgataccgcacgaataaaggtcgatttacccgcgtttggcatccccaacataccgacgtcagccagcagcatcagctccagcagcagctcacgcttatcgcccggcgtaccgttagttttctgccgtggtgtacggttaactgacgacttgaaacgggtattgcccagaccgtgccagccgcccttagcaaccagcagacgctgaccgtgtttggtcatatcgcccatggtttcaccggtaccctggtcgattacacgcgtacctaccggtactttaatcgtgacgtctttaccgcgcttaccggtacagtctcggcttgcaccgttctgaccgcgctctgcacggaaagatttttcaaaacgataatcgataagcgtgttcaggttctcgtcggcttccatccatacgtcaccaccatcaccgccgtcgccgccatccgggccgcctttcggaatatacttttcgcggcggaagctcacgcaaccattaccgccatcacctgcaacgaccagaatcgatgcctcatcaacaaacttcattttattctccgtaaatcattcgcctgcgcggggttgcgataccaccgttgtatgcttacgtaatccgccccaaatacgatgaccaatggcggaatacatcgcgcccgcaaccacgacaaacgcaccgagataacctaaaaggtttaacatcggtctggcgaagaaatcgggccaggccagtgataaaagatctgaaaaaaacagcgtaaacagtggggtgagcgtgatgatcgcgctcacctgcgctgcctgccagcgagccatcgcttccgccagggcgccatatcctaccaatgtattcagtccgcaaaaaattaaacatgcgagctgccagtggctaagctgcgctatcactccaggatttgccagagggaagagcgcaattgtacataaagtgtacagtaaaaacaggatctgcggtgaggccagccgacgcaataaaaccttttgcgccacgccataactcacccaaaccgtcgccgcaccgaccccaaagataactccccaggtgtaatcggtgagctttgtaaatatctcgaccagactggtgttaaaaaacatcaccaggcc

SEQ ID NO: 10055 - DNA, 5141 bp, Escherichia coli
cggtttctttttcgaagtttttccggattattgcattttttatataattgtgggtggctgattcttgcgaaaggactgttgtgatgtccgagttcccaaattgggagtttttggacatcactcctgatctgccggcggcgatcaggatgactgacatttcgatatattttgggtattcgatagctgccaaatcggtcagcgtcgagtattccggtttattcgaaggattcatgatattgaaaaatatcattgattttcatggggttttgtattagtacccgctcattgtgggaaagtcgggtggatttatcttacccgcaaatctaatacaagatttgcatgatgcagcaatagaccaaggttagtatagcagttgtatttatacgactagttatgcaaaccctttgtgttttttgttgcgactcttggcgtgaaccggaagaccggacctcgctttcgactattcatctttgatggatatgagatcgcaagggtatcgcttcgtgcgatatttagtgaccatcagagcacgctacgacttttgattatatccttggatttaatcggaagctcgcaagcattgcattgatgcaatcacctggttgatcctgccagtagtcatatgcttgtctcaaagattaagccatgcatgtctaagtataagctttaaacggcgaaactgcgaatggctcattaaaacagttatagtttatttggtgatcgattactatttggataaccgtagtaattctagagctaatacatgcgtcaaggcccgacttcggaagggctgcgtttattagatacagaaccaacctaggctccgcctagtccttgttggtgattcataataacccggcgaatcgcacggcttgtccggcgatggaccattcaagtttctgacctatcagctatggacggtagggtattggcctaccgtggcgttgacgggtaacggggaattagggttcgattccggagagggagcctgagaaacggctaccacatctaaggaaggcagcaggcgcgcaaattacccaatcctgatacagggaggtagtgacaagaaataacaatacagggcaattctgtcttgtaattggaatgagtagattttaaatctctttacgagtatcaattggagggcaagtctggtgccagcagccgcggtaattccagctccaatagcgtatattaaagttgttgcggttaaaaagctcgtagttggatttctgccttgggcgaccgatccacctttcctacgggattggttggtatcaggtttgaccttggctttttcttgggattcgtgctcacgtacttaactgtgcgttgaccgtgttccaagacttttactttgaggaaattagagtgtttcaagcaggcttatgccatgaatacattagcatggaataataggatatgacttcggtcatattttgttggtttctaggactgaagtaatgattaatagggacagtcgggggcattcgtatttaactgtcagaggtgaaattcttggatttgttaaagacgaactactgcgaaagcatttgccaaggatgttttcattgatcaagaacgaaagttaggggatcgaagacgatcagataccgtcctagtcttaaccataaactatgccgactagggattgggggtcgttaattttagacgccctcagcacctcgtgagaaatcaaagtctttgggttccggggggagtatggtcgcaaggctgaaacttaaaggaattgacggaagggcaccaccaggagtggagcctgcggcttaatttgattcaacacgggaaaactcaccaggtccagacataggaaggattgacagattgatagctctttcttgattctatgggtggtggtgcatggccgttcttagttggtggagtgatttgtctggttaattccgttaacgaacgagaccttaacctgctaaatagttgcgcgaaactttatgtttcgtcgctacttcttagagggactttgtgtgtttaacacaaggaagcttgaggcaataacaggtctgtgatgcccttagatgttctgggctgcacgcgcgctacactgacacgatcaacaagtatttccttgcccggtagggttagggtaatcttttgaaatcgtgtcgtgctagggatagacgattgcaattattcgtcttcaacgaggaattcctagtaaatgcaagtcatcagcttgcgttgattacgtccctgccctttgtacacaccgcccgtcgctcctaccgattgagtgatccggtgagctgtccggactgcgattagttcagtttctgttctcttcgcgggaagttctgcaaaccttatcacttagaggaaggagaagtcgtaacaaggtttccgtaggtgaacctgcggaaggatcattcacaccgattcattctctgagaaaccagcggtctcgctctctcttgctcttttgytwgagwgttgcgagatgggatccccgctttgtttggatccccccaccttaacttgtctgttraggtgattaattcctatgaaccattgtactagtcatagtatccaaatccaattttggattttggtatttcaaaacgaaattccaaactctcaacgatggatgcctcggctcgagaatcgatgaaggacgcagcgaagtgcgataagcactgcgatttgcagaattccgtgaaccagtagaaatctcaacgcatactgcacaaaggggatctttcctctttgtacatacatatcagtgtcgctcttcttcccgatacaaacattttgttgttaacgcaactcaatgctttgtatcccgcttgaactaactcttcggaggtggttcgttatgtgcgcttgtgaaggcaggcgtattaattwgcaaggctatartctcgtattgtagcccctccgaaaggaggcttgcgcctgtgagtatctctcgaggtactcgcaaactcgactgtgttgtggtgatatcacgtgttccttgatcacgcgattcttctcttcaacgcattacgtcaaatctattgataaatgcagagaagtgtttgaatcacgcgttcagtcyggtcgcgagrttattatatatcataacacgcttgtcggtttgcaccatggcaatatgtcatcattagaaggcctgatgtgtgtgagattacccgctgaatttaagcatataagtaagcggaggaaaagaaactaactaggattcccttagtaatggcgaatgaacagggatcagctcagtgccaaatcggaatcacttgtggttctgaaatgtggcttgaaggcagtaccagtggcatcgcggacgaaagtctcttggaaaagagcgtcatagagggtgagaatcccgtgagtcgttcgccgtttgtcacgtacggtctgcgttctaacgagtcgcgttccttgggattggagcgtaaacgggtggtaaatttcatccaaagcaaaatatatactcgagaccgatagcacaaaagtaccgtgagggaaaggtgaaaagaactttgagaagagggttaaatagtgcctgaaatcgttgagaaggaagcggatgccgccgttgcatatgctgattgtaggattgctgctcgctcctgtcttctgctactcattcacagacctggtcgtgttgagcagttgtttggcagatgttagtggtgtttcctactttcagtcgtcagcatcactggctgagtggaaataatccttggatgctaattggttcgctatctgtgaattggttgcttccttgcgatactcactactcggtcagtgaggaagtgcgtttgctggtcaacgagctttctaactgtcattaccctgcgcttttcgattcgtcgagtggccaggatgtggctttgagattgttcgcacttagtaatcgcgatgctggcttccaacggttgcctccggcccgtcttgaaacacggaccaaggagtctaacgtatgtgcgagtgtgtgagtggcaaacttatacgcgtaatgaaagtgaggccgtatggccatgttggggtcaccaacaaccgaccttgatcttcggtgaaaggtttgagtatgagcatatccgttaggacccgaaagatggtgaactatgcctgagcagggtgaagccaggggaaactctggtggaggctcgtagcgatactgacgtgcaaatcgttcgtcagacttgggtataggggcgaaagactaatcgaaccatctagtagctggttccctccgaagtttccctcaggatagctagagtctttatcagttttgtcaggtaaagcgaatgattagaggttccggggaagtaacttcctcgacctattctcaaactttaaatgggcaagatccagtagttacttaattgaactattggggtcaatgagacgactctaagtgggccatttttggtaagcagaactggcgatgagggatgaacctaacgctcggttaaggtgctaaactgctcgctcatcagataccacaaagggtgttggtcgatcttaacagcaggacggtggtcatggaagtcgaaatccgctaaggagtgtgtaacaactcacctgccgaatcgactagccccgaaaatggatagcgctgaagcgagtgaccgataccgggccattgttgcaagataattggcaacaatgagtaggagggcgtgggggttgtgaagaagcttggacgtgagtctgagtgaaacagcttccagtgcagatcttggtggtagtagcaagtattcaataagagaacattgaaggccgaagtggggaagggttccatgtgaacagcacttggacatgggttagccgatcctgagagacaggttaaattccatcggattggagctttggctctgtttctcgaaagggaagctggttagtattccagcgccgagacgtggataatatgtggcaacacaagtgaactcggacacgccataggggaccccaggaagcgttgtcttttctttttaacagttcgacttaccctggaatcagatcatctggagatagggttttcgaactggaatagcaccttgtctaacagggtgtctggagtgttctcgctggcccttgaaaatccgagggatagatttattcgcactctcgatcgtacccataaccgcatcaggtctcca

SEQ ID NO: 10056 - DNA, 3827 bp, Escherichia coli
tcgatgcggcggccaaatcgttgtaaatcccgtaaaggcagatgcgcgccatgcccggtgacgccagagggagtgtgtgcgtcgctgccatttgtcggtatacctctctcgtttactcagttgttcaggaatatggtgcagcagctcgccgtcaccacagtaaatagcggcatgattcggcaccgatgaaccaaagcagcacagcagcacatcgcccggctgcgccgctgacaacggcacctgatacagccctgtggcctccagattatcaagatagagattctggccgttacgccaccagtcatcctcacgatgaaagtccggcatctcaatccccgccagatggtaagcgtcccggaacagcgtgtaacagtccgtcaccccgtgctcaaagcgccgcccggtgagatgcggcacacagcggaacttatgaatcgccccccggcagaccagccaccacggcaaatcactctgcacctgcagccgccggtcggcctcactcagccagggcagaccaccgggatgactgtggaccagcgccacaatctcaccctgcatctctgcctgcagccagtcctccggagccatccggaaatacgcctccggctcaccggagatattcacgcagggaaaatatctttccccctccggcgctctcaccacgaagccgcacgactccgctggcgcacatcgccgggcatgcgccagaatcgctgattctgtctctgtcatgggatttactgcgaaagtttgttaatggaaaggaagccgccaaagttgccgacgttattgcgaaacttacagccgctcaggcatttgctgcatttatccttcgtgatatcggaagtcggctgatcatattcatccgcgaccgccggaccgtgataaccgcactcatcaccgcgataggtccaggtgcaggtattagccagcatgatgcgccccggaaaaacggcaccatccgtttccgtcggtgtggacagtacaaaggaggcactgaccgcactcagttcgctgcactgctcgatgcgccagcggctgatcacctcctgctccggatcggcgtcgctgtttccgttgacgaagttcaccgcatccagaaaacgggcgtaaaccttacgcctgaccaccgttccgccgaccagactctgcagatcttccaccatcccggtgaccataccgtacaggttagaaaccgtcagcgtggggcgcgtactggtgcctttgccattcagttcaaaactactcccctgaatgggatacggctgatactgtcgcccctgccaggtgaccggctcacctttttcgttctgctcattacagaaaaaataacgttctccaccgacctctgtcagatcgatttcccagagcaccacgctggccgactgctccgcacgggtgcattcattcaatgtttcctgccggatatcctgcatcagttcaccacctgttcaaactctgcgctgaactcaacacgcagcatactgacccgcgacgaccattttgcgcaggtcacctttatctgcctgtaaccataaggcggcgtccacagaaaggccttccagcccccgtgctcagccagaaacgactccagcgccgtggcctcctcacgggagacagacagcgtcacgctgtacgttttcaggtcagcgttcagcccggcaggcgcacgctgggaatagccatcaccaaagcgcacctccctgacggaaggagccgatgtcacatccatcccgggtttcactttccagcggaaggttttcatcgtccacctccggagaacagaccaccatcgcgcatctgtgcctggatttcatcacgggcacccttgcgggccatgtcatacaccgccttcatcatctgtggacctggcagaccattcgtaccgtcgttctgaatcaccacgttgttgttctgctcaaacctgataccctctgaacgccgcatttgcgccggacttccggtgccaccgacataaccgccggtggcatagccgcgcatcagccggtagagatttcccacgccaatccggctggttgcctccttcgtgaagacaaattcaccacggtgaacaatccccgctggctcatatttgccgccggttcccgtaaatcctccggttgcaaaatggagtttcgccgcagcggcctgaatggctgtaccgcctgacgcggatgcgccgccaccaacagccccgccaatagcgctgccgatactcccgacaatccccaccattgcctgcttaagcagaatttctgtcatcatggacagcacggaacgggtgaagctgcgccagttctgttcactgccggtcagcatcgccgccatattctgcgcaataccatcaaaggtctgcgtggcagcacttttaacctgcgacatactgtccgtggcactctcttcccactcactccagccggacttcaggcctgccatccagttcccgcgaagcaggtcttcagccgcccaggtctttttctgctctgacatgacgttattcagcgccagaggattatcgccatactgttccttcaggcgctgttccgtggcttcccgttctgcctgccggtcagtcagcccccggcttttcgcatcaatagcggcccgttttgcccgttgctgctgtgcgaatttatccgcctgctgcgccagcgcgttcaggcgctcctgatacgtaaccttgtcgccaagtgcagccagctggcgtttgtactccagcgtctcatctttatgcgccagcagggatttctcctgtgcagacagctggcgacgttgcgccgcctcctccagtaccgcgaactgactctccgccttccacaaatcccggcgctgctggctgattttctcatttgctccggcatgcttctccagcgtccggagttcagcctgaagcgtcagcagggcagcatgagcactgtcttcctgacgatcgcccgcagacaccttcacgccggactgtttcggctttttcagcgtcgcttcataatcctttttcgccgccgccatcagcgtgttgtaatctgcctgcaggattttcccgtctttcagtgccttgttcagttcttcctgacgggcggtatatttctccagcggtgtctgcagccgttcgtaagccttctgcgcctcttcggtatatttcagccgtgatgcttcggtatcgctctgctgctgcgcatttttgtcctgttgactctgctgttcagccttctttcgggcggcttcaagcgcaagacgggccttttcacgatcatcccagtaacgcgcccgcgcttcatcgttaacaaaataatcatccttgcgcagattccagatgtcgtccgctttcttaaacgcagcctctgccttaatcagcatctcctgagcggtatcaggacgaccaatatccagcaccgcatcccacatggatttgaatgcccgtgctgtcctgtctgcccaggtttccagcgtgcccatgttctctttcaggcgtcgggtctggtcatcaaaccctttcgttgcggcctcgttcgccgcctgcaatgccccggattcatcgccggaacgctgcaactgagcaacatacgcaatctgctccgccgttacgttatggaactggcgcgccatcgccgtcagccccgacgtcgggtcagtggtcagcttcccgaaggcttcagcgaccttgtccacctccacgccggatgcagaggagaaacgcgccacactctggctgatggatgcaatctgagcctcaccgcttactcccgccttaaccagtgcgctgagtgactcgctggtctggttaaacgtcagccctgccgcctgcccggctctggacaggaccagcatac

SEQ ID NO: 10057 - DNA, 3515 bp, Escherichia coli
ggatatggcaacgcgggcagcgacacgctgatcaggatagccggtaaaatggcaccaagacagacacggagtttctcgtccctacgggtagcggggcgctgtggataaaatcgctcccacagttcttcaacattaagatgtgacaacgtcaccgtcgttaaaatcaccaacgccacaaaagagaacaagccgacacccgcctggatatgggcataatcctgtacctttatagaagcaacgccaatgccgaccaggtagatatccagcatcacccactctttcagccgctcaagcatcagcagtaccgggcgtaaattcattcccaattggttaccaaaccataaataagctatggaggtcaccagaatgaggggggcaccgataacgcagaaaaagaccatcgcccccgttatcgcatcgccctgtttggtcatttgccagatgccttgcataacgttggcgtcaatacgaatgcctaacagccagatatgcaacagcggttcgccccaggcaaacggcataagcaacagcatggtgaaggccattgccgccaggcgcgttagcgaccagtcgcgcccgtcacgaatttttgcctgacagcgcggacaataggcactttgatgagaatttatctcgggcaggctaaacagcatgtcacattgcgggcaacgttggtaatcaccacgcggcagttcctcgccgatagccctcactgttatcttctttgtcggcgtaatttgtggtgtgttaagagccatgacgtgccaaatgtaataagaattaacattaatcttaacccatgatgggaatgatcttgagcattaacgcatttaatgcttattttaataggctggcagttccaggtaagacaaccaagtgattatataatgaacaaagcagaattttacgcggatttaaatcgcgactttaacgcgctgatggtgggagaaactagttttctggcaacgcttgcgaacaccagtgcgttgttatatgagcgtctcactgacgtaaactgggcaggtttttatttgcttgaggacgatacactggtgctcggaccatttcagggcaaaattgcctgtgtccggatacccgttgggcgcggcgtatgcggcactgcggttgcccgcaatcaagtgcagcgtatcgaggatgttcacgcgtttgacgggcatattgcctgtgatgcggcgagtaattctgaaattgttctgccactggtggtgaaaaatcagattattggtgttctcgacatcgatagtaccgtcttcggtcgctttacagacgaggacgagcaaggcttacgtcagcttgtggcacagcttgaaaaagtgcttgcaacgacggattacaaaaaattctttgcgagcgtcgcaggataatcaacggataacgtagcatttactgatagcgtcattataatgacgcctgttcatgcctgcgcttgttggctacgtccgttgtaatcaggaaatttcatggaaaatcaacctaagttgaatagcagtaaagaagtaatcgcgtttctggccgaacgttttccccactgtttcagtgcggaaggtgaagcgcgtccgctgaaaatcggtatttttcaggatttggtcgatcgtgttgccggggaaatgaacctgagcaaaacgcaattgcgatccgctttacgtctctacacttcgagctggcgttatctttacggtgttaaacccggcgcaacacgtgtcgatcttgacggcaacccatgcggtgagctggacgagcaacatgtcgagcatgctcgcaagcagcttgaagaagcgaaagcgcgtgttcaggcacagcgtgctgaacagcaagcgaaaaaacgcgaagctgccgcagctgctggtgagaaagaagacgcaccgcgccgcgaacgcaagccacgtccgaccacgccacgccgcaaagaaggcgctgaacgtaaacctcgttcgcaaaagccggtagagaaagcgccaaaaacagtaaaagcacctcgcgaagaacagcacaccccggtttctgacatttcagctctgactgtcggacaagccctgaaggtgaaagcgggtcaaaacgcgatggatgccaccgtattagaaatcaccaaagacggcgtccgcgtccagctgaattcgggtatgtctttgattgtgcgcgcagaacacctggtgttctgaaacggaggccgggccaggcatgaacatgttttttaggcttaccgcgttagctggcctgcttgcaatagcaggccagaccttcgctgtagaagatatcacgcgtgctgatcaaattccggtattaaaggaagagacgcagcatgcgacggtgagtgagcgcgtaacgtcgcgcttcacccgttctcattatcgccagttcgacctcgatcaggcattttcggccaaaatctttgaccgctacctgaatctgctcgattacagccacaatgtgctgctggaaagcgatgttgaacagttcgcgaaaaagaaaactgagttaggcgatgaactgcgttcaggtaaactcgacgttttctacgatctctacaatctggcgcaaaagcgccgttttgaacgttaccagtacgctttgtcggtactggaaaagccgatggatttcaccggcaacgacacttataaccttgaccgcagcaaagcgccctggccgaaaaacgaggctgagttgaacgcgctgtgggacagtaaagtcaaattcgacgagttaagcctgaagctgacaggaaaaacggataaggaaattcgtgaaaccctgactcgccgctacaaatttgccattcgtcgtctggcgcaaaccaacagcgaagatgttttctcgctggcaatgacggcgtttgcgcgtgaaatcgacccgcataccaactatctttccccgcgtaataccgaacagttcaacactgaaatgagtttgtcgctggaaggtattggcgcagtgctgcaaatggatgatgactacaccgttatcaattcgatggtggcaggaggtccggcagcgaagagcaaagctatcagcgttggtgacaaaattgtcggtgttggtcaaacaggcaagccgatggttgacgtgattggctggcgtcttgatgatgtggtggccttaattaaagggcctaagggcagtaaagttcgtctggaaattttacctgctggtaaagggaccaagacccgtacggtaacgttgacccgtgaacgtattcgtctcgaagaccgcgcggttaaaatgtcggtgaagaccgtcggtaaagagaaagtcggcgtgctggatattccgggcttctatgtgggtttgacagacgatgtcaaagtgcaactgcagaaactggaaaaacagaatgtcagcagtgtgattatcgacctgcgtagcaatggtggtggggcgttgactgaagccgtatcgctctccggtctgttcattccatccggcccgattgttcacgtccgcgataacaacggcaaggttcgtgaagacagcgacaccgacggacaggtcttctataa

SEQ ID NO: 10058 - DNA, 2975 bp, Escherichia coli
taatctgtatcaggctgaaaatcttctctcatccgccaaaacatcttcggcgttgtaaggttaagcctcacggttcattagtaccggttagctcaacgcatcgctgcgcttacacacccggcctatcaacgtcgtcgtcttcaacgttccttcagagactctaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggccaacgttagaacatcaaacattaaagggtggtatttcaaggtcggctccatgcagactggcgtccacacttcaaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcgttaccgctaaccccatcaattaaccttccggcaccgggcaggcgtcacaccgtatacgtccactttcgtgtttgcacagtgctgtgtttttaataaacagttgcagccagctggtatcttcgactgatttcagctccacgagcaagtcgcttcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgtcgcttcagcaccgtagtgcctcgtcatcacgcctcagccttggttttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcaaccctcacaggccaccttcacaggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcaccccataaagaggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacaatatgtgcatttttgtgtacggggctgtcaccctgtatcgcgcgcctttccagacgcttccactaacacacacactgattcaggctctgggctcctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcacctcaccgacgcttatcgcagattagcacgtccttcatcgcctctgactgccagggcatccaccgtgtacgcttagtcgcttaacctcacaacccgaagatg

SEQ ID NO: 10059 - DNA, 2941 bp, Escherichia coli
ttgccggaaaatcttcctcatcaaaaacagcagggcgaccatcaaaaagcgtcgccccggtgtcatgcttctccagtgcatccagtacggctgcacggagttcagtatgtttcatcgctttattaccattctcagttgatgctgcagcgcatagcccagctctttcggaagacgctcacgccgtatccgctcaatattctgtttaaacgccgtggtcagcggcaccgccatcgggattttcaccacatcaatggggtaacggtttttcccggccacacgctgcatgacatgccaccggccatttttcagttgctgaataaacgcgccgggaatacgacggtttcccaccacaagcacgctgccgccacctttcagggatgaacgctgcccctttttacgacgcctgcgtcgggacaggacaacccgcgcgttacccagcctgattacgggcaaatccccccggttaactttgattctggcctgcggatttttgaccgtggcccttttcagcctggccctttcctttaccagtttccggcgtacctttgtctcacgggcaaccagtgacgccgactgcgatatcgcggatgaagcaacgcggttaatggccattgcggcggcaccaggcactgccgttttgctgatacggctgaggttttcaacggcctgctcaagaccttttatggccatacatccccctttcagcggcgacggctggcggcaggtggttgcccccggttgagccagagataacaactccctccgtcatccggagaaacacggtccacccagaacatctcgccgttaatggtcagcgtgtcaccacgccgtacagcacaaaccgtatccgtaagcacaaataatgacgggttacttccttcaatacggatcccactactggcaaaacccagcgactccggatcgtcaaaaacgccatgaacctcgccgccacgctgtgcaccggaggtgaactgcgcactgatgcccatcacttcaacaatcgtactgtccaccccggcaagggcggcatcaaaggcattctgaaaatcacgcataaacagccattccaccatcaacgtgtgtttttgcatctgaggacataatcagaatcacccgaccaacatccgcaagctcaacggattcccccgtttcaccatcaacgccacagagatggaggcaggtcagaactctgatgcgcgttaacgcgccggatgtttcctcacgaacatcatgagccgcggtttcccgctcccggatatccatattcataacctgtacatcatcgccggatgactgcatttcctcttcccattctgccacccgctgcgctatctctgcggcactcccggatatatccggctcacgccccagaatcagggccagttcatcaagccgtttcagattttgctctttcgttgccatatcagccccctgtgaaaaaagacacgggggcatttcgcccccgctcacggattatttcacctgtaccaccacaaactcatccgggtccggcaacaccatcagcggcgcggactgcgtcatggtaaattcacgggcgggatcccctaccgtcagccagtgtttcggataacgggaagaggccaccacaccttcggacaacgcctgagcatcctgaatggcaccgtaacaacggatcccatctgcagcagtattccccagaaccagcatgccatctggaagataacgtttttcgataccgtcttctgctatataagacgttttcgccaccacaatggccagatcgccgtaataccccttgaaggacaccactgcgcccagatctttcactgccgtttcgagttgagaatttgaaccgcgacgggtatccagtttttcgcggaacagcttaaaaccattcagaagacgccagacggtaccgtccataatggcaatattcacaagaccgctggccaggtcgcagtagaggtcaatatcatgtgtaggatcgaacgtgtcacgatcctgttttgaccactccttaccactaccctgagtgatgttattcttcgtcgacctgccaaaatcgacctcaattttctcgaactggtctccttccatggtgtatttgccatacaacacagcatttaccgcctgcatttcttccacctggacaatcgcgtgctcttcctgtttgaggttatcggtaatgatacgcagacggcggtaagccggatcattcagttgagatggatcttcaccaggaaggcgctcaaccgcctgctggtaattaaattcgtgtttcggcttgacgtagcccggacgcaacacgcgggtttcaccaccacgatgacgcagcacttttccttcaacaaccggggagacataggccgccaccggcgtttttccggtaattttgtccagcatcacctcttcggtatggaaattcaccgtacggcggaaaaacagctccagaaacagcgcacgaaatttaactttttgttcggtataaccgagtaactggcgggtcgtaaacaatcccataaatcagttcctttcattcagaaatcagtcaggccaccgcggtggcctgataacgtgttacggcagcgccgcgtgactcagggcactgccagcaaaggcgttggcctttttgtgttcatccacactttcaggccagtggattgcctccgtcgcaaaggttcccgacttgtaatacgtcagcgccgtctctgtgccttcaagcggcagtaccagtatgccaaccgcactaccggctttctgtccgtcccagaccaccagtttcccggtggcttcatccagcatcaggggcgtcagtgccggtgttggcgaggaaatcccgctgctgcctgtggcggtatgagccggatcattaccggcaaaaatacgtacttccgcacgctgttcagtgatggttttcgtcaccatattgtaaaaacctcctattgatggtcagcactga

SEQ ID NO: 10060 - DNA, 2801 bp, Escherichia coli
gttaactgttccattgtggtgatcccgttttcccggaaagcccagaacccactggcggcggatttcgttcagttcgttctggtcacggttagccagactcgccgggaaagttgccagtaactggctgaacacaccgttgatgatctgcgctacctgctgtacctgcggcttttcgtcgtactgttccggcatgttgttggcgatcccgacgcatctgctcacggtcaaaattaaccatctgtgcggcgatgtttttcataaatccaccccgtaaatccagtcagtgtttgtcaggtcgagttttggtttgcaggctgtcacacctgcctgttgcttgttacggttgatttcgagctgggtccacttgtcgcggagtttggccgggctcagcacgttaccggaccagaagttgtcctggcatgcccagcggaacagtacacacatgtcgcgatggttacgtccgtcacgttcacgcatcaggcggatatcgttagcccaccctgcaaaattcggttttctggctgatggcgcgatggtcttcaccatgtcaaacatccattctgcggcggtcaggtcttctgctgtcccccacttgctgccgctctgaattgcagcatccggtttcaccacagaaaggtcgttttctggctggtcagaggattcgccagaattctctgacgaataatcttttcttttttcttttgtaatagtgtcttttgtgtccccctgttttgagggatagcaatcccccaatttgagggatgttttatccctcgttttaggggattttccctcgttttgagggatacaccattctgagatgtttttatttggtccaaacatgccgccttgctgcttgataatattcattctgacgagttctaacttggcttcattgcaccgtttgacgggtaactttgtaatctcgctaagttgagaatcggtgattctgtccattggtttattccatccataggttttacgcagaatggcaagcagcactttaaactgtcgcttggtcagatctgcgcctgaataagcctcaagcagcatatttgatagtctggcgtaaccatcatcgagatctgccacattacgctcctgtttggcaaagttacctctgcagaagttgagtatttttgctgtatttgtcataatgactcctgtggattgatccagtaatgacctcagaattccatctggatttgttcagaacgctcggttgccgccgggcgttttttattggtgagtccatcaagcgcatacttaaaagccctgctaatcggactgatgtctgatgccattccgaaagcacacaagaccgaagcaataaatctccagtccgttctgcttatcttcgattcatgacagccaatcatctttgccagaccgcgctgggtaatagctgacagattgataagtaaatctgtttctgcgcgatcaacgtcacgctgtgatagtttgctgtaacttgttctttccatttcttaagatttccaatagtgaatagttagttgaaaggtatgcgtggaaacgcatatggccttagttggtcagatatcttggaactcgcttttcagcgacgtaggacgaatgtccgttgttacaaagagcggatccgcttattaagcggctttgtgttccggcgggaacacgtcatcaagactgacttttgcgcctaacttgtttaggcacgcaacaagagcacggcatgttttaaggtctgggaagcgacgaccagattcccaatgtccgatagctccctgtgtgcatccaactgccttagcaagtgttgtttgagagatattcagtgactctcgatattttcgtaggttgctcatatgccctccatagtaaacacgaataaaaaaatacaatatgtactttgcgaatacaagtaaaaatacacattgtgcatggatggttccagtacagagcgtaataataaggacatgaaaatgaaatggtatgaactggctagatccagaatgaaagagctcggcataactcaagagaagttagccgaagagctaggtatgacgcagggtgggattggacactggttgcgcggatctcgtcatccatctcttagtgatattggtgtggtgtttaaataccttggtattgataacatatcattcaaccacgacgggacattttcacctgttggcgaatactcatcggccccagttaaaaaacaatatgagtaccctgttttttctcatgttcaggctgggatgttctctccagaactcagaacctttaccaaaggcgatgcggagagattggtaagcacaaccaaaaaagccagtgactctgcattctggcttgaggttgaaggtaactcaatgaccgcaccaacaggttccaaacccagctttcctgacgggatgttaattctggttgaccctgagcaagctgttgagcccggcgatttctgcatagccagacttggtggtgatgaatttaccttcaagaaactgatcagggatagcggtcaggtgtttctacagccactaaacccacaatacccaatgatcccatgcaatgagagttgttccgttgtggggaaagttatcgccagccaatggcctgaagagacgtttgggtgatgaaaccacttttatctacaatttacagggcggtaaacattggcaaaaatagatgattatcagccaagccaagtagaagttgataaagtactttattgtaaaaaaatagttaacttttctggcgttaaatggaaacagaaaccaagtcgctctgatatgtggctacaagcccatatcatccccttggga

SEQ ID NO: 10061 - DNA, 2610 bp, Escherichia coli
atagtttctctccgatttgtgcctgtcgcctgaggccgtaatcatcgtcggcctcataaaaattaaaactcttttcgcagccaactattgagtcgcttgatccacgagccaactgatgctgtaacacgtttttctacttcagcttcaccgttaagatgtgactctttcccatagtgaagcaatcccaccgccgtcgaataatacggctcctgagcataatccgttaaaccggtaatgttcagcggcgcgccgatacgcacttgcgtatgaaacacgcgctgagcacaggctgcaagaccttcgatctgcgctgcgccaccggttaatacaatgcctgccgccaggtgatgtttaaccccttgttggcgaagcttttcctgcaactgcaatatctcttcgttgaccagattgagcagctcggtatagcgcggctcgatcacctctgccagggtctgacgttgtagactccgcggcggacgaccgcctacgctcggcacttccacgctctcatcttttccaacgatggagcccagcgcacaaccgtggcgaactttaatcgcttcggcgtcacttggcggtgtgccaaaggcgtaagcgatatcactggtcacgacattgccagcataaggaattaccttcgtgtggcgcaatgccccaccggtataaacggcgatatccattgtaccaccaccgatatcaacgacgcagacacccagttcacgttcatcttccgtcaataccgaataacttgatgccagaccggcaaatatcagttggtcaactttcagcccacaacgttcaaccgctttgacgatgtttttcgccatatcattgtgacatgtgatcaggtgcacttttgcctgcatccgcacgcccgaaagccctaccggattcttgatcccttcctgatagtcaatcgcatactcttgcgggatcacatgcaacacacgatgctcatcgcgcacacgcaccgatttcgcggtatggacgacgttttccacatcttcttgcgtcacttcttcttcagaaataggcaccataccaatttcattctggcagctgatgtgcttaccagaaagcgccagatataccgaagagatctgacaatctgccatcaattctgcctggtcaatggcgcgttgtacgcacttgaccacggattcgaggtcgttcaccccacctttatccataccacgcgacgggcaactacccacgccaatgatattgaccataccgtcgggcagaacttcccctactaaagcggcaaccttcgcggtaccaatctccagtcctactaccagttttctgtccgtcgccttgatcattgttgttctgcctgtgcctgattttgttgctgagtagattcctctggcggcaagggcgcccagcctactgccgctccagagtcataacgcaaatcaacgtagctaatccgtttgccatcggtttgcgcctgctgctgtaaaaccggataaagttctacaaagcgagccaaacgtttcatcgtatcgccccgaccaagattgagcttaatatcgttattcagcgtcaactgccaggaacgtcgcgcggtcatcgccgcttccttcagagtaaatctgtcctttgccagcatctgccccatttcgcgatagccctgcaacacttcattggcgctgccttccgggccatacagcattggaagcacctgcttgctggtgcgatctggcggcacgctgaaggtgtttccttccgcgtctaccatatgttgatcattccaccgcgcaatcggcacatattcaaccagatgaatcttcaattcatcaggccactgctttctgacgctcacctgcttaatccacggcaggcgttgttctatttgcgtctggatgatgttgacatcctgggtcataaaggtacctggctcacccaatgccaggatcgactgccggatatcgtcattacgcgtgtaatggcgttcaccggtcaacaccagctttgagagcggcaggcgttgcgcatcttccatccagcccaacacgacccagccgctcaccaacactgtcgttaaaacggtcagcaggaaaaggatccccgccagacgcgttccattattgcggcgagaagaaacctcttcttcgctatttcgcgtgttcagagcagcctgcgacatattagtccgccagttccagaattcgtactaccaactgcgagaagctcatacctgcctgacgtgccgccatcggcaccagactgtggctggtcatacccggtgaggtattggcttccagcagataaaactgtccatcactgtccagcataacgtcaatacgtccccatcctttgcaacctaacgtcgtccatgcttttagcactaatgcctgcaaattggcctcttgtgacgcttccagacctgcggggcagaaatactgtgtctcatcagagagatacttcgcctcataatcatagaaggttccggccggttgaatacgtattgacggtaaaatttcttcaccgagtatcgcaatcgtgaactccggcccacttagccatttttcaatcaatacttcttcatcgtgctgaaatgccaatcttaatgcatcttgtagagcatttctgctactactttga

SEQ ID NO: 10062 - DNA, 2565 bp, Escherichia coli
aaactgctgaaagttctgggccgaggtatctcctgctggatgcgtttggcgcagcgaacgatgtactgaaaggcgctgtgcaaggtatcgccgaactgattactcgtccgggtttgatgaacgtggactttgcagacgtacgcaccgtaatgtctgaaatgggctacgcaatgatgggttctggtgtggcgagcggtgaagatcgtgcggaagaagctgctgaaatggctatctcttctccgctgctggaagatatcgacctgtctggcgcacgcggcgtgctggttaacatcacagcgggcttcgacctgcgtctggatgagttcgaaacggtaggtaacaccatccgtgcatttgcttccgacaacgcgaccgtggttatcggtacttctcttgacccggatatgaatgacgagctgcgcgtaactgttgttgcgacaggtatcggcatggacaaacgtcctgaaatcactctggtgaccaataagcaggttcagcagccagtgatggatcgctaccagcagcacggtatggctccgctgacccaggagcagaagccggttgctaaagtcgtgaatgacaatgcgccgcaaactgcgaaagagccggattatctggatatcccagcattcctgcgtaagcaagctgattaagaattgactggaatttgggtttcgaggctctttgtgctaaactggcccgccgaatgtatagtacacttcggttggataggtaatttggcgagataatacgatgatcaaacaaaggacacttaaacgtatcgttcaggcgacgggtgtcggtttacataccggcaagaaagtcaccctgacgttacgccctgcgccggccaacaccggggtcatctatcgtcgcaccgacttgaatccaccggtagatttcccggccgatgccaaatctgtgcgtgataccatgctctgtacgtgtctggtcaacgagcatgatgtgcggatttcaaccgtagagcacctcaatgctgctctcgcgggcctgggcatcgataacattgttatcgaagttaacgcgccggaaatcccgatcatggacggcagcgccgctccgtttgtatacctgctgcttgacgccggtatcgacgagttgaactgcgccaagaaatttgttcgcattaaagagactgttcgtgtcgaagatggcgataagtgggctgaatttaagccgtacaatggtttttctctggatttcaccatcgattttaaccatccggctattgattccagcaaccagcgctatgcgatgaacttctccgctgatgcgtttatgcgccagatcagccgtgcgcgtacgttcggtttcatgcgtgatatcgaatatctgcagtcccgtggtttgtgcctgggcggcagcttcgattgtgccatcgttgttgacgattatcgcgtactgaacgaagacggcctgcgttttgaagacgaatttgtgcgtcacaaaatgctcgatgcgatcggtgacttgttcatgtgtggtcacaatattattggtgcatttaccgcttataaatctggtcatgcactgaataacaaactgctgcaggctgtccttgcaaaacaggaagcctgggaatatgtgaccttccaggacgacgcagaactgccgttggccttcaaagcgccttcagccgtactggcataacgacatttatactgtcgtataaaattcgactggcaaatctggcactctctccggccaggtgaaccagtcgtttttttttgaattttataagagctataaaaaacggtgcgaacgctgttttcttaagcacttttacgcacaacttatcttcattcgtgctgtggacttcaggctttaatgataagatttgtgcgctaaatacgtttgaatacgatcgggatggcaataacgtgagtggaatactgacgcgctggcgacagtttggtaaacgctacttctggccgcatctcttattagggatggtcgcggcgagtttaggtttgcctgcactcagcaatgccgccgaaccaaacgcgcccgcaaaagcgacaacccgcaaccacgagccttcagccaaagttaactttggtcaattggccttgctggaagcgaacacgcgccgcccgaattcgaactattccgttgattactggcatcaacatgccattcgcacggtaatccgccatctttccttcgcgatggcaccgcaaacgctgcccgttgctgaagaatctttgcctcttcaggcgcaacatcttgcattactggatacgcttagcgcgcttctgacccaggaaggcacgccgtctgaaaagggttatcgcattgattatgcgcattttaccccacaagcaaaattcagcacgcccgtctgggataagccaggcgcaaggcatccgtgctggcccctcaacgcctcagctaacaacaataaacctttacttcattttattaactcccgcaacgcgggggcgtttgagattttattatgctaatcaaattattaactaaagttttcggtagtcgtaacgatcgcaccctgcgccggatgcgcaaagtggtcaacatcatcaa

SEQ ID NO: 10063 - DNA, 2533 bp, Escherichia coli
accctcatcatcttttcatagccaagaaccattcctgttagattacattgcgaatcaaggtcaaccatcaatactttcttgccttcatccgcaagtgcccatccaagattgaaggttgttgtggttttacttaccccacctttatgattaaaaaaacaaattgattttgtcatatttctctatcctttcgacccccagcatattgtaatttacgctgggtgattattttatattgttaatgataatgtttaataaaaataagagagtaaaacaactattagtaatagcacttgcttgataaatattattttttcacctttagttctatagtctaaacgaagaactaaagccggttgtatttaattgattcgtgtatcaatgctttgcccataacataaagttgatcttgggacttctcatcaatgtaccatttctcataggctggattatccgaaagaacggcgagtttgttgccttgcatttgtagacgtttaacgtggaacgtcttaccataaacgaaagagtaaacaccatcagtttggaagttgcgaacagaaatgtcgacaaacagtcgatctccggaaactagagtaggggacatgctgtcgccatttacagtcataactttaatatcatcttgagaacgattaccgaaaagagaacgggcatgctctgttgtgaactcaatggcgtagagcacatcaacatagtctgaaagcatataggttccaggtcctgcgctaacgctaagatccaaaacttctatcctgtatacatcgggttttgttggattggggatgcttgccatttccttacatccttctctctcgccaacaccatattctaaatatgaagctgatacccccagagccaatgcaagtttattcatgacagaggcacgaggcttcgcagcgccgattgtgtatcgccgcgccatttcatatgtaacgcccacaagacttttgagttgggtgacagaaattcccttgtttgtcattagctcgtttagtctcttggcgaaatctggatacttctgttcttctaccataggtagaaggttactcgcatcacatacgctagtcatttctattttaagtagttgcattctgctattttaagtagcatcatccctctgaatttcagaggagaaaggtatgtcatctcaaaactacacagagaaagcagtaaaagctgcgggaaaatctttatctgaagtagcccgtcactttggttttaagtccactcaatccgtcgctaattgggtaattaacaatcaagtcccgtcagaacgggttttacaactttgtgagttgggaaactggtccgtgacccctcatgaactgcgtcctgatatttaccccaatccaaatgatggattacctgagtgctattcaaaagttagcggttcagctgcgtaaacgtaaccacagaaacgaggagttaaccgtgggtaagcatcactggaaaatagaaaaacagcctgagtggtacgtgaaagctgtcagaaaaactatcgcagcgttgccggggggttacgctgaagctgctgactggctggacgtaacagagaacgcattatttaaccgccttcgtgccgatggcgatcagattttcccgctgggatgggcaatggttttacagcgtgctggtggcactcacttcattgctgatgctgtggcgcagtctgcaaatggcgtatttgtgtctcttcctgacgtcgaggatgtggacaacgccgatattaaccagcgtctgctggaagtcattgaacagatcggcagttattcaaaacagattcgttcagcaatcgaagacggtgtagtggaaccgcatgagaagacagcaattaacgacgagctgtacctctcaatttcgaagctgcaggagcatgcagcactggtctacaaaatcttttgtgtttcagaaagtaatgacgcccgcgagtgtgcagctccgggcgtcgtggcgtcgattgcttctggttgtggagaaactaacgcatgaacagtttaacaacacactaccgtcgctcgcaactgattgcgcttcctgtaccgggtggaaaagcgaaggtggaatattgctatgcagtgaatgtaccaggtgacagggaaattgtaacccacagctttgctgagtgggctgtgggtgatttcaaccggcagaaggagacagtcctttgcgacaagttaaccgctggttcaaagatcactacggagtgcccgtcagagtcattcgttgggaaccggaaacacaacgtgttatctacctccgcgaaggctatgagcatgagtgcttcagcccgctcgaacagtttcgtcgtaaattcagggaaatagaggtcggtcatgagcactaaattaaccggctatgtatgggatggttgcgctgcatcacgcatgaaattatccagcgtggcaattatggcccgcctggctgatttcagtaatgacgaagtgtgtgctggccatcaattgaaaccattgcccgccagattggcgcggggatgagtaccgtcagaacggctatcgca

SEQ ID NO: 10064 - DNA, 2402 bp, Escherichia coli
caccaggacactataccgcgatccagctctaccgtgcctcacaccagagctctcagaagctcttgagtgtrragtaatccgyctttttaartcgagtccgtagatggaaatagaataggaggagacaaatcggcgcaacacgggatgaatctcagtggatcgtaagactaagcctactctcaacacttacaatacccggatgcaattaagtcgtcttcaaaggatttatcgagcccaatacttgcaattgctatgatcaccatacactctgaccacaagtcaatgcagccagaggtatagcagcttgaattttggtcaggccgaagcctgacctagcctttttcttgtagcattgagcacggtgtacaacactgcttatccagcatggattccggcttagaggcgttcagccgtaatccagcagatggtagcttcgccgtactgtcttttcagacaacggcattaaccaagtatctggacgaagtgttcctctcgtactaacttcgactactgtcgcagtatctactttgtcagtagggtaaaactaacctgtctcacgacggtctaaacccagctcacgttccctattggcgggtgaacaatccgacactttgagacttctgcgtctcaatgataggaagagccgacatcgaaggatcaaaaagcaacgtcgctatgaacgcttggctgccacaagccagttatccctgtggtaacttttctgacacctctagctgtatacttcacagacctaaaggatcgataggccatgctttcgcagtttgtgttcgtactgaaaaccaaaatcaagcgagcttttccccttttggtctacgtgagatttctgttctcactgagctcaccttaggacacctgcgttatcatttaacagatgtgccgccccagccaaactccccacctgagaatgtcatctacacggattggtcgatgcaagcatcaactgtaaatccaaaacttgcaactcgaagagcgcaagcttccgcttaatagaataagtaaaacaacattacgagtagtggtatttcacgtgcgccggagctcccacttatgctacacctcataagtcgtttcacaatctcagactagagtcaagctcaacagggtcttctttccccgctgactattccaagcccgttcccttggctgtggtttcgctagacagtagatagggacagtgggaatctcgttaatccattcatgcgcgtcactagttagatgacgaggcatttggctaccttaagagagtcatagttactcccgccgtttacccgcgcttgtttgaatttcatcactttgacattcagagcactgggcagaaatcacattgtgtcaacaccttttgaggccatcacaatgctttgttttgattaaacagtcggattccccttgtccgctccagttctgagctgtttgttaagtgcatgcagagcgccgaagcagcctggatcaattgaaggtatcaagcaaggagtccacaagtcacgtgagcaacaagtagtctctgctcgactccaacgattaatccaggttccacataccaaacctcagagccagtccttttcccgaagttacggacctattttgccgacttcccttatctactttgtcctacggaccagaggcttctaaccttggagacctgatgcggttatgggtacgatcgagagtgcgaataaatctatccctcggattttcaagggccagcgagaacactccagacaccctgttagacaaggtgctattccagttcgaaaaccctatctccagatgatctgattccagggtaagtcgaactgttaaaaagaaaagacaacgcttcctggggtcccctatggcgtgtccgagttcacttgtgttgccacatattatccacgtctcggcgctggaatactaaccagcttccctttcgagaaacagagccaaagctccaatccgatggaatttaacctgtctctcaggatcggctaacccatgtccaagtgctgttcacatggaacccttccccacttcggccttcaatgttctcttattgaatacttgctactaccaccaagatctgcactggaagctgtttcactcagactcacgtccaagcttcttcacaacccccacgccctcctactcattgttgccaattatcttgcaacaatggcccggtatcggtcactcgcttcagcgctatccattttcggggctagtcgattcggcaggtgagttgttacacactccttagcggatttcgacttccatgaccaccgtcctgctgttaagatcgaccaacaccctttgtggtatctgatgagcgagcagtttagcaccttaaccgagcgttaggttcatccctcatcgccagttctgcttaccaaaaatggcccacttag

SEQ ID NO: 10065 - DNA, 2246 bp, Escherichia coli
cgccattacctacaaagccctgcgcgacaaaaatgccagagaactgaagctggcgaacgcggcaattactgacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcagtgcagatagagttgctcatatcgatgggcaactcatgcaattattttgagcaatacacccgcgcttccagcggagtataaatgcctaaagtaataaaaccgagcaatccatttacgaatgtttgctgggtttctgttttaacaacattttctgcaccaccacaaatttttgctgcatcgacagttttcttctgcccaattcccgaaacgaagaaatgatgggtgatggtttcctttggtgttactgctgtaggtttgtttccaacagtaaacgtctgttgagcacatcctgtaataagcattgccagagcggcagaaaacaacatttttttcatcttattatcctgcattgttaaaaacggcagaatcctatgtgacaacaattaaacgatagttaaatggattgatgaaaattaaaactacacaggtgggctcagactattggaggaagttggggacactcagaatcctgtggaatgaaataaaccggtctatccgtccattacccttttagctgcgctgtatcgtcgccgtattcccgcattaaccatgaccgtagcccgacggggaattccttctgcgtgagtgtgcgggaataattaaaaacgatgcacaccgggtttttaccgcgttaatgattcgcgggtttatcccggtgcgatggtggaagaaacaggaagctgtattacagaaagtgctactactgtatcccgatgcgatgtatgtaatgtgagtcagataatggcacaggatgtggtgatgtggcagtctggaacacaggatatattgtcagaataagacccgtaggaataaaaatgaaaagacgccttttactactttttctgttatctgtcctggcagtgggatgctcgcagcaaaaagctgatgagccccggcaattagtgacggtgtatccacgatatccggaatatgctgcagcaaattatatcaaggggctggttgaggttaagttcgatattggtgctgatgggactgtgacacggatcgtttttctccgctcagagcctcataatttgtttcgtgatgaagtggtgaaggccatggcgaaatggcgatttgaaaagaatcgcccctgtcagggagtgaagcgacaatttatctttacgccgtcacgtccctgatgcttccaggtagagaggggctggaagcaggagaaaaatgaaagagccagcggttatatttttgtcatggctgacgaggaatgatggaagaaggcgttgtatgccacacaacgcctcactgttcatttcttctttttctctagtggaacccgatgaataagagttgcactggtttccgatgagatggcgatatactcgggcaaagtatgctggcagttttccaactggtcaaaaatacctgctctcgtctgttgcaatgcctgcagcatgcggcggcaatgcgccttgcttttgctaaccatctttccttcctctatcagtcgctgcgtgaactcatcatggaataccaggtaaatgcggatgttatcggttttggctacgcagcatagtacaaaacggacaggtgcatcccgggacgggggaggcgtcacatgtccctgtgatggttgttccgggtaatgcactgtgtggggcataaaaatgtccgataattttactttctaccgcagttagttgattcgttggtcctggtagcacattgggcgaggatttaaatgccaggcaactgaaggatgatgttgcaagggagatagcgagaatatttctgattttcatttgatgatgcctctgtgtgaaatgacggtaaacgacgcacttgtgccggcacataatagcaagcaccataatagatcagattcgattcttgctgtaagtgataattattctcgtttttcgggt

SEQ ID NO: 10066 - DNA, 2233 bp, Escherichia coli
tatcgtcgccgcccggtttggtctttccccagttgcctggggaaaatcctcactaagcttcatcacgcagacgcgtgattacttagcgatgaccttgcggccgcggtagtaaccgtcggcagtgatgtggtgacgcaggtgtttttcaccagaagttttgtctacagacaggctggtgactgcggtcagcgcgtcatgggaacgacgcatgccacgtttggaacgggttggtttattctgttgtacggccatggaccttactcctcaattacggtttatccccgatccaacggggagcaccaattacttacgctttaagctggctaatacggcaaatgggtttggcttttgcgcttcttcaggcagttcaccaaagaccatgtccgcttcggacacttcacagtgttcagaatcatgcaccggaactaccggcaaggcgaggatgatttcatcttcaaccattgcaagcagatcgatttcaccgaattcgttaacctcaatcggttcatacgcttccggcagtgcttcagcctgttcgtctgaacgcacaggactaaaacaatacgttgtgtagacctgatgagtaaacggcttcccgcaacgctgacactcgagcgttaccgtcaccttcgcatcgccgtttaacactgcgagacgttggttatcgatagcgaacgacatggagcattccacatcactgtccacactgactacggattcggcgacgcgctcaacctgatcaggagtatagataccctggtaatcaaggcgtttttgagccgtacgaaccggatcgagagtcaggggtaattttaccttttgcatagggcgcgcatattaactttgtaacgtcatagagtcaaagaaaaaggcagcctgtggttgccttttgccaataattcgcacacattgcgggttactgctttattttcgttcagtgctgataacgaacatcaacctgcaaaacgaagcgcatagtttaaaatggctatcatcaatacgctatatctgatggaaaaaaatatgcctaaacttattttagcctccacctcgccctggcgtcgcgctcttctggaaaaactgcaaatctcttttgaatgtgcagcacccgaggtcgacgaaactccacgcagcgacgaatcaccgcgacagttggtgcttcgactggcacaagaaaaagcgcaatctctggcgtcacgttatccggatcatttaattattggttcagaccaggtatgtgttcttgatggcgaaatcaccggtaaaccgttaacggaagaaaatgcccgtctgcaattacgcaaagccagcggcaatatcgtcaccttctatactggactggcgttgtttaattcggcgaatgggcatctacaaacagaagtggagccttttgacgtccatttccgtcacctgagcgaggcggagattgataattacgtgcgtaaagagcatcccctgcactgcgcgggtagctttaagagtgaaggatttggcattacgctgtttgagcgtttagaggggcgtgatcctaacacgctggttggtttaccgctaatcgcgctgtgtcagatgttacgtcgggaagggaaaaacccgctgatgggatagttttttgcgccggatgcggttacttcgcatccggcaatcggtgctggcggcctgatgcggcgtaaacgccttatcaggccaaccgcccattatcaggtttatatgcttgtattagcgcgcgttacgcagcttttgcaaacaacgcttcaaaccttcatccatcggcgcttcaatacgcatcacctcaccggtccccggatgagtaaacttcaacgctgcggcgtgcaggaacaggcgatttaatcccgtgcctgcttcagtgagctgtctgtcaaattcacggtcaccgtagcgatcgtcaaaggcaatcggatgacccgcatattgtgtatgcacacggatctgatgagtacgccctgttaccgggctacaacgcaccagggtggcaaatgcatagcgctcttccactttaaagcgtgtttccgacggtttgccttcctgactcacacgcacgatacgttcgccgctttgcagaatatttttcagtaacggcgcttgaacgctcttcacatgcgactgccactgaccgcgcaccagcgccaggtaatctttttgcatccctttttcacgtaattgctcatgcagagaacgcaacgccgagcgttttttcgctaccagcaacaca

SEQ ID NO: 10067 - DNA, 2145 bp, Escherichia coli
cgatattcattggcactttgcctttgcggaagccgtcaatacgtacttttttcgcaacgttgaccagctcgcttttaacagcggtctcgatgctgtcagcagcgatagtaatcgttacacggcggccaaggccttgagtggtttcaactgaaacttgcatcttgttacctcaaaaaatcacagtgctcggtcaactcttaccccgcaagcacaggttgttggcttcgcggaaccgggatgttcttataatcaatcacattccctgttaccagaatcatcccgaaagcattcaaataggacgcggcattatagcggcatcacttttatgagtcgagaacggttattgcgcgctgtcgcgtattttttcacaattcccgggcgattttcgtctgaatgctgggcaaaaagcgcaaaatccagacaaaacaaaacggcccgcaggccgtttttcataaaatctttagcaacatactggaaaagcgccgacagttgcaaatgcgtttttacgcgatgcttcctgctccacgacagggaggagaggcaaagacggtgtcctgcaacccttcccactccttaatagtgtaagtatgcagagccagcgcatgaacggtagtagagagttcctccgctaaagtactgtaaatcattcgatgacgattcagaaaacgttcacccgtaaaacgatcgctgaccagcacaactttaaaatggctttcagagccggctgggacattgtgacgatagctttcatccactacttcgaggaatacgggttggaacgccgcccttaatttttcttctatccgctcacgtatcatcatgaaatatctcctccgacaacgctgagatgtcatccatccctttaaatactagccgcttttaccgtttccattgcagcttaacaacaaatatttaggtttcgtcctggtttttccgtcaagcgtatgaagtttactgatttaaagattgaaacacaggcctcgcatcagcgtttcttttaccaggggcgattatttcgtcaacatgatgaatttacatgccttacccacttcccctcgccgtaggcaatgttatgatggcgggaatttttaccaaacacgcttaagagtctctgagagcccgaacatgttcaaaaaaatcctcttcccgttagttgctctgtttatgcttgcaggatgcgcaaaaccgccaacaactattgaagtttccccgacgattacactgccacagcaggatccaagcctgatgggcgtcaccgtaagcattaatggtgccgatcagcgtaccgatcaggcgctggcaaaagtcacccgcgataatcaaatcgttaccctgaccgcctcccgcgatctgcgtttcctgctgcaagaagtgctggaaaaacagatgaccgcccgtggatacatggttggtccgaatggcccagttaatctgcaaatcatcgttagccaactgtatgctgacgtgtcccagggcaatgtgcgctacaacatcgcgaccaaagcggatatcgccatcatcgctaccgcgcagaatggcaacaaaatgaccaaaaactatcgtgccagctacaacgttgaaggtgcgttccaggcctccaacaaaaatatcgccgatgcggttaacagtgtgctgaccgataccatcgctgatatgtctcaggacaccagcatccacgaattcatcaagcagaacgcgcgttaatttctgccctctggcccggtgcaagccgggcctgtagacgcccatgtccagtcaatatttacgtatttttcaacagccgcgttcagccatattgctgatcctgggttttgcttccgggctaccgctcgccctgacgtccggcaccttacaggcctggatgacggtcgagaatatcgatctcaaaaccattggtttcttctctctggtaggccaggcttacgtttttaaattcctctggtcaccactgatggaccgctacacgcccccatttttcgggcggcggcgcggttggctgctcgccacgcaaattctgttattagtcgccattgcggcgatgggttttctcgaaccaggcacccagctccgctggatggcggcactggcggtggtgatcgctttttgctctgcctcccaggatattgtcttcgatgcgtggaaaac

SEQ ID NO: 10068 - DNA, 2051 bp, Escherichia coli
ataagaacatcacgaagttgctgcgcgattacaccatgatgtatcctcgccccttcttccccctttatagcgacagcgttcagccatttataagcgatatacctgacgtcaccccaggcatccagcaatgtttcgtcaggagagaccggctctgtctttaatgttccgtcactggtaaccacaggattggagccaagataaactgtcgagaacctgtttcccggaccaccaagagcatttacattatcaagataaggtttaacatctccgttctcaaaaagatgttcgagtgcgttatataccgcgcgacgtggagtactgcttccggaaccatgcaacgttatcattgcaccatctgctgaagacgttgtttcaccgccgctaacgattaatctctgagcggtaacatcatcagacggtactttcttcgcaataatggcgtaattaccctcaagtttgacttccgcgcgaacttgtcctgatgtacctgcatggacagtcagtgactggacggcaacatcatctgtgaaatcaacgggtacaggaaccgtcctcacgcctgacgtcgacataaaagtaggaagcgttctgttaggagtggctccgtagacaaaatcccttgaaacaaattcttcctgtttaattttcaccctgaaacaatacaaatcagccgggtgaccatcgtgaacataaggatattttctgttgttatcccctatgctccatgggtttagaaagtcttccccaccgaaaatgtagtacagccagttgtctttgatacaaactgaaccaacaccaaccgcagagttaactattccgccctgataaatctgatcagtaacattaacccactctacattatccagactccactcattgacgttaactctggtcataaatgttcttggataatttcctgcataacggttatcaggttctcctccttcccactcaccaaatgcgcgctcactgccaaaaataatcagctcatcgccaactttggcaaaaggaaggtttgagtgatgaacattatttgggaagcgaagagaattccatgatgtacctaaatcagagcttctgtgcaatgaactaccgggttgagtacttaatgtccccctggtcgtcagatacagaatgccatcataatattttacacatggctcagatgcattcgcctcatattctgcaggtatgcgtctgcgaacaaagctaccaggagaaccgaaagcatcagagaaatagagtatcccaagctcgcgtggaccaatatcaccattatggtagccaacagcaaaactgttatcgctaatcgtcgcaaaactgtgaatctcagtaacaggagtgcttccgtcaacaaaagaaggaatagttccaagactggtttttctccatggtgacgagtgaaatgatgtaccaaaactccagtatctaccctcgttattctgatccacatcctgggtattttgcgtcgtaactgtaaaagtatttttatcaataacagtagtcaccgtcatattcccggtaacacctgtaacaccagagtttgagaagttgacaaaatcaccagcaaataatccgtgatcagtaatgcgaatataagcgacttgctgatttgctgctttcgttataccaccataaacgcgaaggctgcgactcattgggcgatcccacaactctgcaacctgcagtttatttccgctcacggtccgcgtctcaattacagcaaaaaggcgatttctgacaacccccatactcatgcagtgatagttaactgtgggatagttttcatgtaaatctgtaagccattccggcgttgtccaggtcttcccgtcatctcctgagcgaacccatgcaacatggaggttatttacaccatggcggtctccagccataaaaggcgcatagatgacattgtcatatacaaacgttttatcctgcgtccaggcgttgtaccacggtgtatctgtaattttaaataactctccctggataaaatcttcagaagcataaaaaagaggctgggcccggtattctctcaaataaaaaacgag

SEQ ID NO: 10069 - DNA, 2030 bp, Escherichia coli
ttcgtgccaatggattgttcccatgccgagccagtaggcagagcgaatttcagcgcatcaggcggctgaccctaagagcattgcgaaggaatgtcgacgttatgtgatgagcctaagaacggtggcaacatccctgtatggtgtgttcctcctgcggcattgatggctcattcaaatttatattccctcctcacccctgcacagtgttgaccagcgttcgatcatctttgatctcacttcgttgatcacgaagccgaagctacgaagcacttcttcacgggccaacattgtactagggtgagggcgcggccggttaaaggtggtggcaggagggcctgcgaaacagccatgacgatcgctgtctcgtaagaagggcctctacaaaagttagaaatcgggataatatatccggcaacccggaatcgaaccagggaccatccgatatctacaaatctacagtcggacgctctaccaactgagctattgccggtctagaaacgcgttgaatgcaatatcctatattattcaacaaattcttcaacgaacacaggaagggcgatttggttacagtagatacaggaagagtgatattttgagtgtggaggaaaacggtataactttgtttgacatatgtcctagataacgctccacgatgggttcgaaccaccgaccttgtggttaacagccacacgctctgcctactgagctagcggagcactaataaaatcaatctaaggttttagccatttttttaaacagctacaaatctctcaagaagtcattggtagtcgctattaatagaaaaaccaccacaaacgatccaactccactggaacaccaggattcatcaggctttggattgaactttacgagagcaataaatatatcacccaccgtggggctcgaacccacgaccacaaggttaagagccttgcgctctaccgactgagctagacgggctaaacaatatcaaagtcgtatagattgttcccagacctcagcatatctctaagcatccactcctaaaacatgacactcgtccatgggtcccttcgcttctcgaacacgaactgagacatggacgagactaccgatgtccgtgtcaccatgatcattcgctcaactcatacttgctgggcttcgtacggatccccaaacggcgtacatatcgagatcgacgacgagtgacacgccgtcaattacaagagatcagaagcagtagatgtattctacttttattcggaattctgtgtcaccagtcaccagatgatatgagctccgttcgtgccaatggattgttcccatgccgagccagtaggcagagcgaatttcagcgcatcaggcggctgaccctaagagcattgcgaaggaatgtcgacgttatgtgatgagcctaagaacggtggcaacatccctgtatggtgtgttcctcctgcggcattgatggctcattcaaatttatattccctcctcacccctgcacagtgttgaccagcgttcgatcatctttgatctcacttcgttgatcatgaagccgaagctacgaagcacttcttcacgggccaacattgtactagggtgagggcgcggccggttaaaggtggtggcaggagggcctgcgaaacagccatgacgatcgctgtctcgtaagaagggcctctacaaaagttagaaatcgggataatatatccggcaacccggaatcgaaccagggaccatccgatatctacaaatctacagtcggacgctctaccaactgagctattgccggtctagaaacgcgttgaatgcaatatcctatattattcaacaaattcttcaacgaacacaggaagggcgatttggttacagtagatacaggaagagtgatattttgagtgtggaggaaaacggtataactttgtttgacatatgtcctagataacgctccacgatgggttcgaaccaccgaccttgtggttaacagccacacgctctgcctactgagctagcggagcactaataaaatcaatctaaggttttagccattt

SEQ ID NO: 10070 - DNA, 1981 bp, Escherichia coli
aaccgagcggtcggaggttcgaatcctcccggatgcaccatctcttacttgatatggctttagtagcgatatcaatatcagtagtaaaataaattttcccgatgcatccgtagctcagctggatagagtactcggctacgaaccgagcggtcggaggttcgaatcctcccggatgcaccatctcttacttgatatggctttagtagcgatatcaatatcagtagtaaaataaattttcccgatgcatccgtagctcagctggatagagtactcggctacgaaccgagcggtcggaggttcgaatcctcccggatgcaccatattctccgtaaccttcagcaatgaaggtatcgaagaggtagcggtattaaccgcaggcaccagggaggataacgttgcgccagcagcggcccgaagggcgaacgccagtgagtcatcctcccggatgcaccatattctccaaaaaatttccttcaaaaatatctcatttctaaataactactttatccatttcctgaattttcttctccttcgccatcagcgacaaaatcaagcaattacgctaaagtaacgtcatatttttcgacttgcgagaagaccatgtacgagcgttatgcaggtttaatttttgatatggatggcaccatcctggataccgagcctacgcaccgtaaagcgtggcgcgaagtattagggcactacggtcttcagtacgatgttcaggcgatgattgcgcttaatggctcgcccacctggcgtattgctcaggcgattattgagctgaatcaggccgatctcgacccgcatgcgttagcgcgtgaaaaaacagaagcagtaagaagtatgctgctggatagtgtcgagccgcttcctcttgttgaagtggtgaaaagctggcatggtcgtcgcccaatggctgtaggaacggggagtgaaagcgccatcgctgaggcattgctggcacacctgggattacgccgttattttgacgccgtcgtcgctgccgatcacgtcaaacaccataaacccgcgccagacacatttttgttgtgcgcgcagcgtatgggcgtgcaaccgacgcagtgtgtggtctttgaagatgccgatttcggtattcaggcggcccgtgcagcaggcatggacgccgtggatgttcgcttgctgtgagtgaagtgttatcgcttttctcgttgtttgccagtagttttctcagcgctacactattacccggcaactccgaagtcgtgctggtggcaatgttgctttccggagtgagtcatccctgggttttagttttaacagcaacaatgggtaatagccttggagggttaactaacgttatccttgggcgtttctttccattgcgtaaaacatcgcgctggcaagagaaagctaccggctggctgaaacgctatggtgcagtcacgctattattaagctggatgcccgtggttggcgatttactgtgtctgttagcgggatggatgcgcatctcgtggggaccggtaatcttttttttgtgccttggtaaagcgttacgctatgttgcagttgcagcagctaccgttcagggcatgatgtggtggcactaattgtaggcctgcacatatggtcaccattacagttatgctaattaaaacgattttgacaggcgggaggtcaatttgatcccggacgtatcacaggcgctggcctggctggaaaaacatcctcaggcgttaaaggggatacagcgtgggctggagcgcgaaactttgcgtgttaatgctgatggcacactggcaacaacaggtcatcctgaagcattaggttctgcactgacccataaatggattactaccgattttgcggaagcattgctggaatttattacaccagtggatggtgatattgaacatatgctgacctttatgcgcgatctgcatcgctatacggcgcgcaatatgggcgatgagcggatgtggccgttaagtatgccatg

SEQ ID NO: 10071 - DNA, 1979 bp, Escherichia coli
cgcgggttgtcctgtcccgacgcaggcgtcgtaaaaaggggcagcgttcatccctgaaaggtggcggcagcgtgcttgtggtgggaaaccgtcgtattcccggcgcgtttattcagcaactgaaaaatggccggtggcatgtcatgcagcgtgtggccgggaaaaaccgttaccccattgatgtggtgaaaatcccgatggcggtgccgctgaccacggcgtttaaacagaatattgagcggatacggcgtgagcgtcttccgaaagagctgggctatgcgctgcagcatcaactgagaatggtaataaagcgatgaaacatactgaactccgtgcagccgtactggatgcactggagaagcatgacaccggggcgacgctttttgatggtcgccctgctgtttttgatgaggaagattttccggcaattgccgtttatctcaccggcgctgaatacacgggcgaagagctggacagcgatacctggcaggcggagctgcatattgaagttttcctgcctgctcaggtgccggattcagagctggattcgtggatggagtcccggatttatccggtgatgagcgatatcccggcactgtcagatttgatcaccagtatggtggccagtggctatgactaccggcgcgacgatgatgcgggcctgtggagttcagccgatctgacttatgtcattacctatgaaatgtgaggacgatatgccaacaccaaatcctctggcaccggtgaaaggggccgggaccacactgtgggtttataacgggagcggcgacccttatgcaaacccgctttcagacaatgactggtcgcgtctggcaaaaattaaagacctgacgcccggcgaactgaccgctgagtcctatgacgacagttatctcgatgatgaagatgcggactggaccgcgaccgggcaggggcagaaatccgccggagataccagcttcacgctggcgtggatgcccggagagcaggggcagcaggcgctgctggcgtggtttaatgaaggtgatacccgtgcctataaaatccgcttcccgaacggcacggtcgatgtgttccgtggctgggtcagcagtatcggtaaggcggtgacggcgaaggaagtgatcacccgtacggtgaaggtcaccaatgtgggccgtccgtcaatggcagaagatcgcagtacggtgacggcggcaaccggtatgaccgtgacgcctgccagctcctcggtggtgaaagggcagagcaccacgctgaccgtggccttccagccggagggcgcaactgacaagagcttccgtgcggtgtcagcggataaaacaaaagccaccgtgtcggtcagtggtatgaccatcaccgtgaacggcgttgctgcaggcaaggtcaacattccggttgtatccggtaatggtgaacttgctgcggttgcagaaatcactgtcaccgacagttaatccggagagtcagcgatgttcctgaaaaccgaatcatttgaacataacggcgtgaccgtcacgctttctgaactgtcagccctgcagcgtattgagcatctcgccctgatgaaacagcaggcagaacaggcggagtcagacagcaaccggcaggttactgtggaagacgccatcagaaccggtgcttttgtggtggcgatgtccctgtggcataaccatccgcagaagacaaagcagccttccatgaatgaagccgttaaacagattgagcaggaagtgcttaccacctggcccgcggaggcaatttctcatgctgaaaacgtggtgtaccggctgtccggtatgtatgggtttgtggtgaatgatgcccctgaccaggcagaggactccgggcctgcagagcctgtttctgcgggaaagtgttcgacggtgagctgagttttgccctgaaactggcgcgagagaaggggcgacctgactggcgcgccatgcttgccgggatgtcatccacggagtatgccg

SEQ ID NO: 10072 - DNA, 1974 bp, Escherichia coli
gcttcctttccattaacaaactttcgcagtaatcccatgacagagacagaatcagcgattctggcgcacgcccggcgatgtgcgccagcggagtcgtgcggcttcgtggtaagcacgccggagggggaaagatattttccctgcgtgaatatctccggtgagccggaggcgtatttccggatggctccggaggactggctgcgggcagaaatgcagggtgagattgtggcgctggtccacagtcaccccggtggtctgccctggctgagtgaggccgatcggcggctgcaggtgcagagtgatttgccgtggtggctggtctgccgcggggcgattcacaagttccgctgtgtgccacatcttaccgggcggcgctttgagcacggggtgacggactgttacacgctgttccgggatgcataccatctggcgggaattgagatgccggattttcatcgcggagatgactggtggcgtaacggccagaatctctatcttgacaatatggaggcgactggtttttaccgtgtcgcactgacagaggcgcagccgggcgatgtgctgctgtgctgttttggttcatcggtgccgaatcatgccgccatttactgtggtgatggcgagctgctgcaccatattcctgaacaactgagcaaacgagagaggtataccgacaaatggcagcgacgcacacactccctctggcgtcaccgggcatggcacgcatctgcctttacggggatttacaacgatttggccgccgcatcgaccttcgtgtgaaaacgggggctgaagccatccgggcgctggccacgcagcttccgtcgtttcgccagaaactgaatgagggctggtatcaggtgcgcattgccgggcgtgatgcaggcgaaaatgaattatctgcccgtcttaatgaaccgctggcaaatggtgccgtgattcacatcgtgccgcgtctggcgggagctaaaagtggcggtgtgtttcaggtggtgctgggggcggcgctgattgcggtggcatggtggaaccctgtgggctggctgggtgctgcggctgtatcgggcatgtatgcggcaggggccagtatgattctgggtggtgtggcccagatgctggcaccgaaagccaggacgcccacggcagccagtacagataacggcaaacagaacacctatttctcctcactggataacatggttgctcagggcaatgttctgcctgttctgtacggtgaaatgcgtgtggggtcgcgggtggtttctcaggagatcagcacggcagacgaaggtgacggtggtcaggttgtggtgattggtcgctgatgcaaaatgttttatgtgaaaccgcctgcgggcggttttgtcgtttatggagcatgacgaatgggtaaaggcagcagtaaggggcataccccgcgcgaagcgaaggacaacctgaagtccacgcagttgctgagtgtgatcgatgccatcagcgaagggccggttgaaggtccggtggatgggttaaaaagcgtgctgctgaacagtacgccggtgctggacagtgaggggaataccaatatctccggtgtcacggtggtgttccgggcaggtgagcaggagcagacaccgccggaggggtttgaatcctccggttccgagacggtgctgggtacggaagtgaaatatgacacgccgatcacccgcaccattacgtcggcaaacatcgaccgactgcgctttaccttcggtgtgcaggcactggtggaaaccacttcaaagggtgaccggaatccgtcggaagtccgcctgctggttcagatacagcgtaacggtggctgggtgacggaaaaagacatcaccattaagggcaaaaccacctcgcagtatctggcctcggtggtggtggataacctgccgccgcgcccgtttaatatccggatgcgcaggatgacgccggacagcaccacagaccagctgcagaacaaaa

SEQ ID NO: 10073 - DNA, 1933 bp, Escherichia coli
gtacgggccagaaagagccatcatcaagcccgagatcgcggcgttcggttgccagcatgatgagatcggcatatttcacgggcgtactcataacccgggggtaacccgtatttctcacggattacggcgtctattttttcttccatccgtttatagtcaggaagaaggcgtttcagtggcgccgggatgtcctggcaatacgcttctgttgcatcatgcattaacgcttcaaaagcaaattcctgcggcaccagttggctgcaaagcaccgcatgttgggcgacgctgtagaagtgtgaaagatgtcctgcaaagcgacagatatttgaaagagaaaccgcgatatcgttaatcacgatgtcgtctttatttatcctgtcataataaaaatgcttcccggaaaaagttttaataaatgacattttgttctccacgtatatgcgctgcaccgcgctgaattctggtaaaagaaagccctcaccatccggcgattattgagtcaattacgtttccataaatgcccccgcaggggcatttgcagtaatgaaatcaggcggtgaaagtaccaataaaggtttctactttgctgtctttgaatttctcaacaagcagatcacgaaattcgttagccatttcttcctgcactgcttccagctgaataatgcgcagaaccagtacaggacgatcgccagtgataatgctgaggcgtaatttaaacggacgttctttcaggccttcaaacggaacgcatttaaattcaaatgccactggcataatatctttggttttcgcttcgacagactccatcagggagcgtttgccgctgaagtcattgtcttcaaaatcagcggtctggtttgcttcaatcgtgattttacggacagccgcagccgcttttgttgcctgaatggcgtcaccattagcatcaaagcccacaaggtagtcggcccagtcttcaatccattctgccagtgacttctgggagttacgctcgccgttaacagacaacagagcagagaacggtgctgtctttttcagtttgagagtggcggtgttatctgcgtgacctggttcatcaatagtacccaggttaagcacactgacggcacgcatattatcggcatcgataaagcagcgggtgccttcatctgcaagatctttagaataacgggtaaagtcatcgatgctggcagtggaaagcgcaccacggaaacggaagcgatttaaattaaatttttccagatcatgaatgcggaaattctcaggcaatgccacagcatcggcaccaatcttactgataatttcattaacaccctgagcagaaataagggcatggatttgattaattgcggttgcgtctaagttctgagacataataagtcctcactatataaagatattcagtgatgagataaataatcagttaattaagaacgatattaatgacctgctgcgcggagttttccgtcaggttcaccggcaagagtcagtaattgtccctggtcttcctgcagaatagtcaggcgaccaccgcgattgacatacatcggcgtttcggtggtgtcttcttcggaaattttcccgcggttagtcggacgaacatatgagagtttgtgttttattttcacacggttctcatcaaacggttcgatttccaggttgagcgagaccttacctttggttttcgtgttcatcacaccggaagcgacttcactgagaactgcgccgattttggtttcaaatacgccgccgtccagctccccgataaattcctgcacgttggtactgcgttcgctagccattttgctgctcctcatcatatcgaccctgcaaggtcggttggtttctccacaaaacagagaagaacacctgcggtggcagccgcccgggtggattgggttatgagcccgtcgtccggtgatgctcttctctg

SEQ ID NO: 10074 - DNA, 1921 bp, Escherichia coli
agcagaatgagcgccgcggcccagttagaggggaagatagccaccacaatcagcagcggcaccgacactgccagcgccatttgcggcaggtagcgtgcatagtaatcatgcatatcgtcaatttgctcgagtaccagcgtcgcccagctccccgctggtttaccctgaatccacgctggccctgcttgttgcagacggtcgagaacctgacggcggatggcaaagcggatatgctgcccggcgtgataacccacccgttcgcgtaaccagaccacccatgcgcgcagtacaaaggtcagaaacagtaacgtaaagggaagcagcagggcttcacggggaatattctccataatcatatgttgcagaattcgcgccatgaaccaggcctgggaaatgatcaatatgccgctcacaaagcccagcagacgagaaatattcagccaacgttgggagatgacgctttgctgttttaaccagcgggttaattctttttgacgggatttattcattgcacgcttagcaggtgagttatcagaattatttgcagagcaatgttacaacggggaaaaaataaaggcgacccatagtcgcatggtgtcgccttctttacttttgttactgatttgtaaaattattttgcgtcagctaaaccgtcgaggtagcgttccgcatcaagagctgccatgcagcctgtaccagcagatgtaatggcctggcgataaatgtgatccatcacgtcgcctgcggcaaagacgccagggatgctggtctgggtggcattaccatgaatacccgactgtactttgatgtagccgttttccagttccagctgcccttcgaaaatggcagtattcgggctgtgaccgatagcaacaaacagaccggcaacgtcgagtgactcgatgttatcgctgttttgcgtatcgcgcagacgaacgccagtgacacccatctgatcgccggtcacttcttccagcgtacggttggtgtgcagaataatgttgccgttctccactttatccatcagacgcttaatgaggattttttccgcacggaaaccatcacggcggtgaatcagatgaacttccgaagcgatgttagacagatacagcgcctcttcaaccgcggtattgccgccgccgatgaccgcaactttctggttgcgatagaagaaaccgtcgcaggttgcacaagcagaaactccacggcctttaaaggcttcttcagagggcaggccgagatagcgtgcagaagctccggtggcaataatcagcgcgtcgcaagtgtattcgccgctatcgccagtcagacggaacggacgattctgcaaatcaactttgttgatgtgatcaaagatgatttcagtttcaaatttggtggcatgttcgtgcatgcgctccattaataacggaccggtcagatcgtttggatcgccaggccagttttccacttccgtggtggtggtcagttggccgcctttttccatgccggtaatcagcacaggttgcaggttggcgcgcgccgcgtagacagcagcggtgtatcccgccgggcctgaacccaggataagcagtttactgtgtttggtcgtgcccatgagatccccatagttgttggcagacaatggcaggattgtagggaatttacagacgtaaaaaaagagtatgacgattttgttaacaatttgtgcaatcggcagcatcgataagcaggtcaaattctcccgtcattatcacctctgctacttaaatttcccgctttataagccgattaaatgatgaataaacgcccctgttaatgaatatctggcatgttgtactaaaaatcgatgttttgctttgacaatcccctggtgttttgcgaaaacattcgaggaagaaaaaaaacagtattcttatatgcgcataaccatgcatgtaaa

SEQ ID NO: 10075 - DNA, 1911 bp, Escherichia coli
gcggtcaggtgctgcaccgctggcggcgtgacaccattcaccgtgccgctctggtcgccgtcaaagtgcgccccgttatccacgatggcctctttttccggtacatgctgcacggcagtgatggcatacgtgccgtcatcgttctcacggatactcacacagcggaacaggcgctggcgcagcgtcggcagcttcagcccccacacgctgtattctgcaacgccgtcaggaacacggctcactttcaccttcacgccgtcggtgacggactggacctccacgctgaccggattcccctgtccgtcaaccaggcttatcagcgtggtgccggaggatggcagcgtgatttcacggtcgagcgtcagcgtccgggtctggctgttcaccgccagcacgcgcccgccggtgctgatacccgcatagtcatcatcgcagatttcaatgacatcgcccggtacatggcgaagcccttctgcacccacgctgaagtccacggtctgcgtttccagcagttccgttttaatcagccacagcccggcgcggtgtgcctgcccccggctggtacagccaaaggcatccatcttcgtgacgttacgaccgtaacgggcaatggcctgcgtgtcctccacaagctctgtcgccgtctcccagccgttatccgggtcaatccagttcacctcaacggcattatggcggtccttcagggcgctgaagctgtagcggaacggcgcgccatcatccggcatcaccacattactgcggttataggtccacaccttatccgacggtcggtcctgcacgaacgtcagcgtctgcccgttccataccggcatacagcgcatcgccgagcagaaatcactgagcacatcccacgccttgcgctgtgtggtcagccaggcattacaggtgatgcgcggctccgtgccaccaaagccatccggcaccgactggtcgcaattctggccgatgacatacagcgcccatttatccacatccgccgcaccaagacgtttccccatgccgtagcgcggatgggtcagcatatcccacagacaccaggccatgttgttgctgtatgctggcttaaacgttccgtcccagataccgctgtattgccgcgtctgcgggttatagttcgacggcacctgcagaatgcgcccgcgaagatgataattacggctcacctgctggctgccgaactgctccgagtccacctgcacgccgaccagtgccgtgttcgggtagcactgtttcacatcgatgatttcggtgtatgacgaccagagcgttttgttctgcagctggtctgtggtgctgtccggcgtcatcctgcgcatccggatattaaacgggcgcggcggcaggttatccaccaccaccgaggccagatactgcgaggtggttttgcccttaatggtgatgtctttttccgtcacccagccaccgttacgctgtatctgaaccagcaggcggacttccgacggattccggtccccctttgaggtggtttccaccagtgcctgcacaccgaaggtaaagcgcagacggtcgatgtttgccgacgtgatggtccgggtgatcggcgtgtcatatttcacttccgtacccagcaccgtctcggagccggaggattcaaatccctccggcggtgtctgctcctgctcacctgcccggaacaccaccgtgacaccggagatattggtattcccctcactgtccagcaccggcgtactgttcagcagcacgctttttaacccatccaccggaccttcaaccggcccttcgctgatggcatcgatcacactcagcaactgcgtggacttcagattgtccttcgcttcgcgcggggtatgccccttactgctgcctttacccattcgtcatgctccataaacgacaaaaccgcccgca

SEQ ID NO: 10076 - DNA, 1895 bp, Escherichia coli
agcagcgccagcacggtttctggtccggtcagaaatttgaaggcgttgagcgcatcaatatccacaccgtaatcttaagttcctgttcacttaacaaatcatcatcaactggcaacattaacaggcgttccattgccggaattgcacgttctgccgcctcacgcagtgcctgatagttaattttggtcatatcacatccccctgaagccgttgcatttacgtaaaaaatcgcagatatagcccttcattttttcgtgccaatctcgatcattcccattgcaccaaccatcaggtggagtccagttttctatcagagcagccattttctttgctttcgccggagtagctgttgcggtatcgcagtaatgacgagtgtcaaccaacgtatccataccatcgatatcaagtacgcaaaaccatgtgtgattcggcatttcaacagatggtatttgttgcccacgtcgacgtttatcaataagacatacagtcactggttgcctcctttgcgaagctgggcagcaaagtcaactaaccactcagtcatttcaaccttccctaccaggtctgaaccagggtgcatacagcaatcactctgcgccgctttgaaatccttatactcatattcttgggccaccagattttttgcagcttctatagcagcatccaccccctgcgcccgtacttcagccaagaaagcgtcggtggctgtggtttcgatatcgttaatttcaggaagaatctcttcccatgtagcgatatcgccattcaaatgccatccggcaattccactggagttatccgcaacactgcgaacggcttcaatagtttcatgcattgcctcattctccgctgccagcgcattagcacgcaccagttgcacttccagttgcgttgccaaatcgctgatcagctttgccacactgcgcatatcaacggcaccacattctgctttcagttccgaagccatctcatgcccggcggcaactaaccctttgatattactttccatctttaccctcgcttatccacataacttattgattacattgataactaaaaagatcgtcgattcagaactcttcgatgttccagccaccacctgctttctttggcttaaccgttaccccgatgattcggaacggatactgatctgcggcgactttggttttcactctggcgtcatcggtccagaatccccctttcacttcgtgcagttccatctcgccggtggcgagcatcacagcaaaatctggcgtatagaacgtgttgtcagctaaccgcagcttgataccctcaaatcgataccagacgatttctcctgcacgtttacgcagctcaaggtgctggcaatacgcagattctgttttgttcatctggcctgttttgagtcgaccaagagcctgcatctgttttctcatgatttaccccttaggtaattaaaaaccacataagacacgaaatcaatagattttagaatattttattacctctaaggtaattatcgagacgtaaaaaaatgcgctatcgcgctggtattacttgataaatcctgacgcctttccccgcctgtattcctccatcagccactgcgccggtgttattcccccaagggtggcggcgttaggcatgcacccgaaacttcgccctggtggatggtaaacgtctctccctgtgtccggaggcgtactcatgggttctggctttgcctgtatgctgatcaccggatcgggtatctgctgtccggaagccacctttttcgcccaatcatcgagcagcctgcgcgcgtgtttctcaacctcaatctcgctaagctggcgctgatacattgcacggcgggtatcacatacgacccagtacataaccggatgtcgccacgggaatctttcgggaccacc

SEQ ID NO: 10077 - DNA, 1876 bp, Escherichia coli
tgcacttttccgggctgacgtacactgtgctcagctgtttttcagcgatccgggatatgcatccgctggatttcagtttgctgaaccggcgtgaggatgacgaagagcctgaagatgatgtgctgatgcagaaagcggcagggcttaccggaggcgtccgctttgacccggacggaaatgaagttatccccgcttccccggatatggcgggcatgacggaggatgacgtaatgctgatgacagtatcagaagggatcgcaggaggagtccggtatggctgaaccggtaggcgatctggtcgttgatttaagtctggatgcggccagatttgacgagcagatggccagagtcaggcgtcatttttccggtacggaaagtgatgcgaaaaaaacagcggcagtcgttgaacagtcgctgagccgacaggcgctggctgcacagaaagcggggatttccgtcgggcagtataaagccgccatgcgtatgctgcctgcacagttcaccgacgtggccacgcagcttgcaggcgggcaaagcccgtggctgatcctgctgcaacagggtggtcaggttaaggactccttcggcgggatgatccccatgttccgggggcttgccggtgcgatcaccctgccgatggtcggggccacctcgctggcggtggcgaccggtgcgctggcgtatgcctggtatcagggtaactcaaccctgtccgatttcaacaaaacgctggtcctttccggcaatcagtcgggtctgacggcagatcgtatgctggtcctgtccagagccgggcaggcggcagggctgacgtttaaccagaccagcgagtcactcagcgcactggttaaggcgggagtaagcggtgaggctcagattgcatccatcagccagagtgtggcgcgtttctcctctgcatccggcgtggaggtggacaaggtcgctgaagccttcgggaagctgaccactgacccgacgtcggggctgacggcgatggcgcgccagttccataacgtaacggcggagcagattgcgtatgttgctcagttgcagcgttccggcgatgaatccggggcattgcaggcggcgaacgaggccgcaacgaaagggtttgatgaccagacccgacgcctgaaagagaacatgggcacgctggaaacctgggcagacaggacagcacgggcattcaaatccatgtgggatgcggtgctggatattggtcgtcctgataccgctcaggagatgctgattaaggcagaggctgcgtttaagaaagcggacgacatctggaatctgcgcaaggatgattattttgttaacgatgaagcgcgggcgcgttactgggatgatcgtgaaaaggcccgtcttgcgcttgaagccgcccgaaagaaggctgaacagcagagtcaacaggacaaaaatgcgcagcagcagagcgataccgaagcatcacggctgaaatataccgaagaggcgcagaaggcttacgaacggctgcagacaccgctggagaaatataccgcccgtcaggaagaactgaacaaggcactgaaagacgggaaaatcctgcaggcagattacaacacgctgatggcggcggcgaaaaaggattatgaagcgacgctgaaaaagccgaaacagtccggcgtgaaggtgtctgcgggcgatcgtcaggaagacagtgctcatgctgccctgctgacgcttcaggctgaactccggacgctggagaagcatgccggagcaaatgagaaaatcagccagcagcgccgggatttgtggaaggcggagagtcagttcgcggtactggaggaggcggcgcaacgtcgccagctgtctgcacaggagaaatccctgctggcgcataaagatgaga

SEQ ID NO: 10078 - DNA, 1844 bp, Escherichia coli
cgaacccgaaacccgaaacccgaaacccgaaacccgaaacccgaaacccgaaacccgaaacccgaaacccgaaacccgaaaacccgaaacccgaaacccgaaaacccgaaccccgaacccgaaacccgaaacccgaaaagcctagatttggagggttgtggtgtcgcactgtcgcttccagtaggctaagtaggttgagtagcatggagatgcgcacgcaaaagaatgcgtgtgaatttagagactgcaaggtatgaagtcagtaatttgatggatgattgggtggacgcgcaagttgaattcatagaaattagtgactagcgtgaatgaataataggatgtggtggttgaacgggaggcaatgggagtagattcaggagtgagtgaaacccacgttttatgctataccgaaatcggaggctggtctcgaaacatgctgcatatgtaacactcatcatatacctagctagaccgctcgagcaatcgtttgacggcgccgttccatagtatattttgtacggagttgtgcggctctttgtacaatgactgcacgatactggaaccgagaatcgaactcgggacctactgcgtgtgaggcagtcgtcataaccaactagaccattccagcaggttagtgcacgaccagacatttgtttctcaacgatgcggttccattttatgtgtttgacacagaattatgtgactttgtgtataacaattgtaacatactggaaccgagaatcgaactcgggacctactgcgtgttaggcagtcgtcataaccaactagaccattccagcaagatgatatgatatcagatatttgtctctcgaccactccgttccatttcatgtgtttgaatgttctcccagttatccctcagggaacgaatcgtgatagcgtaagtggcaattgccgaaatcgcccgctccccttcgacaatgttgacttccatgaactcgcaacgttccccccgccgctggcgaagctgcttggttctcaacattgttcgagggatacgggagcactcaagataacaatggttcacccgatcgctatagagtacccaagcgttcgcgagacacggtcctcagtttttcgttatcgaatgtgcaacgataatccgttgtcaccaggcaaacgcaatatgttctctacaataagctttatcagtgtacagtaaccttagtgagaccatgaacatgcgcatctgggtagatagtggtgatacgaagctgttcagcaaaaacagttgaatcgatttattaacaatttttcaggttaagtgtcaccagtcaccacaatatcaacttctttccataaaattctgagggtagtagtggatggtcaccgtctttcactcccgcatggcgctgccaacatgtacctgtgatcacagagtaactatgacatgatacataccagcacccgcgaataacgcctcaaattgaatgataaggccatggtggcccgtgaaaagcctagatttggagggttgtggtgtcgcactgtcgcttccagtaggctaagtaggttgagtagcatggagatgcgcacgcaaaagaatgcgtgtgaatttagagactgcaaggtatgaagtcagtaatttgatggatgattgggtggacgcgcaagttgaattcatagaaattagtgactagcgtgaatgaataataggatgtggtggttgaacgggaggcaatgggagtagattcaggagtgagtgaaacccacgttttatgctataccgaaatcggaggctggtctcgaaacatgctgcatatgtaacactcatcatatacctagctagaccgctcgagcaatcgtttgacggcgccgttcca

SEQ ID NO: 10079 - DNA, 1807 bp, Escherichia coli
ttacgacgaaactgttcgagcggactgaagcattcatgctcatagccttcgcggaggtagataacccgttgtgtttccggttcccaacgaatgactctgacgggcactccgtagtgatctttgaaccagcggttaacttgtcgcaaaggactgtctccttctgccggttgaaatcacccacagcccactcagcaaagctgtgggttacaatttccctgtcacstggtacatttactgcatagcaatactccaccttcgcttttccacccggtacaggaagcgcaatcagttgcgagcgacggtagtgtgttgttaaactgttcatgcgttagtttctccacagtcacgacacgccacggcgcccggagctgcacactcgcgggcgtcactactttctgaaacgcaaaagattttgtagaccagtgctgcatgctcctgcagcttcgaaattgagaggtacagctcatcgttaattgctgtcttctcatgcggttccactacaccgtcttcaattgctgaacgaatctgttttgaataactgccgatctgttcaatgacctccagcaggcgttggttgatatcggcgttgtccacatcctcgacgtcaggaagagacacaaagacgccatttgcagactgcgccacagcatcagcaatgaagtgagtgccaccagcacgctgtaaaaccattgcccatcccagcgggaaaatctgatcgccatctgcacgaaggcggttgaataaagcgttttctgttacatcgagccagtcagccgcttcagcgtaaccacccggcaacgccgcgatcgtttttctgacagctttcacgtaccactcaggctgtttttctattttccagtgatgcttacccacgattagcctcatcgttctgtggttaaaaattgaaagtgttctgctaatctttcggatagatatccggtcttaagtcagatttcgtaattgcacctgacgtgcattgctcaagttttttagccagcacaaaactggcttttttatagccattgaaaaccagccgtaagtagccaggtgttgagccaacttttccggccaactcgccctgctgttctttggttaaagagtcccaatacgctttcatacaatgtgtacctccggtgtacatattacatgattgaaatgaaccttcaagatacttgtaccttaacggtacaagggttttaatttcgttatgaaaacaatccatgacatccggcggtctaacgccagaaaactgagagatggtgttggcgggaattcttcctttgccactatgattgatcgcgagccaacccagaccagcaggtttatgggagatggtgctactaaaaatatcggtgacagcatggcacgacacatcgaaaaatgtttcgacctgcctgtcggatggctcgatcaagaacaccagacaacgaacatcacaaaaaaacctgatgtttcaatcactaataaacaaatcacattagtccctgtcatatcatgggtacaggccggagcatggaaagaagttggatattctgaggttgatttgagcacagcagaaacgtatccctgccctgtaccctgtggggaaatgacttatatcttgcgggtgataggtgattcaatgattgatgagtaccgcccgggagacatgatttttgtcgatcctgaagtacctgcctgccacggtgacgacgttattgcattgatgcacgatacaggtgaaaccaccttcaaaaggttgatagaagatgggacacagcgttatctcaagcgttaaacccaaactggcctgagccttacattagat

SEQ ID NO: 10080 - DNA, 1804 bp, Escherichia coli
ggcggataaaggtttagacgaaatttttgatacgatttccgcttctcccccagttcggtcaacgcagtcgtatctgaagggtgagagtgataaagatattgtttctcccacgagcggttggttttgagggatacgcacctcgaccaagaaacttttgacgtatggacgactctttctcgtctcggcggcgctccatctcggctacaaggtcgacaacacgaggaaagggaccaacactgccgattcttattgaaataggcttgctgtcgtatgaaaatgctatagaaaccatgcacgaattggaagacacgaatagtatagatcttacattttttaggctttgtcgcttcaagagatctacgtatttcgtgaaacatttcggcctcgcgttttgctcgtcgtgcctctaactcgtcaattctctgtttgatccttccgatgtcagtagttgtgggtggcaatagcctyacagtaaacggctggtatgagragttctcaacaagagatgtgttttgcttcaacgaggacaattcatttgcctcaaaytcgcgacggctggcttcgagtcgctcaatctaagtagggaagaatcggctcgttgacgacatcaaattccacgccgagacttcacttctcctmggatttgtggaaatgggtcttcaggtggaacragaagcacttcagttgagtggccatttgaatgsatctcgtagcttggtgcagcagacaccacagttgccgctgcaagtgaagcatagatattcatggagttcaaatgtacctaacacacatcaygaatagaagggaagaacmacagcgatcgacaacattttggacgaacacaagaagaaatgaaatcgattgcgtaaattgcagtctgcaatttgcaatttgcagagcatcccggattaatttatgcaagatgccttttttgcatascgaattcgcacatgactggtcagaggtttgcattcagaaccacatcactggctgaccagtycgtaatatatcgatcctcgttatattccattgaacagaactcaaatcatcatttcacgcattcgacgaaaaacgcgcatatcaagagcacatttcaatttyctgagcaaggccwgaggtgcgagatctcaaggggcaaccttagctgaggaagtcacccaccattcttcggcacacatcgccgcccaagatgctttatcttgtatggacatcgcggtaaagttgatggatcggaggcagctaccgcgcgtgttgtgaggagcaatacacccctggctaacggagaaagtccatccttgtggacagccggagaaatctcttgcgcagctatccgagcacggcctgaatcacggttatagaccggggcttccgtcctgtgaggtaccagtggatagcgcaatcgcgtgcaagtctttgcttctcgggaacactcaatgggtgggtgaaagaggtgcatgagccagtataatccgatggtgggacacaaacttgccctttgctttcccagtgcaaagggcactgtaatatgactgctcaacatagatgagcagttcgatgtacctctcctgaatattctcgcttgcataatccattgaagaagtgacttgctaggcgattctcgatagatgtgtccactgattccttcgcaaccgttgtgtatatctgaaaccgcagcatttccatcatctttcgcactgtaaaatccgcggtgtatgaccttttgctaccaggaaagcgcacaaaacgttggcaaataccattcagttgttggagtaaaaataactggaatctgcagaagccaatc

SEQ ID NO: 10081 - DNA, 1792 bp, Escherichia coli
gacgtgctgatccgttcaaacgcgaaacttaattcgatcgacctgggggaaacggcgccggcttcagcaagcaacgagagaaagcgtttcatcttctaccagtcttggaaggctgggcacctacctgatgaagatttcttagacaagatgtcggagttatgcggagtgaaggagaagcattaagtttatgtatgttgaacgtacagtagaaataaagtttctgggcatgatactgcagcgcaatcatgatttctcatctttacctctcgagccattattgttgcgtgaacacagtacgtgtagaacatctatgtaacgtagtatcaacaaaagcatagcggagcacgcgcagcagggaaattccatagcagatgtgagagacagatgaagaccatgtgtatgcgcgtggcacgcacataacagaaaaagcggcagaaaaaccacacaacggacacatttcgcgtataataggactgaaagaaatgaagagctgcgtaagtacggacatcgtcaaagtatcgtccgggtgattgcagataaaacctcacccagtgaggaattcatacttcccgtagcggaagaacgctcccagaaagtagtactttccggtgagttaatctctcttacccgccgatgttttagaaaaaaatgcgagaaaaaagatagaaatgagcagaaaagtggcagaggggcgtatgccataatgtatttctgccgagaagaaaattgaaaaagagcaaattctaaaaacatgctgaaatgcatttctgcccaagagaaaagagcgtttcagcagaagtgcggttttgcataatgtcagagcgcttttgtaaatcagagtgctattatgtgtgataagagtgcgattttgtaaatarctggcgctgttttgtcgtttaraaaacagcggacacataagagcatgtgcggttcttacgggccaaaatggaaaacagcattccgctgttgtgctgtcgtgctgttttgtattgtgccgctgcaacacacgtcgagttgcttgcttatgaagcttgttaagctatatactagacagtatctacatttactcctgagtattggtgacacatcgaccatctgcacatcgacctccctcccagcgatgactgtttgagttgccatgagtggggagacactcaccaaccaactctacttactaagtagagtttgaactaaaagttgtaaactaatagtttgaattcttcgccagaggtgtatgttcgatacttcaggcgaaggatgctcctctcgtacttcacttgtgataacaagaccgaggcgtcaatttcttctcttgggtttctgtgttgcaccgtctttagatggcgagtggattcagactcaacagtatctgcgaatccgttctccgaaagtatcacacaatctcatccctctgacccgttgatacgtattcgacaacacagcacaactgcctgtgacaacgaacaccacatcggacagcacatagcgccatataccacgatccatactataaccgaaaactaatacagaatccatgaaggatccgtaaatgatggccagaggataaattgaggaggatacgcactcttccgatctgtgactcggtagattggcgctccaatgggtatgaaatgatcctcgatcttggggtcagtctggccagcgaaaagccacataactatgcgccagaggatcggcttccacttcttgtcgttcagtagggcagtagagccttcgccattattcttccccaggatgtaatacagatagcgattcaattgtctggagcaaa

SEQ ID NO: 10082 - DNA, 1789 bp, Escherichia coli
aacttaacgcccagttaagactcggtttcccttcggctcccctattcggttaaccttgctacagaatataagtcgctgacccattatacaaaaggtacgcagtcaccccataaagaggctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacaatatgtgcatttttgtgtacggggctgtcaccctgtatcgcgcgcctttccagacgcttccactaacacacacactgattcaggctctgggctcctccccgttcgctcgccgctactgggggaatctcggttgatttcttttcctcggggtacttagatgtttcagttcccccggttcgcctcattaacctatggattcagttaatgatagtgtgtcgaaacacactgggtttccccattcggaaatcgccggttataacggttcatatcacctcaccgacgcttatcgcagattagcacgtccttcatcgcctctgactgccagggcatccaccgtgtacgcttagtcgcttaacctcacaacccgaagatgtttcttgcgattcatcatcgtgttgcgaaaatttgagagactcacgaacaactctcgttgttcagtgtttcaattttcagcttgatccagatttttaaagagcaaatatctcaaacatcacccgaagatgagttttgagatattaaggcaggtgactttcactcacaaaccagcaagtggcgtcccctaggggattcgaacccctgttaccgccgtgaaagggcggtgtcctgggcctctagacgaaggggacgtatcagtctgcttcgcaagacgccttgcttttcactttctatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacggttcccgaaggcacattctcatctctgaaaacttccgtggatgtcaagaccaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgcttcg

SEQ ID NO: 10083 - DNA, 1737 bp, Escherichia coli
cttcgtggcttaaattaggaagttcatttaagctcattagcgtgtatcacacgattgcgtcgcagtcaagattcgttctccgagtatcttcccgttccaggcgagctcaacgctggaatcttgccggtgcgggacacgtatgagctcgctcccagtggggtcgttcaatataccgatttcaatacttagaatcatttccaggattgcctgtctacagaaccgcctgtcggctgccttcgctttagtctacagatgaattctcagtgtgtctgtgaggtggttcccatattagtgagagaaggtcattactcgacactaaccgacgaagcaataatagttgcacgccgcgagttactaacgtgtagcaagttatgtgcgattcatatatcgagtcaaggacaaacactcgagacctgtactactcaaacgcgtcgcgggctcggcaccgccatttgagagcgtctacgagtatcggattattgactgacgttcaggactcgagtagaacacatccgagtagcgacacgctcagtggccttggtaacgatcaaagttacataactcagtcatataaactttatcgtagtgcagacgttgcggatcaccttattattcgaattcccgcgtcccatccaacacttgcggaaatcagcaacccataggggcgctatggcattgatgaacttaacacagttagtgcactcagacgtatccatgtcaccgtttttcggaatgtgttcgtctcgaggtatttattgtgaataacactacaaacacgacaccaactgggattgaatgtaagactacgggtttgaatcgatttacgaatctgacatgcaaaaaaatggtcttaggttggcgatgaacgagaggtgaagcatcttcctcagatatgcgcatcgccaccgtaaacaactaactaggaactatcaaacggttaccgtaacccaggagggttgacagatggcgatgcagggatattgggtgttgcactagggatgtcaggcgtggcgctagggataactggcgttgcgctggggataactggcgttgcgctggggataactggcgttgcgctggggataactggcgttgcactggggataacacgcggtgttgaagtcgcggatgaactggtagggattacggatgtagttgtcacggtttgagtagttgtaggagttgccgaagatggcgtagagactaacgttgttgtaggcagagtcggagtagttgtgagagcagacgtagtagaaataattgtagaagtggttatagaagtagttgtcgtacttcttatcgtagtcgtagtcgtagttgtagttgtagtcgtaggttcgcatacagctagactgccacagaactgattacccaagtggcatactggtggagtccgccaccacttgcaataacttgcgggattattgagatcttgacagtaccgatcacaggcatcggcagtctccttggggggcgtaggttgaggtggaatcgtagcaccaggtcgaactgaggaggaacggttagctacatatcataatgggaccacaacactccacatttagcacgttaccatcacaaacatccgccgagcatggttgattccctgtcatgcacactgggtgggtcagccaatgtttgcagtagcttgaggccccgtttttaactgaaatggagaaccggagatctcaagttgagagccataatagacgaagttcaatctcactttgcaataga

SEQ ID NO: 10084 - DNA, 1728 bp, Escherichia coli
ctttcgtgatagcaaggtttgaccacttgataatttccggccaggtcttcgttcgtagctggttgtcggtgttggcggtcaccacgaccttacaatcctcgcaagtggacatgccccagttgatcagcattgagatgaatgcggatttaccaataccgtgaccagaagcacgtgccagcataagcggctgatatcgcgtctctggattctgcaggtgatcacgtatctctcggaacgcatcggcctgccactgacgtggaccggtggcatgtgccagttcagtaccctcttccccccacgggaacgcatagagggcatagccaagcggatcgtgagtgaaccctgcaatatcctcgattaactgctcttcaggagataacgctgtatctgtcactgattgccatcctggcgttctttcagtctcttcctggctgccgctatgcgatcagcaattgtcacattcacattaacatccaggcgttctttgaatgcgttgacgtcgacgtgcttaccaatcagttcgaggttcttcaccttgtcaggccatttaatttttttgaggattgtctctatcgaatcctcgttcatgttcatgatggtcgatgacagatcaaagccactaagcgtagtgcgccagattttcggccactcgcggattggcttaaggctcccatcgtcgttgaggatgtcgatcacgtccatctggtcgatctccaccaggcgcatgagaacgtaatcagcactgacgcgcattcgtttgttgcgctcttccatcagctcggcaatccgtttttgaatgcgttcatcgcgcatcatgagactggctttaactgccgctgtatttggggagaatcctgcgttaatcgctgcctgagtctggttttcaggcgttttgatgtatgactggcaataagcctcctgcattgctgttagtggcttaaattgcgttgatttgcgtttataggctttaggttcagcaggcatcataaccaccgtggtaatagttaccgttgtggtaatagtaccatgcaaaataaagccgccatagttggcggcagtattcaaaaccatcaaattcatcatgcataacccactcgtgacatgtcacaatattaatttcgtttcatgccagcctttggtcacccagcattgcgagtcaccattacacgggcatgaattcacaggaactctctcgccgcacttaccgcaacgttttctgctgatcgattttatacgcccgtgcacgcgagcatcatcctggcggataagtaacgcaatatactcaccaaattcgtaaggcgcacgcccggggcgacgcgtggcacagttacgctccagcatttcaatttcctgagcatcaagcacaatctccagtttacgcacaccagatgcagcttgtctggctctctgagcggctttgcgctctgctgctgatttagccatcaatattcacctttatcgcgaacacctttaccggtttatcaccgaagtggggatgtgtgattgtcttgatttcatatccgtcatacgggacgtcaattctgcggctggaatcgtcgcgcttcggatatccctttgtgataatcaggcggtcatactcgcggaacataattcgcttattccagtagtcattacacaggcgatactcttccgttttctctccgcgaatcatggcatcgaagtattcacctttaacggcaagttgcaggttagccacgaccttcctcc

SEQ ID NO: 10085 - DNA, 1722 bp, Escherichia coli
ggaaccgttaatgatggttttgattcttgatcaaagaggtgggcgcccttaaaacatttattttatttttatataaatgaatgatgtagatttaaaaattttaattgatgatttagtatttaatcaaaattttcttacttattatgaattaaaagcatatctccaaaaatatgatgaaaatataacgggtgatgatatggattattattattcatattataaaaatgaaattttgaaatatcatgataaaataatttctaaaattaaagacaaaattaaaaataatgaatatacaaagggaaaaactaaatcacaacttaaacaattgaaagatttcaaaaataaagtattaacagaagaagatattgatgaattatataaattatataatcctgagctgcaaaaaacaaaggaacaaaagctaaaagtgcaaaacgcccaggtcattcagaccataaatgaagcacaagctttaatttatgattcattagttaaaccacattcagcccgacttttaaatgaagatcaacttttggaattcatccttcaacataaactcgaagcgggaaagtatatcaaacctttatatacagcatatttaaaacaaatgaatagaatacatccagaattaatgaaaggaggaatgaattccaaaacttcatcatccaaaatcaaagcagataaaattaaaccacttgcaacaccaaaacctccaacagtagtacctcctcctccttcagttaatccttcatcattcactttattatatccatttcaaacattaaagaagcaaaaagattttaaaaaggatttcaagatattaaataaaccaaytgacccaaaaattcaaccgttaaaggaaaaatttagtcgcccttcatttgcaccatatccatattcatatgaaatcgatcatctgggatattcaaaaggaaacgttacttatttatttgccattaacattaacactagatatttatattgcattccagtgaaagggaaaacagaacaggaaacaagaagagctattcaatacttactagatcatgaaagagtagataatatcaggggtgatagtgataaaggatttcaggcaactatgattcattatttcccacaaattaatttttacttctcatcttctccatatacgtttcataataaaatagttgatgcggtaatgagaactcttagagatgcgttaggggttaacggtcagatatactgggatggaaatcatgactccatcatacaacagttagtatattattacaataatacatggcatagaactataaacatgaaaccagtggaaatgaaaaatgatatttcaaaagaatgggaatatattagaaagcaaatggaaaggttgaatgatgttaaacgtgaacaaattaattcggggctcatgaattttaaacaaggggataaagttttgattcatctcgattatggaaaaactaataaatcaatgacaaaaagaagacgaagatttgacacaatagctgaatttgttagatatattaacggcaatgcattagttgaagttgacaataaattaatagaaattccgatttattttattactccattatatttaaataatatttaatttttttttatttcgtaagaaatgggtgacaacgaagcagccaagagtccagacgatgaatataaaaagaaactaaacagaattaaatcaaaaatatgctattacaaaaa

SEQ ID NO: 10086 - DNA, 1692 bp, Escherichia coli
tatgaacgatgtcttatacggagcaaagaaaaatggttttttagaatccgatgttatttgtttgcagtcttatagattaaattttatttttaaagaaaaaaattataattttcatattgaggaaccaaaatattttacttcaataattaatatgtaattttattaaaaaactttacaatatatttatgactaaatcttttgtacaccttcatgcacatactgagtactccatgcttgatggtgctgctaaaattaatgattatctaaagaaagtaaaagaacttaaacaacctgctgctgcaattacagatcacggcaatctttacggtgctttagagttcgttcgtcaagcggactcattaggaataaaaccaattattggatatgaagcttatgtaacacctggatcaagatttgatagacctaatagagataacaataaaagatatcatctaactcttttagctgaaaataataaaggatatcaaaatctagttgaattagttagtaaagcatatttagaaggcttttattacaaacctcgtgttgattatgaattattggcagaacactctgaagggattatagctttgtcaggatgccttggtggtgaagttgctcagcatttagcacctgatggatcaaaagaagagggaaatattaaaaatgagaaaagttacaaaaaagccttagagaaagcaaaaaattatcaagatatatttggtaaagataacttctttatcgaaattcataatcatggaatcacacaacagatagaaattttagatgatttagtaaatatttcaaaagagttaggagctccactagttgcttcgaatgattcacactacgtagcacaagaagattcttctgcacatgacgctctattgtgtgttcaaacaaatgcgacaatggaggatgaagatagatttaaatttgatggggaagagtactttgttaaatcttcagaagaaatgagaaaattatttccagatgaaaaatttccagatgcttgtgaaaatactttaaaaatagctaatagggttgcttatgatttcgacttcaataaagattacttaccagatttcccagttgaggatgattctttatccgcagaagaatatctaagaaaaaaagttttaattggagcggaagaaaaatatcaagacattaactcagaaatacaagaaagaattgactatgagttagaggttattaattcaatgggttttgcatcttattttttaattgttggtgatttaattgattttgcaaaatctaaaagtattagaacaggtgctggaagaggttcagcagcgggttcaatagtttcttattgtttaggaataactggtatcgaacctttaaagtatggattaatttttgagagatttttaaataaaggaagaaagtctttacctgacattgatatggattttgatgaaagatacagaggagacgttatccagtatgcagttgagaaatacggcaaagatagagttgcacacattgttacttttgcaactatcaaagcaaaacaagccattagagattcagcaagagtattaggcttacccttttcaagtggtgataaggttgcaaagatgatgccacccatgattcttggtaacacagccacaatttcagagtgtttacaattagatgaagataatgtaagtggttatagtaaag

SEQ ID NO: 10087 - DNA, 1681 bp, Escherichia coli
tagaagtaatttccctcgtctcccatacttccaaatgtatgcatatgacataaacttttatgcattacacaaatggcccaataatatctatagagtaaaaaattagaaatttaatttttttatatgatagttatatttcagatttgcgagcgtaacttttttctccatggcatacttgttttaagagcaaatgatcaaaatcgtccttcaattattgaaggagctgatatcttttgaaaattgaattgaaagggtattcaattttcaaatttcctctcaattttggaaacatatcaactctatgaattaacaattatgtgccttcacagtttatcagtcatataaggtgcttataaagaaaaaagttacgctcgcaaaatatgtttttatatagatttcacataaaataattatgtaatttctaaaaagaatatttttgttcttggatattaaagtgtattgtagtttaaaaagttttaaatatgttgctaaaatttcaggtttatagctcatgtctagcatgacttcttcgtatgcgcaaaaaatctgacacgtaagggtatccttaagaaattaatgattatttgaatttatgatatcaattatttgatttattctttcttcaatctcttctattctttttgttaaatcatcaattttcattaatgaggtgattcttgattgaggaatagatttcaaactaaccaccccttttatttttgaaattttgaatccatcaactttaaacattttattcaatttacacgttgtcaattcttcaaataattttttattrttagcataatagtcattaaattcttcaacagatgaaaaaatttttrtttcagtaattggtttaacaacrtttattttttgttgaacatyttcactttcattwatttcytcctcctctgtttyatttatttttaaaattggtttcatttatcattaaataaaaattagaatataagtgatgaaatatattttttaattaatattaaatcagaaatggcggcaggattctttaaaaaattatgggaaggaattaagaaagctgcgggttgggttcataaaaatattattaaacccgttgcaaactttttggcaccagtagcgaacacggcaggaactatcataggtggagtattaggtacaaaagcaggtaatccggcaatgggagcacaagcaggtaacgcaattggtggaattgctgaaggaatacttaataaaataggaggtagatagtggaaaaataaatattatttttatcttagtatcggttgaagtctttgataaactttttctcctttatttaatatttctcttattggggcggcttttggtgttattgactcagcaacgtcactaattgcttctttattcttaaatatccaatttgctcctttcttcattgtttcccaaactttatgcgctcctctttttactttatcccataattttttaaagaatcctgcagccatagttgattatttcattaaaattaaaaattcattttcatcttttaattttgattttttatttattaataaatgacgactaactatttggtgccaaacactaaaccgattaatggaaatgtgtttcattcattcgaaaagataaatgaaatattcacaaagaatgacggtagaagatattatagagaactgaaagttcatgc

SEQ ID NO: 10088 - DNA, 1646 bp, Escherichia coli
actacttggactcgtatcgtgagcgtctcttcaacgatcacattcttttaactatctactactctgaagtagattcagatgcgcaccttgtgaataattttaatagccacgccgatgatatccgagacgaagttcagcaattgaggctggagattacattgagagcgcagatggaccagacggtcctatggacaagacactcggagggcgtgttcgaggatgaccaggacccggtcaccgggtgatcatgactcggaaagcacctggtgaaggaaagggcttggggctctcaagagtatctatggatagtgcatggctaccgcgaatcgcggtccgagaacgatacgcggaggagcaatacaatgttgtgagaatggcactgcccatggcagtggcggttagatggcattaaggggtctgatgtacacatggaaatgtaaggaaaaatggaaaaatgccatggaagctatagttgtaatctccgtcttgccaccgaagatgccgagaatccgatagtgagcagtgttgtaacatatgtatgctttcctcaactgatctagagagttccctcactgcattgaacggctagggttgagctgcatggaaacaacaagagtttgccgaggtgttcgccatcaacacacgtggttcgccatatgcaaactctccgacactgatgatgaaacgatcccaaaggttaaacgtagctcaacaccaacaataccagacacacttagtgaatcccgcgtccattcatgcctacatgcctcaacatagatgttgtcgcccgataratactcactcctgagtacatacatcraacacaatacatacacccttctgtatgtgagagactttctttaacgtttcccgacatgctgcactcaagccctccgaaaccagccaaagtaacttactttaagtaagttcaattatttccatctcgtatgcgttatcgagtgagtgataatatcattatgatcatcgcagtgaggtacccaatatccactgtacaatatggcatattaaatatgctacatccatatacgggagctacatcggtgagaccatgggccactctggaaatactattccaatccgggtgatccatctcgatgtggatgagcctgtggtctgaactacacaggtcaccgacaacttcccattgcggtggatggcgactgatcagagaggcttagttagcatgtccgacttggaggctccgagcttcgagtacgagttgagatttccgccttcctaatgcgtgtagaaaagttccgagcgaccctgtattgaacttcaataattggattgctctgcaccggtagggactggcaaccgaacactttctctgcgttcagactccgagtctaattaccacacattagtgatagggttgtcagaagttcaattacaggaacgccaaatgcaactgcgcattgctctatcattacaatggcatgtcaatggcatcaagcaagacaagtttcttttgtgtgcgtagggttgtggaatatctccgcagttctactggagatgcttgactttcgggtcaaggcgttatcaatgttggttatcataaccaggttatgcaaggctagaaactctgcgttaagacaaagttattgatctgttcgctgatttaa

SEQ ID NO: 10089 - DNA, 1641 bp, Escherichia coli
ccgttccgccgaccagactctgcagatcttccaccatcccggtgaccataccgtacaggttagaaaccgtcagcgtggggcgcgtactggtgcctttgccattcagttcaaaactactcccctgaatgggatacggctgatactgtcgcccctgccaggtgaccggctcacctttttcgttctgctcattacagaaaaaataacgttctccaccgacctctgtcagatcgatttcccagagcaccacgctggccgactgctccgcacgggtgcattcattcaatgtttcctgccggatatcctgcatcagttcaccacctgttcaaactctgcgctgaactcaacacgcagcatactgacccgcgacgaccattttgcgcaggtcacctttatctgcctgtaaccataaggcggcgtccacagaaaggccttccagcccccgtgctcagccagaaacgactccagcgccgtggcctcctcacgggagacagacagcgtcacgctgtacgttttcaggtcagcgttcagcccggcaggcgcacgctgggaatagccatcaccaaagcgcacctccctgacggaaggagccgatgtcacatccatcccgggtttcactttccagcggaaggttttcatcgtccacctccggagaacagaccaccatcgcgcatctgtgcctggatttcatcacgggcacccttgcgggccatgtcatacaccgccttcatcatctgtggacctggcagaccattcgtaccgtcgttctgaatcaccacgttgttgttctgctcaaacctgataccctctgaacgccgcatttgcgccggacttccggtgccaccgacataaccgccggtggcatagccgcgcatcagccggtagagatttcccacgccaatccggctggttgcctccttcgtgaagacaaattcaccacggtgaacaatccccgctggctcatatttgccgccggttcccgtaaatcctccggttgcaaaatggagtttcgccgcagcggcctgaatggctgtaccgcctgacgcggatgcgccgccaccaacagccccgccaatagcgctgccgatactcccgacaatccccaccattgcctgcttaagcagaatttctgtcatcatggacagcacggaacgggtgaagctgcgccagttctgttcactgccggtcagcatcgccgccatattctgcgcaataccatcaaaggtctgcgtggcagcacttttaacctgcgacatactgtccgtggcactctcttcccactcactccagccggacttcaggcctgccatccagttcccgcgaagcaggtcttcagccgcccaggtctttttctgctctgacatgacgttattcagcgccagaggattatcgccatactgttccttcaggcgctgttccgtggcttcccgttctgcctgccggtcagtcagcccccggcttttcgcatcaatagcggcccgttttgcccgttgctgctgtgcgaatttatccgcctgctgcgccagcgcgttcaggcgctcctgatacgtaaccttgtcgccaagtgcagccagctggcgtttgtactccagcgtctcatctttatgcgccagcagggatttctcctgtgcagacagctggcga

SEQ ID NO: 10090 - DNA, 1634 bp, Escherichia coli
ctgagggaaaaattcagttcctttcaaaaatcaattactatacagttcgaaactatagacgctttgatgactgtaattcttcaacacatacgcccaatgctgtggtaagttcacacaagcaagataggaaagtagataagttgtaataacattggaatggaaagagataagactacagcttaaaggcttaatacagcttagctcgaaccgatcagtatgatataactaatatatcgattaccatggcgagcgcgattctcatcatatcacaaagccgtagtaagactttacgtcgggcaacacctctgcattcagcgaaccttcaagagctcaaaaaggaactagttggcgaaatgtgagcagtgaaattggctgattcgttgggcaaacttcaccttcataccgcgtttttttcacacatacagtattacatcagttcgtgaaaaaattcacgggaaataacaagattaaatagagagaaaatcaactgatgttaatattgatgtcattttttcagaccggctgtgtgcttgtcgcagacctgtaggagcatgagcactaaggctgtgtcgccgataccattcgctgtctttggcggcgaatctatgatgatggttactccacatttggtgagttacgctggtttgcaggttgcctcgttgtggacgattattgtgctttaaaaacggggaattttttccgctgtgggtgactgatcgattccttgaaatatgtaatcgctttcctcagctactgagctcaggagtttcctatacagtgttggagtaggaatatatgtaatcgctttcctcagctrctgagctcaggagtttcctatacagtgttggagtaggaatatatgtaatcgctttcctcagctgatgagctcaggagtttactatacagtgttggagtaggaatatatgaaatcgctttcctaagctgctgagctcaggagtttcctatacagtgttggagtaggaatatatgtaatcgctttcctaagctgctgagctcaggagtttcctatacagtgttggagtaggaatatatgtaatcgctttcctcagctgttgagctcaggagtttcctatacagtgttggagtaggaatatatgtaatcactttcctcagctgttgagctcaggagtttcctatacagtgttggagtaggaatatatgtaatcactttcctcagctgttgagctcaggagtttcctatacagtgttggagtaggaatatatgtaatcactttcctcagcggctgagctcaggagtttcctatacagtgttggagtaggaatatatgtaatcgctttcctcagctgctgagctcaggagtttcctatacagtgttggagtaggaatatatgtaatcgctttcctcagcagctgagttcaggagtttcctatacagtgttggagtaggaatatatgtaatcgctttcctcagctgctgagctcaggagtttcctatacagtgttggagtaggattatatgtaatcgctttcctcagctgctgagctcaggagtttcctatacagtgttggagtaggaatatatgtaatcgctttcctcagctgctgagctcaggagtttcctatacagtgttggagtaggattatatgtaat

SEQ ID NO: 10091 - DNA, 1625 bp, Escherichia coli
aacacattctcaacgtgagcttccttgcgtgccctggtttttcctctcaagtacttcactgataactcatggactctatgatgcgccctctcctgggtacggccagtacttcaggtttctggttcacatgagtaacatcttaaacctggataatagttcgggtttcaggtctcccgtcgggtttcaggtggggtttcgaattttccattctccgctttcatctgtggtgtcttctttttttgggaggagcccgtagcacttgcattacagccattacccggataacagcgcgacagccgagctccgacgagtcagtcaaaactccgaatagtctgtagagtagaccgacgtgccgccgattggaatgttgcatgcattttgctagctcaacttgagctgctcaaggatgatgactagcgattgatgacacatcaacatgagccttttaacaaaagatagtgcattcccttttgatatgagcatcatatgcattgcataaagcgagaatattgctattttttttgtttagttattcaatctcaatactcaagtgaatacatcaaaatgcgtcacaatctcttcccctcagatggcgacatctcaagagtccacctcatctgaaatgactcctagtgtgcgaattccgccacttgaatcttctcgacatcccttgggggcaatctcacaggagctgcgacattaccgatagttgatagcttacaatcgcgaccaatccatagtgtacaggtcggcgatctastagacgatactcttcaatgatctcgtcaccgccttatatgctaagtcgtacttgtagctagtacaacaagttctgagcataatcgtagtctcagacgagagcatataacttgctgattcgacctccgaggcaatctcccagattgcgagatcgaatgcttacaattctccggcaaaggatagtgatcgtgatgggccatgaaagcaagctgactaggcaatagtgctgtgcctgcacactatagggtacggcgtagccactacactaaaactaacgccatcaacttttggttctccaatcaggtcgaagattcataaaccatcgtgtcgatcctcatttctcgctccagggttaatcactgaataacgcagctttgcacgcagagggcgtagaccaaactaacttgggcaggacaatctcttacacggtctgttttcgatgattcacttgtctactccgctaaattccaatcccggtcctacgtagtctagcccgaccttcccctctatctcgactgtttattaaatgaacttaagttggtgactgttgcttatgagtggctctgccaatttgcgatctttcacgatttgctcaccgcgggtaaccgtactctaactcttacggggccgatgccctgaactttcacgtagacgatgctcctgtaccacatcgatcaccttgctgcacccattctctactacatcccgagtcgggatgtagtagtaactttgcacgtcgggattcccggggcatttaattttttatgagcattccatttgagtctcgagcatgtacggaataactttgttgacttgtatgtgaggccatagatatagtagtgagtaatcagtattctcacatctag

SEQ ID NO: 10092 - DNA, 1611 bp, Escherichia coli
atcctttttcgccgccgccatcagcgtgttgtaatctgcctgcaggattttcccgtctttcagtgccttgttcagttcttcctgacgggcggtatatttctccagcggtgtctgcagccgttcgtaagccttctgcgcctcttcggtatatttcagccgtgatgcttcggtatcgctctgctgctgcgcatttttgtcctgttgactctgctgttcagccttctttcgggcggcttcaagcgcaagacgggccttttcacgatcatcccagtaacgcgcccgcgcttcatcgttaacaaaataatcatccttgcgcagattccagatgtcgtccgctttcttaaacgcagcctctgccttaatcagcatctcctgagcggtatcaggacgaccaatatccagcaccgcatcccacatggatttgaatgcccgtgctgtcctgtctgcccaggtttccagcgtgcccatgttctctttcaggcgtcgggtctggtcatcaaaccctttcgttgcggcctcgttcgccgcctgcaatgccccggattcatcgccggaacgctgcaactgagcaacatacgcaatctgctccgccgttacgttatggaactggcgcgccatcgccgtcagccccgacgtcgggtcagtggtcagcttcccgaaggcttcagcgaccttgtccacctccacgccggatgcagaggagaaacgcgccacactctggctgatggatgcaatctgagcctcaccgcttactcccgccttaaccagtgcgctgagtgactcgctggtctggttaaacgtcagccctgccgcctgcccggctctggacaggaccagcatacgatctgccgtcagacccgactgattgccggaaaggaccagcgttttgttgaaatcggacagggttgagttaccctgataccaggcatacgccagcgcaccggtcgccaccgccagcgaggtggccccgaccatcggcagggtgatcgcaccggcaagcccccggaacatggggatcatcccgccgaaggagtccttaacctgaccaccctgttgcagcaggatcagccacgggctttgcccgcctgcaagctgcgtggccacgtcggtgaactgtgcaggcagcatacgcatggcggctttatactgcccgacggaaatccccgctttctgtgcagccagcgcctgtcggctcagcgactgttcaacgactgccgctgtttttttcgcatcactttccgtaccggaaaaatgacgcctgactctggccatctgctcgtcaaatctggccgcatccagacttaaatcaacgaccagatcgcctaccggttcagccataccggactcctcctgcgatcccttctgatactgtcatcagcattacgtcatcctccgtcatgcccgccatatccggggaagcggggataacttcatttccgtccgggtcaaagcggacgcctccggtaagccctgccgctttctgcatcagcacatcatcttcaggctcttcgtcatcctcacgccggttcagcaaactgaaatccagcggatgcatatcccggatcgctgaaaaacagctgagcacagtgtacgtcagcccggaaaagtgca

SEQ ID NO: 10093 - DNA, 1583 bp, Escherichia coli
tatactcccatcgttttcgacgattcgctcaactccgaattctcaggctctgtggtgaacattaggctcacgttcatgatgaatcttctccgtaacatggacaaccgcttactcgacccaagtgtgtcggtcaatttgagcgcactttatatatcaattttcttatctagttttccaacttggagtgcggttgaacttaccgttcatgatctacggtttattcaatagactctggtgctcaacgttgtggttctattcagattcttcgatggtcctgaaggaggacctgctgtgccagtgagagatgacttgcttcgtcctgatagccccgcattgaaggcacttgtgaaaaaacaggagctatctcccgaattccagaataagaccaagggcgaatttgctcatctgttaaaggcattcaacttgacgcacactgcggagctcagggcggttgccggtgttattatctccaatggggtccacgatctccccctaccattcaccggccgggctgctgagctcgtggatgaagtgagaaacagcagcctctcgacgctatcggatggttcctccttaggtgctgagcgcacgcgaatgggtcatgagacgtcgcttcgcgactttgcccatcggcagacttggtgcagggagcctccttcgttggttggtgggtaaattggtattaatacagagggggatcacttttttgggtggacatgatatcaatatatattgcttgcagagtgtaagtcgtgggcctcatcgcttccgattcagaagttctggattcacctctcctgaactcccttatgcttggcgtactagcattgtcgataagtccctgcgcctcttgaaaaatcgcggtatgttctggcaccacaataggctacaacaatatgccactggcatatcgttgtcgcttactgccagttccataatgaaaggctcataatgtaatgaaactttcattatattgcctctatacatgcttagtaagcgtcacttagccttctaggataggagccctatcatagagtatagaatcttcggatattcgcatcggatatagaatcagaggctttacggggaatcataggttgaaatctcccttactctcgcaagtgtctgagtgaactctcgacagcgcattgtcactgctggccggccatcattccgactcagatcctatccgtggagcctaaaaatgtcttcatacccgacttcgcggatgcactggcgatcgagctctgggatacagggaacagcgggaatatttcgaccttatgggttggattccataagcatcgttaccatcaaggaaaacacgatgtggacacggataaatctggtgctttcactgaaggtgcgtatctcttccacgaaaactttcatcgccagttgcacaggtgctctgaaaatccttaagaaacgctatgacacgattcctcctgagcttggcgatcggttcggcgtatccaatgtcatgtctttggatgacctccagagatatagtactctgattctctgagatactctagcgaacgccaattttttctccgttatgccccttgtggatatctcaa

SEQ ID NO: 10094 - DNA, 1577 bp, Escherichia coli
ggtggggggtgattggtgataccatagataaacatagatcgtaacttgcaggctcattgatatcctaaacttcgtgtcaccaatcaccaaacggtggtcattccattcgtgatcgtgcgcagttcctatacgactcaaatgatcagaatagcgtgagaagcagcaagacgaggctgcaagttgcatctcaatgttatccacttagatgtacggctctaatcccatattgcgcgctcgtccgagctcatccatttccagcacatgtagaactgcgatctgatcgagcgaagcctattccgatccagctctccctccgctccctcgagcaatgttcacccgtttggatcgcccatactcgtttgacagtacaaaagaacattgtccagggacgggggcgctcccttgtaccatcagagtcttctcgtttttcagattatatgaaactgctcaatcgaacgatagaatgattcagaaaggacaaacgctccacgatgggttcgaaccaccgaccttgtggttaacagccacacgctctgcctactgagctagcggagcactaaaatactatatatgaagcttctttcttttttttatactgcaacacattttgagagctcatcagggtttgatttccctaagcaaggtcactatgacaacatcaggttttcacaaggaattcgcgattatcagaacatagaattgacaagaaaaagatcagatatatcacccaccgtggggctcgaacccacgaccacaaggttaagagccttgcgctctaccgactgagctagacgggccaaccaaccggattgggcaagagctggtccgcccgaccttaccaaatcgaggcctcatcatcgccctctttatccatatcagtatttacgtgagtgagagcaaaaaatgcgcgatatttccgatgcccgtgagaccgcagttttatgttcatcctattcgagatgagttccacgactagctggggagtcacgacgttccttatggggtggggggtgattggtgataccatagataaacatagatcgtaacttgcaggctcattgatatcctaaacttcgtgtcaccaatcaccaaacggtggtcattccattcgtgatcgtgcgcagttcctatacgactcaaatgatcagaatagcgtgagaagcagcaagacgaggctgcaagttgcatctcaatgttatccacttagatgtacggctctaatcccatattgcgtgctcgtccgagctcatccatttccagcacatgtagaactgcgatctgatcgagcgaagcctattccgatccagctctccctccgctccctcgagcaatgttcacccgtttggatcgcccatactcgtttgacagtacaaaagaacattgtccagggacgggggcgctcccttgtaccatcagagtcttctcgtttttcagtttatacgaaactgctcaatcgaacgatagaatgattcagaaaggacaaacgctccacgatgggttcgaaccaccgaccttgtggttaacagccacacgctctgcctactgagctagcggagcactagaatactatgtatgaa

SEQ ID NO: 10095 - DNA, 1556 bp, Escherichia coli
accccgcacccctggacaaagattacagtcacctggtgaactcatcactcgcgcgactaatagttcaggctacatcctgtacgggctcaatccgtccaacagtgcacatggggtgaggggaacgagcatgatgaaggggcaatgaagccgttaatcagaggatgttgtggctgttaatcctgagtacgcctgagtatatagagcagatagagcgaaaaactttttacacttctcgatttgtgcgtgtcatccttgcgcaggggccatgctaatcttctctgtatcgttccaattttatcggatacccccgagggggtccatcgaaatatagcgtgcataaagtgctattctctgatttcaagtacgttccgattggtgtggtatgagtcaaattatctatcagtgaattccctgcgcatcacgggtgaatttcgttgtcacgggtgaacttcgatgttgagttggtcgtttagctcagtcggttagagcatcgtgctaataacgcgagggtcgcaggttcgagccctgcatcgaccactagtttggcttactcattgcactatccaagtgattaagttcacatcaactttttactcgctttgtaagaaatccattcgtgtgaaattcctgacctgcgttgagcgttcggcttctgaaatgcaatcgactcaattccgagctctttgctcgattgccagactcctcttaccctgccccaatgtgggctgttgttcgtagagttcgaggtcgcctcgtgcaaaggaaatccgtgtgaagttcacgaagaattctgttcctgtgtaacctggatgatgccagccacaaattaactgcaactgaaaactgcattgaggagatgtgttgggaaagatcactgttgggtgactggtgacaccgggagttgtacaaaagaatataaactatcactcttcctctcattcacaggccactgtgtcaccaatcacaacctcggaggtttctctgcaccgatctatcaaaacatccagctgacaacggttgcccgccgaaagccgtggtagataacaatagagaatggtcatgttatgagcgacgttagggaaccaacttgtgaggcttaacggtatggtggctgtgtggtctagtggtatgattctcgcttcgggtgcgagaggtctcgagttcgattctcgactcagccctcgtaagggtgagtttgggcacagcggtagatgcagctggcggatgtagatagctacggaaaccaggtagtgcaaatccctccggaagctaggcaaactggaccatatgcgaaccgttggtcactgggaaatggtatagctggtcgagacgcatgaagcactcgagtgctcgaccccgcacccctggacaaagattacagtcacctggtgaactcatcactcgcgcgactaatagttcaggctacatcctgtacgggctcaatccgtccaacagtgcacatggggtgaggggaacgagcatgatgaaggggcaaatgaagccgttaaacagaggatgttgtggctgttaatcctgagtacgccctgagtatatag

SEQ ID NO: 10096 - DNA, 1554 bp, Escherichia coli
tagagaatttcttttgcggtgtccgtccccacttcacacagatacacgccccgctgattgcgggtttttggcatggtgatcaccggcttgccatagacagatgcgccttttaccggcagcacccggaaaacaccgtgtttttttgacctctgataaacgatttcgccatcgatccccccgatgtcccagcagacacgggaaatggtcatttcggttccgtctgcatggcggtattttttgttgatcgccgcatccacacgtaacagcgtctcttcctcatcgggacgccccataatgatgattttatccaccagaaaggcttcctctcccggagcccatccccagacatacatctcaaaacggtttcgctgcgagtcaatgcccgccgtcagataaaccacccgggcaggcaccgccgccgtgtaacgcacaaccttatccatcagcacctggtgatcgagtttttcgcccacagcctcttcccaggtctcgcccagcgtggtgttcacaaaggttttcaggccgttgggatctttcagtgcatccagccagtcatagacaatctgtacccaggtggtgaacggactgtacgccgtccagatatggaaagtgatggagcgcggcggcggaatttcatcaccccgggcgctgaaaaacatcaggccgtcacgggtccacatgcccgtgttttcacagatccaccgcccgttactctggtcaagctcagactgatggatcacacagccatgatgctcacaaaggtagaaaacactttctggcttattcttctcccacttaagaccgaaaggcgaggcatcatcgccaaatttcagatactgctcctccccacagtgcggacagggcacataaaaacgcatgaagtgtgccgactcgttagcggctttttcgatctggcaggagcctttgattttaggcgtcgagccgcgaatggattttggccatacagagccctcaatacgtttatcccccagcagggttggcgaaccctctttttcaacatccggttcgaacgaggaaagctcgtcataacagaccacatccacggatttttcacggtagttttttgctgccgctccccccagacaccagaaacccacaccggaggaaaaacgcttcagggtgagcgtattatcgcggtgttttcttccgaaccatggagccagctccagcaatgcaggaacatcccttatcgttggctcaacatgagatttcataaaatcttcagcagctgagtccgtgggctgaaaaagaaggctgttgcgtgatttatgctcaataaaataagcctccactcccagcaacatctttgtataaccaacacgggcagatttaatcaggttaaccgtgcgaatcagatcgttgcccatacagttcatgatgccaacctgaaacggcagtgtttcccatcgccccggggtataagacgactctttaggaaggtaataatgtttattggcccactgaactgtcgtcagtggaacaggaataatgagagataaaagccctgtagctatcgcaccggctgcattagct

SEQ ID NO: 10097 - DNA, 1540 bp, Escherichia coli
aaatagcacacgatatacctcttttttgaaaaattcaccgcgtcacccatcaccaccccaaatctgcgcaacgaaaaaggtcaattttaagtaaaattcacttaaatttcacttaaattcacttaaatggaatgcgcagatttagaccattttggtgacatttccaaatgacctaccacatatggtccactgtaacaccccatcctcagaagcatacccatatggttgaaatcgagccacatggcctacatcaacttttatacccacctgcaagtcaatttcgcccatgtgcgaaattgatgtgcagctttcgcgagcatctttgaccaaacgtgcacatcgatttcgcgcatccccctccaccccttggacaatgttataaactatgttcacttgtctctctattgaactactggactcttctgtgggctagcataggctgcttcacaatacaagacaaaagaggaacaatgtccaagggggtggggagggggtttgtaaaaaaatgtacgacttttgcaaaaagccagcagcaccctaaggacttcccgggcggtcccccaccccagtactatccgggccttgcgccgcttaacttcggagttcggatgggatccggtgtattcgacgcagtatggccgctggcgatcataaagtcgaccaaaaagccaagttacccccaaccgcgcacacccaaatttggacaagtcgaggattttcaacccataaggtatgatcctccatccaacttcaaacgctcatcaggacactataccgcgatccaactcaaccgtgccccacaccagagctctcagaagctcttgagtgtggagtaatccgcctttttaaatcgagtccgtagatggaaatagaataggaggagacaaatcggcgcaacacgggatgaatctcagtggatcgtaagactaagcctactctcaacacttacaatacccggatgcaattaagtcgtcttcaaaggatttatcgagcccaatacttgcaattgctatgatcaccatacactctgaccacaagtcaatgcagccagaggtatagcagcttgaattttggtcaggccgaagcctgacctagcctttttcttgtagcattgagcacggtgtacaacactgcttatccagcatggattccggcttagaggcgttcagccgtaatccagcagatggtagcttcgccgtactgtcttttcagacaacggcattaaccaagtatctggacgaagtgttcctctcgtactaacttcgactactgtcgcagtatctactttgtcagtagggtaaaactaacctgtctcacgacggtctaaacccagctcacgttccctattggcgggtgaacaatccgacactttgagacttctgcgtctcaatgataggaagagccgacatcgaaggatcaaaaagcaacgtcgctatgaacgcttggctgccacaagccagttatccctgtggtaacttttctgacacctctagctgtatacttcacagacctaaaggatcgataggccatgcttcgcagt

SEQ ID NO: 10098 - DNA, 1513 bp, Escherichia coli
gctcagattgaacgctggcggcaggcctaacacatgcaagtcgaacggtaacaggaagcagcttgctgctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatca

SEQ ID NO: 10099 - DNA, 1503 bp, Escherichia coli
cacgggcacgttttgatttttatcaggcgcgatcagcctggtcacgggcagagtggattggtgccggaagaatggccattgacgggctcaaggaagtccaggaatcagtgatgcgcattgaggccggactgagcacgtatgagaaagagctggcgctgatgggcgaggattatcaggacattttccgccagcaggtcagggaatctgctgagcggcaaaaagccggactctcacgtccggtgtggatagagcaggcgtatcagcagcagatagcggagagtcgtaggccggaagaggagacaacaccacgtgagacgtaatctttcacacattattgccgcagcattcaatgaaccgctgcttctggagcccgcctatgcgcgggttttcttttgcgcgctcgggcgcgagatgggggcagcaagtctttcggtaccacaacagcaggtacagtttgatgctcccggaatgctggctgaaacggacgagtacatggccggaggtaaacgaccggcccgtgtttaccgggtggtgaacggtattgctgtactgccggtgaccggcacgctggtgcaccggctgggggggatgcggccattttccggaatgacaggctatgacggcattgtcgcctgtcttcagcaggcaatggcggcattgtcgcctgtcttcagcaggcaatggcggatagccaggtgcggggcgtactgctggacattgacagtccgggcgggcaggccgccggcgcgtttgactgcgctgacatgatttaccgcctccgtcagcagaagccggtctgggcactgtgcaatgacacggcctgttctgcagccatgctgctggcgtcggcctgctcccgacggctggttacccagacatcccgtatcggctccattggcgtgatgatgagccatgtcagctatgccggtcatctggcgcaggccggtgtggatatcacgctgatttactcaggggcgcacaaggtggatggcaatcagtttgaagcgttgccggcagaggttcgccaggacatgcagcagcggattgatgcggcgcgccggatgtttgccgaaaaagtggcgatgtataccggtctgtctgttgatgccgtcacgggaacagaggctgccgtttttgaaggtcagtccggcattgaggccgggctggcggatgaattaatcaatgcgtcggatgccatcagtgtgatggccacggcgctgaacagtaatgtcagaggaggcactatgccgcaattaactgcaacggaagccgccgcgcaggagaaccagcgagtgatggggatcctgacatgccaggaagcgaaaggacgtgaacagcttgccacgatgctggcaggacaacagggcatgagcgttgaacaggcccgggcgattctggccgcggcggcaccgcagcagccggtggcatccacgcagagtgaagccgatcgcattatggtgtgtgagagcgacggtcgtgacactggcggcacgctggcggcga

SEQ ID NO: 10100 - DNA, 1496 bp, Escherichia coli
aaatgctcttgcatggactttgtcctcgccgcgttgcagctttatgaactcatgaattctatcataacttattgcaccattatagtccttaatgaagtcagcgagtgcttttttgtttgttgcgtaatgctttgcaacatctatattagcttctgtaagaagttgttttatttccgagtgttctaacttagacaacttccgatacatctttagtaggaaataaaaaaatattttttgaaaaaattagattagattttttaaagttatttttcaaaataatttaatatttttattttaatgaaacacatgcaagattgcaagttcttttcatacaatgctctcgctactgccatcaagaatgagttcaataatgcttcaaatgttaatgttatctttaacaagaagtttgtgaaagaatctaagtttggtcagtatgtcagaccattagctatcgtcattgaccgcaaacgttatacttcacaagagttagcagtagttttgaaacaaaagagtttcttcgtgaatgtcaaagatactcattatactgttataaagaactctaatattgacttcttcagtattgctttaaatctttccgaacagaaagaatataagaagggtgaaacaaatgtgaaatattatccttcatctctgaagacaataacgaacaaagatgttatacakaarytcytaccaaaggttgaagaagcttctattgacattgacgaaggaagtgaaatggttgaagaaatagaccctgaagctatttaagcaaaaatatatttttggttagtcttcatatggatattttacaacaattccccaatgtataaacttttcatacgctttttcataagctttatataccttcagaaattttgcataatctttagaagcatttagatattgtttaaatgctttgtatgtcttcagaaattttgcataatcttttacatgttgttcgttctcttcttctgtcatgagttccgaatattctaaattcatgttctttcatatgagataaaattttataaaaaaataaaattagcttagatttttttattcttcctctttgaagttgtcaaaatactctgttattttttctttcagtagcggtaagtcttctttgaaggtaagtattgtacaacctttcatatcatagtgtgtttgaggtaaagtatcttgaactatctgtttaacatcttcattcggtgtcattgaaatcggtaagttttcgcgatagaaccaatttctgttagatttgtaaatcttagcaaggtcgtaaaagctcttgttgtttcttctgactaaatgcaacataaccatatctctgtcttcttcattttccatctcttcagtataaatcatatacttatagcttttttcctttccttttggtaccaaacgtggtattcttttctgtatgtttttgtcttttgcttcaatgacttcatcttttgcttgaagtttcttttccatctcttcacgttcttgtc

SEQ ID NO: 10101 - DNA, 1496 bp, Escherichia coli
aggcacagatgcgcgatggtggtctgtctccggaggtggacgatgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcaggtcagtatgttgcgtgttgggttcagcgcagagtttaaacaggtggtgaactgatgcaggatatccggcaggaaacactgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggaggcagtatcaggcgtatcccattcaggggagcggttttgaactgaatggcaaaggcaccagtacgcggcccacgctggcagtctctaacctgtacggcatggtcaccggtatggtggaagatatgcagagtctggtcggcggaacggtggtccggcgtaaggtttacgcccgttttctggatgcggtgaacttcgtcaacggaaacagagacgccgatccggagcaggaggtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtgcggttatcacggtccggcagtcgcggatgaatatgaccagccgacgtccgatatcacgaaggataaatgcagcaaatgcctgagcggctgtaagtttcgcaataacgtcggcaactttggcggcttcctttccattaacaaactttcgcagtaatcccatgacagagacagaatcagcgattctggcgcacgcccggcgatgtgcgccagcggagtcgtgcggcttcgtggtaagcacgccggagggggaaagatatttcccctgcgtgaatatctccggtgagccggaggcgtatttccggatggctccggaggactggctgcaggcagagatgcagggtgagattgtggcgctggtccacagccaccccggtggtctgccctggctgagtgaggctgaccggcggctgcaggtgcagagcgatttgccgtggtggctggtctgccggggggcgattcacaagttccgctgtgtgccgcatctcaccgggcggcgctttgagtacggggtgacagactgttacacactgttccgggatgcttaccatctgggcggggattgagatgccggattttcatc

SEQ ID NO: 10102 - DNA, 1480 bp, Escherichia coli
cgctggctatagaaatgccatcctgcctcatcgcctaactctgcaactactggacgggttgaagcaccccataaattaaacgttgcattctttgtggagttgttggagctggatagcgtgaattttttaccatccccggcctgaatatttttaaaagcaatagccactccattctgaaagcggaatacacgctgactattagcataaacatccagaataccgtctccattctgtttaaatccggtgtcattatcaccaagaacaatagagctaccacctaacgcattcgtcgaaccaactccaagactgccattaatgacagcattaacaagaatatttagtgcatcccatttcagcgtcatcaggtcttttgttgtggtgctctggcggcttctccatttgaaatattcattgccgttgtcgcctgtttcaaaccacatgtatgaatcagtgtcaccatcggcatcatttttaaatccaatcttcgcccagtcagtatttcgaatccaggcaaggattgagtcattttcaaaagtaagcccaccggacaaggtatcgccatttttttgcacggcgttaccagccctgtttaccgtttcctgtaaaccgaggtattcgataacggcggcaacggtcgatttcgcaagaatatcccgcccgacttttgtcagggttgccaggctggcgacatcattccccgtaaaatacggaaacttgtctgccgcagtagcaagcccggccagcgccgtcagggtggcatctttcggttgcttacccgcaagcgcgttagtcatggtggtcgcaaaattcgggtcgtttcccagcgccgccgctaactcgttcagcgtattcagtgcgtcaggtgacgaatctacaagggcggcaatcgcagccataacgaaagccgtgcttgcgatttgggtattattcgttccctgtcgcgcagttggcgttgttggcgttccggtcaacgcaggactgtttaagggcgctttcttgttcgtttcacccattaccgccttaaccgctttcgatgtcgcggccagtgtttcagacgtgctgttggtggcactactgagctggactatccctttttgtgccgtcgtagcgtcttgagcggtatattttgcgttagcaaggtcatacgcggccttcactgctttcggcgttgcagcctgcgtttcagacgtgctgttggtggcgctactgagctggacaaggccttttcgcgtcgtgctggcatcctgcgcagtatatttaccgttagcaagatcatacgcggcctttactgctttcggcgttgcagcctgcgtttcagacacgctgttagtggcgctactgagttgaacaaagccttttgcggtcagagaggcgtccgggtgacgtcgtgactgttcatgctctttcagtttgtcatccacgtaatccactgtggccatcaccatggtgttatccacggtaagcgccacggtggcagtgc

SEQ ID NO: 10103 - DNA, 1480 bp, Escherichia coli; identical to SEQ ID NO: 10102

SEQ ID NO: 10104 - DNA, 1425 bp, Escherichia coli
tgggagccgtcaggcgtttcaggaacacgtcgttcatgaatatctgatcgccctgaccaacaaacatcggttttgtgttgccattcgcaggattaatcatcgcaatcctgtccgccgccagcagcacctgactctgcataccgtcaggagtattctcaacaccggcaccaatacccgcgatataaaggcgtccgtcctgcatctgctgcagcttcacagcccacatgctgttcaggttattatttgtatcaacctgaaccttctgtatctgctgaattgctgcactctggtcttccagtttcttattgacggtctgcgtgatttcattgctgacacccgtaatggacgtcctgatttcagccaggtcaggcgcaagctgaccgttatcaatctgcgtccacaactcctgagccagatgggttttccctatctctcctttgaaaaaatccagatagccggatgcatcatcactcgcccggccaacggcctccacaaatgccgatttgccaacggtgttcacactgcggatataaaaataataatcatggcccggtttgatattgatactggcggctatccagtacagcgccgtgccaagatagcgtgctgtggtttcaacctgcctgatatccgcaatccgcttttccgagaaccagaactcaaactgtaccgtcggatcataaaccgcaagatgcggcgtggcggttatctgaaaataccccggtgtcagctcaatctgcgacggcgctgccggtgcggcaatccggaacgataccgatgccggatcgccctgctgcccccatgcatttaccgcccggactgtcagcctgtagttccccagcgccagttgtgtgaagcggtatgtggtttccgtcgtcctggctgtgctgatcagccgctcactgccgtcatccgctgtcacggtcagacggagcatgaagctcacgcccttcaccaccttcggtgtgtcccatcgcgccagcacctgatattccccgctgtctgcagtgacttcggcggtcagatgctgcactgctggcggcgtgacaccattcaccgtgccgctctggtcgccgtcaaagtgcgccccgttatccacgatggcctctttttccggcacatgctgcacggcagtgatggcatacgtgccgtcgtcgttctcacggatactcacgcagcggaacagcgctggcgcagcgtcggcagcttcagcccccacacgctgtatccggcaacgccgtcaggaacacggctcactttcaccttcacgccgtcggtgacggactgaacctccacgctgaccggattgccacttccgtcaaccagacttatcagcgtggtaccggagatggcagcgtgatttcacggtcgagcgtcagcgtccgggtctggctgttcaccgccagcacacgcccgccggtgctg

SEQ ID NO: 10105 - DNA, 1419 bp, Escherichia coli
taccagctcaatagtgagctggtagtaatgttgtaggtccagtaatgtcgtaccacacttccgccgaatgggactagcatggtgccaacgcagtgcaccgatcaggcagcacaccgctaggtggaaggcgcgcgcttcttcatctccgccgcgtacactttttgcgcatcgggggaggggccccgggcgcacgcttattggccgaatggaggctccctgcaaaaatggctgattcggaagccgatttcgccaacgacgcataacatcaccctcaaaccggtaccaatcgactcctctcgccgtcctgagtaacattatgaagagctttttcaaatattatgcgccgttgaggattaattaacgattttgttcaatttcatttatagttgggtcgatcaacaaacagtcacagtatcaacagtgagtttagtctggcaggtcaagggagcgggttatcactcgagtgatccaggttcgaatcctggtgagaacaattttcgggatcggtctcagaactctgggtagggtactgtcatggtagtttaagtactcaatgctacagtagtgaggtaggacgatgtcctcgaggctcggggaaggcgggaaaccacttccaagtcgatcctgcaagtctgcaagtttagtgaccttatctcacacttaaatattctagggaaggtttggactagtggttattgtgttaggctgtcatgcggatgaccgtggttcgatttctggtaacataacttttttatttgttctagtacttatcatcaggctgcggacttcagtagttcagtccagtgtagtgtactagggagtgctgactcccgaaaaacagcgatttttcgtcatagatagtggcgtagtagttatacctcagtttccttacctgcatggttacaagctcgggtctttgcaggtccgtgcggggtccccactttagtggggcgcacgggccgatcagaaattcaacgttacgagtctctacgctcttcaaatggcgcgcgccagcgcaatcgataacctaactcggctctactctattcgatgtgagccgagcaagcagttcaatgaacaacgcgcaaccatcgagcacgctgtgctcgatggttgcgagcctagtaccagctcaatagtgagctggtagtaatgttgtaggtccagtaatgtcgtaccacacttccgccgaatgggactagcatggtgccaacgcagtgcaccgatcaggcagcacaccgctaggtggatggagcgctcctcccttttcgcctctttttgcgcgctgggggaggggccccgggcgcgcgcattatagccggtaggaattcacagcaaaaaagaccgagtacgaagccgatttcgttaatggccctaaggatcaccctgaaactagtaccaatcgactcctctcgtcga

SEQ ID NO: 10106 - DNA, 1414 bp, Escherichia coli
ctccgtgccttgcgctgacgcgcacattgcccgcgtgaaattacccaatttcaactattggcgacttcaatccaactcggaaaaatataccatatacatacctttggcaacagttaagtacagacaatatcatattgacattacgtatcaaccgtattgccgaaatagaaataatcaaataccttacaatcatcatctttattcatcactactgctacttgaagaactagaagagcttgaagaaccttcatctttagaccctttagacttcttcttcttcgactttttcttcttacccttctctgaagactctacttcaaccgaacctccttcataagtggacttcatgacatcactcaaaaatacactcttagaacagctggaaccaccttgtgcttctttatcattagtaacaatagccggagattcccatacaggttggggaagacccttactctcggactgaggagtctcataccagttacccttgcacttagaagccgaaccggtagtattataccatcctccactccacttagaggaagaaccataccagtttttgtcccacttagaggaagaaccatcattaccagtcacctccacctggggggttgtaaccttagcatcattactagtaatagtagcgacagtagcttcatcaaccaccctagtaggttctttagtagcagaatcaacataaccattcttaggatctctagcgatttgctgaagcgtctcatcatggtcacccttagtctcccacggaatagccatagctgaaccatccataggataggcctcttcttctccatcacgaacacggcagaaccttgtctcagcaactgtgagagccctatagaaacacttatcatcaggaccttccgtctcaatatagaacatctcagactcataccttttccaagcttgctgagcaatagtatcaaaagtatgaccttccaagcggttcaccatacaatagttcttaaccgacttgaaatatatgtgtaaagtcctataaaagagaaccttatacatagtcaatatcctcaaggccgtaaaatacaatgagtgggtaaccatacgataacacctttcctccgccagtgccgaatcctcagcaggaatcttaagtgggaggaggataggataattctcagtattctcccactgagacgtaacgtccaacatcatcttgacgcaaataaaccgtaacagagaacccacggtaagaatggaacagggatgccatattccagccttttcgagtacctcaaccgttagttcttgaccaggcttagcatccaaaaagactgtctctccagtaactataaaaagccttaactctggggagagagacgtccatacttcagggacgaaagtacttcccttaacgagagtcagatgcataacctct

SEQ ID NO: 10107 - DNA, 1410 bp, Escherichia coli
cagctatgccggtcatctggcgcaggccggtgtggatatcacgctgatttactcaggggcgcacaaggtggatggcaatcagtttgaagcgttgccggcagaggttcgccaggacatgcagcagcggattgatgcggcgcgccggatgtttgccgaaaaagtggcgatgtataccggtctgtctgttgatgccgtcacgggaacagaggctgccgtttttgaaggtcagtccggcattgaggccgggctggcggatgaattaatcaatgcgtcggatgccatcagtgtgatggccacggcgctgaacagtaatgtcagaggaggcactatgccgcaattaactgcaacggaagccgccgcgcaggagaaccagcgagtgatggggatcctgacatgccaggaagcgaaaggacgtgaacagcttgccacgatgctggcaggacaacagggcatgagcgttgaacaggcccgggcgattctggccgcggcggcaccgcagcagccggtggcatccacgcagagtgaagccgatcgcattatggtgtgtgaagaagcgaacggtcgtgaacaactggcggcaacgctggcggcgatgccggagatgacggtggaaaaagcccgcccgatcctggctgcttcaccgcaggcggatgccggaccatcactccgtgatcagatcatggcactggatgaggcaaaaggggctgaggcgcaggctgaacagctggctgcctgcccgggaatgacagtggagagcgcccgggctgtgctggctgcgggatcaggtaaggcagaaccggtctctgcatccacaaccgccatgtttgaacatttcatggcgaaccattcaccggcagcggtacagggtggcgtggcacagacgtcagcagacggtgatgcggacgtgaaaatgctcatggccatgccatgaagtcagtgctgaccatcaataggaggtttttacaatatggtgacgaaaaccatcactgaacagcgtgcggaagtacgtatttttgccggtaatgatccggctcataccgccacaggcagcagcgggatttcctcgccaacaccggcactgacgcccctgatgctggatgaagccaccgggaaactggtggtctgggacggacagaaagccggtagtgcggttggcatactggtactgccgcttgaaggcacagagacggcgctgacgtattacaagtcgggaacctttgcgacggaggcaatccactggcctgaaagtgtggatgaacacaaaaaggccaacgcctttgctggcagtgccctgagtcacgcggcgctgccgtaacacgttatcaggccaccgcggtggcctgactgatttctgaatgaaaggaactgatttatgggattgtttacgacccgccagttactcggttatac

SEQ ID NO: 10108 - DNA, 1388 bp, Escherichia coli
acgcccgcgagtgtgcagctccgggcgtcgtggcgtcgattgcttctggttgtggagaaactaacgcatgaacagtttaacaacacactaccgtcgctcgcaactgattgcgcttcctgtaccgggtggaaaagcgaaggtggaatattgctatgcagtgaatgtaccaggtgacagggaaattgtaacccacagctttgctgagtgggctgtgggtgatttcaaccggcagaaggagacagtcctttgcgacaagttaaccgctggttcaaagatcactacggagtgcccgtcagagtcattcgttgggaaccggaaacacaacgtgttatctacctccgcgaaggctatgagcatgagtgcttcagcccgctcgaacagtttcgtcgtaaattcagggaaatagaggtcggtcatgagcactaaattaaccggctatgtatgggatggttgcgctgcatcaggcatgaaattatccagcgtggcaattatggcccgcctggctgatttcagtaatgacgaaggtgtgtgctggccatcaattgaaaccattgcccgccagattggcgcggggatgagtaccgtcagaacggctatcgcacggctggaagcagaaggctggttaacgcgtagggcgcgtcgccagggtaaccgcaatgcgtcgaatgtttatcagcttaacgttgcgaagcttcaggcagcggcattttctcaactgtcagattctgacccgtcaaaatctgacgcatcaaaatctgacgcatcaaaatctgacccgtcaaaatttgatgcgtcgaaatctggcaaaaaagcgggttttcacccgtcagaatctggtggggatccgtcagtaaaatcaaaacatgatccgtcagataaaaaaacttctcgtccggacgcttcgcaaccggacacgcagacggctgaacaggattttttaactcgccatcctgatgcggttgtattcagccctaaaaagcgccagtgggggacgcaggatgatttgacctgcgcacagtggctctggaaaaaaatcatcgccctgtacgagcatgccgccgaatgtgacggcgaggtggttcgtcccaaagaaccgaactggacagcatgggcaaacgaaattcgcctgatgtgtgtgcaggatggtcgtactcataaacaaatctgcgagatgtacagccgcgtcagtcgcgatccgttctggtgccgtaacgtgctcagcccgtcgaagctgcgggaaaaatgggatgagctttccctgcgcttatcgccgtccgtcagcacgtacaccgaaaaacgcgaagacccgtacttcaaagccagttacgacaacgtggactacagccagatcccggcaggattcagggggtgatcatgagtcttttgaa

SEQ ID NO: 10109 - DNA, 1372 bp, Escherichia coli
cagcgccgctgaaaaccggatgcgaaagcctttccgggaagtgcacttactaggcccaacaaaatagatttccgttgtcggacatttacccgaactattatgcatctggtcccgtttgatcacgctatagtatcatccagctaggctgtagctatgatgacatacatttgcatatgaagttggcacgcactgtatgtgtgtacactctcgcgtatgctcccgtattcacacctatcccttgtgatatgcccggctcaaccgacaagtagcctcgtcgatctgaaactatatcaaccactgtctcgaaatacgtttgctctcctcaactgagctcagtaggtttcccactaatcatagaacttcatatgcgaatttgtgtagatgtgcacagaaatcaacaagaagtttcttcaatttcttcactaattacacacatacggattcgggtagaaatgtactgaaatcgaggtgagtatcccgaaaattccttagaatttgtaaaattgatgaatatattcttcagtggtgtttttatatcacgggtgaaactccattgctattcgtagcgtgctcagtactgcaacaaaacaatcagaattggaaaagccakttgctcrattwggaatcgaactcggcagatgtttacgtttgatgcctccagtataggaatatatgtacrtattgcgagaaaayttctcggrgraatacggaaattctgagggratttttgggaaatygwcgttggtttttgtacacttctacccaaaatctcgtrgattttcataacatagtgaggaaacttasgagctcagttgaggaaaccgaatatatattccaacacygaatgtctttgttmtraaacacgcagtgttggratatatgttcggaacatartgttymttctcctcagctgagctcaggagtttcttcactaagaggacgagttccaaaacggccttgcataacacattagggaggaatttcctcctaagaattctgtcaaccagtgttgaaatatacgttcgtcttcctcagccgagctcaggagtttcctaactaactatatcctatcggaaaaaaatccccgaaatttcctatcagatatttcatattgtcaccaacacatgccgttgatccttccgagagatcgacacgtatgtagtgttgcaggttgagtgagcaagaattcaccctctctatctcattcatctgggcgaatgctccgagagaagatggtggttctctcgaggccggacgattgttagcgggactctaaagtatgatgcagatagcaattatcaatacactacgaataaagatgtcttacgaataatgcgaacaaagagatgagactctccgagccacttgccgc

SEQ ID NO: 10110 - DNA, 1354 bp, Escherichia coli
acgtgatgttatcaggtgtgtttaaagctgttctgctgggcaataccctgcagtttcgggtggtcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcatacagagtgtatcccggatcttcaccatctttcagtttgaagcaaaccgccgggatgccttcgtccgggcgacccgtacagatgaactcatacggccccagtttggcgatttcatccgccagataagcagcaacctggtaggaagcgttctgtactttggtatagccttcacgaccgaggcgcaggaattcatagtactgtgcaatcacctgacccgccgggcgggagaagttgatggcgaaagtaccaatctgaccgccgaggtagtcaacgttgaacaccagttcctgcggcagcgcttcttcatcacgccagataacccagccgcagcccagcggagccagaccgaatttatggcctgaagcactgatcgatttcacacgcggcaggcggaagtcccagacgatatccggggcgacgaacggtgccaggaagccaccgctggcggcgtcgatgtgcatgtcgatgtcgataccggtgtcggcctggaatttatccagcgcatcgtgcagcggctgcgggaactcatagttaccggtgtaggtcacgccgaaagtcggcaccacgccgatggtgttttcgtcgcaggcttcaatcatgcgtttcgggtccataaacaactgaccggggcgcatagggatctcacgcaactccacatcccagtagcgggcgaatttatgccagcagatttgtaccggaccgcacaccaggttcggtttgttagtcggcttacctgcagcttccatacgcttgcgccaacgccatttcatcgccatcccgccgagcatacaggcctcggaagaaccaatggtgttggtgccaacggcctgaccatttttcggtgcaggcgcatgccacagatcggcaaccatgtttacgcaacgcaggtcgattgcagcggattgcggatattcttctttgtcgatccagtttttattgatcgacaaatccatcaatttatggacgttttcgtcgtcccaggtctggcagaaagtggccaggttctgacgagcgttgccatcaagatataattcatcattgataatctgaaatgcaacatcatcgcgcatttcgtgcagcggaaatcgttttgattctgcgatagtagaaatggcctttg

SEQ ID NO: 10111 - DNA, 1354 bp, Escherichia coli
caaaggccatttctactatcgcagaatcaaaacgatttccgctgcacgaaatgcgcgatgatgttgcatttcagattatcaatgatgaattatatcttgatggcaacgctcgtcagaacctggccactttctgccagacctgggacgacgaaaacgtccataaattgatggatttgtcgatcaataaaaactggatcgacaaagaagaatatccgcaatccgctgcaatcgacctgcgttgcgtaaacatggttgccgatctgtggcatgcgcctgcaccgaaaaatggtcaggccgttggcaccaacaccattggttcttccgaggcctgtatgctcggcgggatggcgatgaaatggcgttggcgcaagcgtatggaagctgcaggtaagccgactaacaaaccgaacctggtgtgcggtccggtacaaatctgctggcataaattcgcccgctactgggatgtggagttgcgtgagatccctatgcgccccggtcagttgtttatggacccgaaacgcatgattgaagcctgcgacgaaaacaccatcggcgtggtgccgactttcggcgtgacctacaccggtaactatgagttcccgcagccgctgcacgatgcgctggataaattccaggccgacaccggtatcgacatcgacatgcacatcgacgccgccagcggtggcttcctggcaccgttcgtcgccccggatatcgtctgggacttccgcctgccgcgtgtgaaatcgatcagtgcttcaggccataaattcggtctggctccgctgggctgcggctgggttatctggcgtgatgaagaagcgctgccgcaggaactggtgttcaacgttgactacctcggcggtcagattggtactttcgccatcaacttctcccgcccggcgggtcaggtgattgcacagtactatgaattcctgcgcctcggtcgtgaaggctataccaaagtacagaacgcttcctaccaggttgctgcttatctggcggatgaaatcgccaaactggggccgtatgagttcatctgtacgggtcgcccggacgaaggcatcccggcggtttgcttcaaactgaaagatggtgaagatccgggatacactctgtatgacctctctgaacgtctgcgtctgcgcggctggcaggttccggccttcactctcggcggtgaagccaccgacatcgtggtgatgcgcattatgtgtcgtcgcggcttcgaaatggactttgctgaactgttgctggaagactacaaagcctccctgaaatatctcagcgaccacccgaaactgcagggtattgcccagcagaacagctttaaacacacctgataacatcacgt

SEQ ID NO: 10112 - DNA, 1349 bp, Escherichia coli
ctgggcagaccagacgccaccatcacgcgatacgacaaaagcacgttcacctgctcatcggcctgtactgacgcggtgaatgcgccggaatggcggtattactggcaggtcaacatgccagccgccaccaacagcacctggatgacatgtggcgatccctgtgattccgcgctgcgtatctggggcgacaccgtcgtcgaatgtgtgcttaacaaactctgcccttcgcatacctacgtaatttttaaatatccggagtaatccatgcatcgtatagacacgaaaaccgcgcagaaggataagttcggcgcgggtaagaacggttttacccgtggtaacccccagacaggcacgcctgccaccgatctggatgatgactactttgacatgttgcaggaagaactctgcagcgtggtggaggcatccggtgccagtctggagaaggcgcggcacgaccagctgcttaccgcgcttcgtgcgctgctgttaagccgcaagaatccgtttagcgatatcaaatcggacggcacggtgaaaacggctctcgaaaaccttggtttgggagaagcggcaaaacggaatgtgggcaacggggaaaaccaaatccctgatatgtctttctggacggttactggtggcaatggaaattttgtgattcgtcaacctgacgggctaatcattcagatggttactgtaagtataagcggcccagtggcgatgaatggaatgactgataatgcttatgccatcacaggttctaataagtcttatattgccacagccacattgccctttgtatttcctaataaggtgctgggcgttatccctctggtatcaacaacagcttatggtggtgtatccagtaatattacaggttcatacgcgacggcggtttgttcttttgccgctgtcagggggaataatacgattgtgttcaaagtcgacaaaccactgaatgcagcctttccttcagataccagcgtctcagcgttaatcattggacggtaataatgaactcagtattcttttcacccggaagtaaaagtttttatctgcaagaattgtttccagaatatgaggatgcgggaacgcttcctgatgatgttattgaaattaccagagaaacatatgagcaatttcttggtctgcatccagaagggaaagaaattggcgctgacagttcaggacggccagtatggattaattccccacccccttcaaaagaggatgaggtgttgacggctgaaatgaaaaaaatatctttggtttcagaagtcaatacctacatcaatacccatcagtggcctggcaaagctgctattggtcgtctgaaaggcgaggaactggcg

SEQ ID NO: 10113 - DNA, 1343 bp, Escherichia coli
agcctctgacgaccacatggtagagtcgttgtcaccaggatcttccggcttcaacaagtcgcaagggatgaggacaaggtcgagaagcaccggtatgaagtagcggtcactgatgcactcccaattgatcctagatagcgcccatgccagtctatcgtcgattcgagacttagccgcctccggcataaagttatcatatatgctcaaaacgcagatcttccgtacgtcctggtcgcagctagtgcatccaataaggaggcatgagactgccatctcggcggcgtcgatttcgagatcccccggtccaacagtatgcctcaaatactcacacagagggcatacaagttcggtgataatgagcctataaagtagtgaccttgaggccaagggccacatgcccctagcactaggctcgccgtttcggccagagactagaccagtggtagcaggtgttggcagaccagattgagggatgaaattatagagcctctctgatgtcacttgatcacacgagcgtagagtttgcatgccatcggcagctctagcaatacataggagagaatccaaaccgtcctctagaacagcctcttctcgatgtgtttcccatagaccaataaatgcaccaggacgagtatcccggagccacttgcccagyttagatagcccatcagagctggcctcgtcagacaggacgaaggsatcctccgttgagaagggctcacccatgatacatcgcttaaagcattgtgagcagaagaccaacaagggtacaacaaccaagggatgaacgacagcaggaacrccataggtttgcatagtgtagctgtggctcgctgacgatggtagtatatgatatgactgcagcacattgaccactgatccattagccccttgagcatcctgagccagcgttactaatggactcagaacttccaacgtgaagaccaagagagctcggaattcgtgatgctctggagttggcacatgggatggtggtcctgtggtaggaggagggggaggaggaggagcgcggctgatggccgtaattggagcacgagggaggcctaatagaaccatactgtagaggcgaatagcacgagctagtgcattaggtagcgcctcgatttgagccaaccagccactaccagcataggagtgtaccaactcagaagggtcaatgcccatgtcgaggtcatcaggactgtcatccattaccatcatccccccaagttgtaccgagagacgatctttcgcctcttgtaacaggagttgatgaatagccttgggagcaatgacagtgaccaattcaaagacacctgctttagcagcccgccgaagtcctt

SEQ ID NO: 10114 - DNA, 1335 bp, Escherichia coli
ataatgttcccggggaaaattcattttcaattttccacgtatggctaggaacacattctcccgatcagttcccatgtaaatgtcatcacattaggaacatcttccccgttgttatcaaacccgtgatatgtccttacaaaattgcagtaaactcggtgtagggtttatacctgacattcgtatgcagtgttggaatatatgcacatggtcaactacgtgtgtaagtgacattcgtgaaaattatggtaaaaattgaggaaattctcaatagtttctgtacatttctacccaaatttgtatgtaaacttctatatccagtgaggaaacttgtggacttagctgaaaaaagcgaaaatttattcagccaacactgctcgagtgaaacgtgaaaagcgtgccatcgtgagtgatacgacttttccttataaaatatacgtcgttttcaacgtggctaagcagaggtagactaatatgaagtgaagctctcgtgtcatccaagcagtggcttgacgttatcattgctattcagacctacgagctgtggtttaagcaaatcatctttgaattcgaatcagtccatggtatcttctcgaaagctgttatcgaggaacatgatatggccattgtcaacgagaggtagacgcactgtcatcaggcgtgtcatgagcggccactcttctccaggcttagtcgagttcggaatattcagaatctgctgctgggtgcactaccggtaggttgttggttcagtttggtaaaatatgcacatggtcaacttcatgtgctggtgacaatatgaaaacacgagggaattttgagagattctcattgatttctgtgcatatctactgagatggtgtgtaaatgcctataataagcgaggaaacgcctgagctcagctgaggagagcaaacatatatcccaacactgtgttgcttggtgagggagattgagaaggatggttaggtcctcgagacgatgacaccgatggactttctggagtttagggactacctcatgccagcgagcggattccagagcgctcagtttaggtacaactagttgacgtcgaaagtagcatgggaaagtgttgtgatttttagggttattgaggttatgatggggctgccgtttcagtcgggaggggagaaagtgagttgttaaaatgccgccgccggggatcgaacctgggtgggtctgttgaccgtgttagatacgggagtcctcagttcttcctctcgaaattccatcctaaagatattgaacgagttgtgtattgggagagtcagcctagcttggttgagctgacggaaaagtaaacgaggaggaggtcgt

SEQ ID NO: 10115 - DNA, 1306 bp, Escherichia coli
ggctgtgctttctcaggtctggaagcgtccaaggtaagggctcaacggatacgtaaaaaaccgatcccatagtcttctrctcgtcacccacaagctataatcaatattatcgcgacacggagraaggcgtgaagtcccccatgatatkattttcaagtctgtatcttgcgtttggcaaccwtgtcttcgagtccgtgaagactgccgtagctgaaactgtcccctccacaatatggagtccgtatagttctatgctgtgtgctctgggaataacccgtaatcactcctctygatttaagtattttctttgtcgraggacggcctcaattctggttggtagcgggtagggctcgcagcgtactctagtcgactctcaactagacagtctatcatatattyatcgaagactcggactcgaagctacaatggggtcgctatgccacttgttggctgctcactggatacaaagcaggctcggagaagacacgttttcacatcatatagcaaaaaagtcgggacgtttcggaggagattacgagcgagaaggtaacctataaaatcaggagacactagtgccggagatgaaaaacacgttgaacggttccttcgttcaggtagaactgctttgagtcagcgtgatttccgagtggacttcaaccgtcttcggtacaagctcattattgagtgtggtgccccactaaagtgagcagagtgaaattaatatggtgctagaattcgtattgtccgatgattctgtcgacgctgacattcaccgagtacgaccaaacttcttgatctatctacctgttagataagttagggttccagcctttgggtggtactcctgcattttctcatatcgctttgatttatcaccaagaaattgggctgaactttttttgcatggattttgagcaattttgcgtgatttgattgtgcatagctckacagagccaaatcatatctagaattcaaaggtaccttctagttagctatcacttaaaaattcgttgaactctgcgacttacagacaaagcacattttatttggggcacccgatacgttccgagtyaagagtggcattctgagaagtttggcgtgagatctatcgcactcaacttakgcttgcgatgaaacgatttcttcaacgttgacattttgctatgagagtagataccctacgctacatagtatgtattcggctgtagttgaataactgacatagtccccattcctttcaatcatctatgaaagcattttgggtctttcttgggacgtttagagcgtcaggatcaatcgaattgtt

SEQ ID NO: 10116 - DNA, 1304 bp, Escherichia coli
tatatctgtaaatgatatcattgctttcaatccaactcttaaagttgcatttgcttcagattcaaatccaccgacaaataaatttgttccatggaatgaaccattcactatgataacgaaggcagtagaagctagtggaacagttactattacaactgtaacccagcaactatttcgaacaaagatggattttaatgaatgtttcattcatccaaagtcattctctttagaccctaacatttatacagaacttgtagaacattatacaaacgaggctttatgttttcctgttaaagttatggattggattcctatggacggttcattctcaaagaatacagatagttcaagtgcaacatttacagcagcttatacgcctattaatgttaaaagtatttgggcactatttagaaagaaagacaactattatgttaattttgagaaccctaagtttaaatatcttcagctttccatgggagcttatggaaatatgcctgcagaacctgaaaaatcatatggacctgtattttatgaaatggttgcgaacgcctgcaatacaaacaatgatatgataggatttaatgaagatgttatgaggtcattggtggatgatggtagtgtggaacataaatgggatagctatgacaacacacatttcttatgtggttttccaacagaagtggacttttgcttccagcaaggtcaaacatctactgctccaataacatacaaattgtctgttaaaggacctattgaactagcaactgaaaatgtaccaaagccayttattggatttatgagggattgttgctttgccattcaggtgcgtgctaatggcatccccataataagattagatgactataacttagctacggacgacagtgaggaataaaggatgaacgtttatttttaaagcttataaatgagttcttcatcaagctctcgtgaaccttcaccatctatgaaacaaactttaccaaacgattatggagcacctattgaatatttcttacgagctgcacaatggcaaagagcagtctcaccaaggttagttgttccaccagctcctgtcaaaaatagcatttggtcaagtccttatataagatatggtctcccactaggtttgctagctacagcaggagcagttatgatgttgaaaagaaataaagcaaatgttgtaaataatactgaagtagctgaagttaaacaaactccaacgccttcacaagcaaaaccaacgccttcacaagcaaaaccttcaatgactcctgaacctatggaagtacaaactcctgttcaaa

SEQ ID NO: 10117 - DNA, 1301 bp, Escherichia coli
tcctgtacggataagttcttgtcggagtgagtaagttccactaggtaaattacgttctacaatcacgcgcgggccaagttgygtgttcggrgaaataattcgcccaggcaaaataataacttgtacrccaaggcgtgaacgctkcccgatataacaacctaatttatcgcatccggtagcgataattccctctggagttcgaacagacacgggytgttcatccagacgatgattactggtwcgtacttgtgcgcccaaatatgcctggtttgcaactaccgagtcggcaataaagcattgcggaccaatcgtkgcttccgcttcaataaccgcatttttaatttcggtggcaaaaccaatttttacgccattgctgattattgtgccaggacgaataaacgcataattacctatcaggcagtttgcgccaatcactaccggcccctgaataacggcaccgtggcaaatacgggtattcgcgccgataacaacctcaccggcactttcatcaataatcacctggtctgcaatctgaacatttttctctttagcattaagcttcagatagtttttcagttcctgtgacagaaggttgggaataagcggttgacgcttccaccagtgcggaatagcgggtgggtttgtcgcgctgaggttcgcgtccagtaaaaaaggcaataagtccataaataatccagatggcataagctaataatacatacacaacggaaagcggtgctaaaggcaccaacaaccagcaacgatgaaaccaggcgctaaatgcaccaataacacaaactacgccgacccagataagcgggaacattgccaacaccacaccatgtggcccggtggtgatgaattcattaaaccaggtagtgagataaataccaacgccataaagcacaaccaacagcataggaaatatactgaagataccgaagcggctaaataaaagtcttttatgcaggcgcatacagaccgcgtagcccacaatccaacgccgccagcggcgccactcctcacgcggactgttacattcctgtgggtatacgatgcagcgattcgcctgccgaatacggtagccgtttgccaccaacgtccaggtgagatcaaggtcttcgactttagtacgatcagagaaaccgaacttacgcaatacatcagtacggaacatcccgcaggcaccgctgataataaacggtgcaccgcccagaaactgctgtagcgtgcgcttcataacaatcatcggcaactttacggtggcgcggatatgtggcagcagacctgcccctttaacg

SEQ ID NO: 10118 - DNA, 1301 bp, Escherichia coli
cgttaaaggggcaggtctgctgccacatatccgcgccaccgtaaagttgccgatgattgttatgaagcgcacgctacagcagtttctgggcggtgcaccgtttattatcagcggtgcctgcgggatgttccgtactgatgtattgcgtaagttcggtttctctgatcgtactaaagtcgaagaccttgatctcacctggacgttggtggcaaacggctaccgtattcggcaggcgaatcgctgcatcgtatacccacaggaatgtaacagtccgcgtgaggagtggcgccgctggcggcgttggattgtgggctacgcggtctgtatgcgcctgcataaaagacttttatttagccgcttcggtatcttcagtatatttcctatgctgttggttgtgctttatggcgttggtatttatctcactacctggtttaatgaattcatcaccaccgggccacatggtgtggtgttggcaatgttcccgcttatctgggtcggcgtagtttgtgttattggtgcatttagcgcctggtttcatcgttgctggttgttggtgcctttagcaccgctttccgttgtgtatgtattattagcttatgccatctggattatttatggacttattgccttttttactggacgcgaacctcagcgcgacaaacccacccgctattccgcactggtggaagcgtcaaccgcttattcccaaccttctgtcacaggaactgaaaaactatctgaagcttaatgctaaagagaaaaatgttcagattgcagaccaggtgattattgatgaaagtgccggtgaggttgttatcggcgcgaatacccgtatttgccacggtgccgttattcaggggccggtagtgattggcgcaaactgcctgataggtaattatgcgtttattcgtcctggcacaataatcagcaatggcgtaaaaattggttttgccaccgaaattaaaaatgcggttattgaagcggaagcaacgattggtccgcaatgctttattgccgactcggtagttgcaaaccaggcatatttgggcgcacaagtacgtaccagtaatcatcgtctggatgaacaacccgtgtctgttcgaactccagagggaattatcgctaccggatgcgataaattaggttgttatatcgggaagcgttcacgccttggtgtacaagttattattttgcctgggcgaattatttctccgaacacacaacttggcccgcgcgtgattgtagaacgtaatttacctagtggaacttactcactccgacaagaacttatccgtacagga

SEQ ID NO: 10119 - DNA, 1285 bp, Escherichia coli
tcctggaggagaggacaacattgcagctgccaaggctggagcatatgaatacgtcactgacccgactctagtggcctccaggtagtagtagcagttgagcggcgaataaccggtctgtgtcgacaccccacactgttagacgtgttggtgacaatgaggaaactcttggggtcattttcgttggtttccgaatacttctacccgtatgcgaaattttgcaatcaatggagatattcctgagctcagctgcccctttatcgttagttttaaaaagaagaggttttatctcttcacgaagcgccttccgaccgacactggagccggtcagcaacgtgatatcttcaatgagaagccaacagccgatgagatgtccgctgctgctgccgctgctgccggtgataggaagcctcagatcaagtaggttcacggcggtggaggagggggtagaagggtgttgttcaggattggtaaaaaggctattattcatacggactttggtgacatccaaattgaactctatggcaagttggtgccgaaaacggtggagaacttctcaaagcacgcacaggatggttattatgacgatgtagtgtttcatagggtaataatattgcagggtgtgggaatcgaacccgggacctctgtcgatcaggttatcaataagttcatgatacaaacaggcgatcctgaaggcaccggaatgggtggcagcagcatttggggcggcgactttgaagatgaattcgtaaaccaaataacgctascttttcgatcgacctctactatcaggtgcccgagttggaccattcacaaccctatatggtgtcaatggctaatgcggggcccaacacaaacggctcgcagttcttcattactactgtgagatggtggtgatacgaggcttcggtgtcaccatgtgttcctatcaggtgccttgtccattccttgacaataagcatactgtatttggaaaagtgactgctggtcaggatgtggtagtaaaggggagcagatgggtgggagggatggtaaatttggaatatatcaggttcataaaatagagggggtgagaactgatgcagaagatagacctcgggaagagatacacatccaaacgattaagattgagtgaaaaaatccgaaacgtttcagtttactctcattgagtttgtcaatatttcttcctggatctgcatactatagtgaacaagcattttagccatgaaaatgaacagtttcctcgagggtggtgtgggcatcttgtaacgctgctatcagattatct

SEQ ID NO: 10120 - DNA, 1267 bp, Escherichia coli
tcccccagtgctgggctgtatctgaccgttaacagaaaatattaccgagttatctgtatttcgctggctatagaaatgccatcctgcctcatcgcctaactctgcaactactggacgggttgaagcaccccataaattaaacgttgcattctttgtggagttgttggagctggatagcgtgaattttttaccatccccggcctgaatatttttaaaagcaatagccactccattctgaaagcggaatacacgctgactattagcataaacatccagaataccgtctccattctgtttaaatccggtgtcattatcaccaagaacaatagagctaccacctaacgcattcgtcgaaccaactccaagactgccattaatgacagcattaacaagaatatttagtgcatcccatttcagcgtcatcaggtcttttgttgtggtgctctggcggcttctccatttgaaatattcattgccgttgtcgcctgtttcaaaccacatgtatgaatcagtgtcaccatcggcatcatttttaaatccaatcttcgcccagtcagtatttcgaatccaggcaaggattgagtcattttcaaaagtaagcccaccggacaaggtatcgccatttttttgcacggcgttaccagccctgtttaccgtttcctgtaaaccgaggttttaaataatggccgtttctggcctgcatggcatgatttgcgcttttggacaggagattcagtgtgctgattggctatgtaagggtatcaacaaatgaccagaatacagacctgcaacgaaacgctcttgtttgtgcaggatgtgaacaaatatttgaagataaattaagcgggacaaagacagaccgaccgggattaaaacgcgctttaaagcgccttcaaaaaggtgacacgctggttgtctggaaactggatcgcctcgggcgaagcatgaaacatctgatttctctcgtcggggaactacgggagcgagggattaattttcgcagtctgaccgacagcatagacacatcttctccaatggggcgttttttcttccacgtgatgggtgccctggctgaaatggaacgtgaattaattgttgaacgtacactggccgggctggcggcagcgcgcgcaagggggcgcacaggcggacgtcgaccgaagctgacaaaagaacagcatgagcaaatagcaaggctaatcaaaaacgggcacgacagaaaacaactggcaataatttacggcattggcacatcgacgatttatcg

SEQ ID NO: 10121 - DNA, 1241 bp, Escherichia coli
gcgtgattgaggtagcaaccgagatgattgcagcatcaccaacaaggccgcactaaggaacatttcccaggttcgaaaggaatctggtatattattgagacgcgcctctatcattggtgacacttatctcgaaggatgattatatccttcattcattttcatattcccatgaattgtggtatcaccagtcaccactaactgttgtgctaaatggaggtggtataacacacagtttccctctatcatatggtgcgtctacaagcattgtgaccagcccaatcagtcaccacgcaacaaatttacgattgtaccactccctcccgaacaagtccgtaagggttcatgatgctgtctttccaccttattgggatgctacatacaaaaccccacactcagcaggatgatagttgtcggcatcagaaccgcgtcaacatacgagcgaaaatggagaacccgggcatcgatcccggtgcctctcgcttgctaagcgagcgctctaccatttgagctagtccccctcacaatattcaaattctttccattccggaaagatgggctgagcaccctcgcccctcgaacaatgttgaagtggtccacgaatgggtgacgaacattgtccaagggaggaggggaaccaataacaggtcgtgcatctcgaactacgatgctcctctaacactcctgctcagtcttcaatcattgcgctcaatgtgagcccaacaaatatcttatctcatatacactttccgatgcagggactcgaaccctggtcgcgtgggtgaaagccacgaatcctaaccagctagactacatcggaaactgaaaacataaaattatatacagttcacaaaagtgctgttcagtccacctgcgtgattgaggtagcaaccgagatgattgcagcatcaccaacaaggccgcactaaggaacatttcccaggttcgaaaggaatctggtatattattgagacgcgcctctatcattggtgacacttatctcgaaggatgattatatccttcattcattttcatattcccatgaattgtggtatcaccagtcaccactaactgttgtgctaaatggaggtggtataacacacagtttccctctatcatatggtgcgtctacaagcattgtgaccagcccaatcagtcaccacgcaacaaatttacgattgtaccactccctcccgaacaagtccgtaagggttcatgatgctgtctttccaccttattgggat

SEQ ID NO: 10122 - DNA, 1234 bp, Escherichia coli
ggggggggaagccacgttgtgtctcaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgaatcagcaacaccttcttcacgaggcagacctcagcgcccccccccccctgca

SEQ ID NO: 10123 - DNA, 1227 bp, Escherichia coli
ggccttgttgcaccatggattactgcgtcaggcagcactgacgccacaggaaactgcgctgatcagtcctatccgtgaattgacctatcgccaactgtcgacggcggcggatcatgtggcccgcgccctgttagcgctgggcgtgcagcatggcgaccgcgtggcggtggtgatggaaaaaggctggcagcagattgccgccgtacacggcattttacgactgggtgcggtctatctgccagtggatccggtgctaccgccacagcgtcgccagcttttgctgacggtgggcgaggtgcgggtacaagtaacgcagccgggtctcacgcaattggagccgtcgctgcccgtgctgatcatcgacgacggaatgctggacacgcctgctgcgccgttgcctgaagtggctggggatgtcacggatctggcctatatcattttcacttccggctccaccggtaccccgaaaggagtgatgatcgaccaccgtgcggccatgaacacactggaagacatcaacgaacgctttggcctcaatgcgcaggatagggtgttcgggctgtcatcattgagctttgacctgtcggtttacgatgcctttgcgccttttatggtgggtgcagcgctggtactgccggaagcaggacgggaaaaagatccgcgtcattggcagacagttatggcacacggtcatgtaagcgtctggaatgcagtgcccgcactgatgcagatgctgtgcgaataccacagcggcgatcggatgagttatccgacgttgcgtctggcactgttgagcggcgactggatcccgctaacgttaccggagcagatgcgcgagcggctcaatgaaacgatggacatcatcagtctgggtggagcgaccgagtgcgccatctggtcggtctactacccgataggtgaggtggaatcgacgtggaccagtattccctacggtcggggcctgcgcaaccagccagtatacgtgctaaatgcgcaactggaggaatgtccggtcggggtggaaggagagatttgcattggcgggatggggctggcacaaggctacctgaacgacgcagagaaaacggcggcgagctttgtctggcgcgaagcgagtggtgagcgaatttaccgcactggggatcgcgggcgctactttgctgacgggcaagtcgcctttttggggcgcaacgatacccaagtgaaggtgaatggttaccgtatcga

SEQ ID NO: 10124 - DNA, 1221 bp, Escherichia coli
gcccatccccagacatacatctcaaaacggtttcgctgcgagtcaatgcccgccgtcagataaaccacccgggcaggcaccgccgccgtgtaacgcacaaccttatccatcagcacctggtgatcgagtttttcgcccacagcctcttcccaggtctcgcccagcgtggtgttcacaaaggttttcaggccgttgggatctttcagtgcatccagccagtcatagacaatctgtacccaggtggtgaacggactgtacgccgtccagatatggaaagtgatggagcgcggcggcggaatttcatcaccccgggcgctgaaaaacatcaggccgtcacgggtccacatgcccgtgttttcacagatccaccgcccgttactctggtcaagctcagactgatggatcacacagccatgatgctcacaaaggtagaaaacactttctggcttattcttctcccacttaagaccgaaaggcgaggcatcatcgccaaatttcagatactgctcctccccacagtgcggacagggcacataaaaacgcatgaagtgtgccgactcgttagcggctttttcgatctggcaggagcctttgattttaggcgtcgagccgcgaatggattttggccatacagagccctcaatacgtttatcccccagcagggttggcgaaccctctttttcaacatccggttcgaacgaggaaagctcgtcataacagaccacatccacggatttttcacggtagttttttgctgccgctccccccagacaccagaaacccacaccggaggaaaaacgcttcagggtgagcgtattatcgcggtgttttcttccgaaccatggagccagctccagcaatgcaggaacatcccttatcgttggctcaacatgagatttcataaaatcttcagcagctgagtccgtgggctgaaaaagaaggctgttgcgtgatttatgctcaataaaataagcctccactcccagcaacatctttgtataaccaacacgggcagatttaatcaggttaaccgtgcgaatcagatcgttgcccatacagttcatgatgccaacctgaaacggcagtgtttcccatcgccccggggtataagacgactctttaggaaggtaataatgtttattggcccactgaactgtcgtcagtggaacaggaataatgagagataaaagccctgtagctatcgcaccggctgcattagct

SEQ ID NO: 10125 - DNA, 1216 bp, Escherichia coli
aaggtctgcgtggcagcacttttaacctgcgacatactgtccgtggcactctcttcccactcactccagccggacttcaggcctgccatccagttcccgcgaagcaggtcttcagccgcccaggtctttttctgctctgacatgacgttattcagcgccagaggattatcgccatactgttccttcaggcgctgttccgtggcttcccgttctgcctgccggtcagtcagcccccggcttttcgcatcaatagcggcccgttttgcccgttgctgctgtgcgaatttatccgcctgctgcgccagcgcgttcaggcgctcctgatacgtaaccttgtcgccaagtgcagccagctggcgtttgtactccagcgtctcatctttatgcgccagcagggatttctcctgtgcagacagctggcgacgttgcgccgcctcctccagtaccgcgaactgactctccgccttccacaaatcccggcgctgctggctgattttctcatttgctccggcatgcttctccagcgtccggagttcagcctgaagcgtcagcagggcagcatgagcactgtcttcctgacgatcgcccgcagacaccttcacgccggactgtttcggctttttcagcgtcgcttcataatcctttttcgccgccgccatcagcgtgttgtaatctgcctgcaggattttcccgtctttcagtgccttgttcagttcttcctgacgggcggtatatttctccagcggtgtctgcagccgttcgtaagccttctgcgcctcttcggtatatttcagccgtgatgcttcggtatcgctctgctgctgcgcatttttgtcctgttgactctgctgttcagccttctttcgggcggcttcaagcgcaagacgggccttttcacgatcatcccagtaacgcgcccgcgcttcatcgttaacaaaataatcatccttgcgcagattccagatgtcgtccgctttcttaaacgcagcctctgccttaatcagcatctcctgagcggtatcaggacgaccaatatccagcaccgcatcccacatggatttgaatgcccgtgctgtcctgtctgcccaggtttccagcgtgcccatgttctctttcaggcgtcgggtctggtcatcaaaccctttcgttgcggcctcgttcgccgcctgcaatgccccggattcatcgccggaacgctgcaactgagcaacatacg

SEQ ID NO: 10126 - DNA, 1215 bp, Escherichia coli
gaactctcctccgtyaycssgtkatamckgtcccagtgaaacttcacccgtacccggccatgttcatcacagaagatttcctctcccgcaggcccggtgacaatggcgctctgtggcccgtccaccttcggtttgctttgcagccgtggacgccacgtccggtccgccggtatcacctctaactgatttcccagcgtggttcctctcccctggctgccgtgaagcgcctgcggctggtctcctgacagaatgctctgtaccacctgccattcacggttcagcatcttctgcggatgccccgtcagcgtaaaccacgtccccggccacagcttcggcgaattactctgccctgtggccttttccgcatcactgcgcaggctctccatccggtacagcgtgaaatccttgccgtgctgttcatccttgtaccttcccggataatcaaatatttcatactgttcaagctgtccgttcaggctctcaccctgctgctcatacatccccggccagtccggcaccttaaacgtgtaatcctggctctgcaccgatgacgggcggacatgcgcctcataacggaacatactgacacactccgtctccgctcctgccgatgtgtccgggttaaacggaagctcccccgcctgtgacagccccgccacatcgtcgcacagcgtcagcttctgctccggactgtccgccgcaaaccgctcaaagaagaaaatcccctcctccgcccacagccgcgccagaaacgccaggtccgmcttccccgtactgsacacagaaytcccgcgccggatggtcctcataaaacagcggcgtccactcygtgacgccgttctcgttcagtaatgtggccgatatcgtccggatatcctgctgctggaagatacggaagttccgccgcagcccgcaccgccataacggcggctcaatacgcaggtgataacgcatctgccagccgttgttctcctgcatgccaaagcccgccaccacgccggtgacataacgcagcgggatgacaccctgccagatagtcagcgttgcgttcttctccagcagcatctccgccgtctgcataaaagaatcgctggcgacatccacactcatcacaaacggataagactggttctggattaaccggaaattcaccactgcaaaggtgtccggctcctggccgtcaacctccagcgtaaagcgaagaccttttaagga

SEQ ID NO: 10127 - DNA, 1205 bp, Escherichia coli
tcttgaacgtcccatccacagaaatgtggaaaccttctccgtcgttcttcatcacgtccttcacccaaggatccatccagatgatgaggcgatccttatccccttcgccgctatcgaacaatatggttgaccgactgaggccccccgcattcacatggacaaatgcagagggcaaagccgctagcccttcccgactggatggggccgtcggtagcccgagggaagttttttttgttttgcgcaaagtctcatgtatcgctttgcgactcggtaaccccgctaccgctgcatcgtccatgctcggagtcacctcgtgaaatggctccatgacacgtgccctcaccaacagctttttagcccgctccttcatctcaatgtagcctttcatggaaggcgcatccggatctccgcatgtgtgagaacctttgacagttgcggaagcgagccttacatcatctargttacccgtcacrastagccgagcatgacacttgcgatatccattgctcttacaaccacgatacctcttacaacgacaagaaaccgagcctctctctcgagcaggcgggcgatcgctattcccggcggcattctggtggtaaaggtatcccctatatgagtagagagttgtcccctgacgttctccgggaactatttccagccgtgaggccgctgctccgtcagcaggaggtacgttgaccaccatgtcaacctgatctgcaacmtcacgcagctgaggcgtctcagagatgtgcgaaggtggagtggtattcatacttcgaggttggaaggtggggaaagataactacaagagagtcaatcaccttctaacgggccttcaaggccgggccggagcgcacgcatgtgcatagctaatgccgcacaatacgctggcacagagactcactgggtgaatacccgtaaggaattcttacgaatactcacccagtgtaatacttaagagggcaaattgctgaccgaggtcgatttacacagcagcgatatggcaagggcaggacggaagagctgttgagcggttgagctgtcgaattagtatttcgacaatccatgactcacgattcctaaagagtaattcggaattacccaacaatccacaatcttttgcagcataatgctgccagcattgaaccgaataatcagcccccatcgtagaacgatcccgtatttttatcgcattattaaac

SEQ ID NO: 10128 - DNA, 1202 bp, Escherichia coli
tccttaaaaggtcttcgctttacgctggaggttgacggccaggagccggacacctttgcagtggtgaatttccggttaatccagaaccagtcttatccgtttgtgatgagtgtggatgtcgccagcgattcttttatgcagacggcggagatgctgctggagaagaacgcaacgctgactatctggcagggtgtcatcccgctgcgttatgtcaccggcgtggtggcgggctttggcatgcaggagaacaacggctggcagatgcgttatcacctgcgtattgagccgccgttatggcggtgcgggctgcggcggaacttccgtatcttccagcagcaggatatccggacgatatcggccacattactgaacgagaacggcgtcacagagtggacgccgctgttttatgaggaccatccggcgcgggagttctgtgtgcagtacggggagtcggacctggcgtttctggcgcggctgtgggcggaggaggggattttcttctttgagcggtttgcggcggacagtccggagcagaagctgacgctgtgcgacgatgtggcggggctgtcacaggcgggggagcttccgtttaacccggacacatcggcaggagcggagacggagtgtgtcagtatgttccgttatgaggcgcatgtccgcccgtcatcggtgcagagccaggattacacgtttaaggtgccggactggccggggatgtatgagcagcagggtgagagcctgaacggacagcttgaacagtatgaaatatttgattatccgggaaggtacaaggatgaacagcacggcaaggatttcacgctgtaccggatggagagcctgcgcagtgatgcggaaaaggccacagggcagagtaattcgccgaagctgtggccggggacgtggtttacgctgacggggcatccgcagaagatgctgaaccgtgaatggcaggtggtacagagcattctgtcaggagaccagccgcaggcgcttcacggcagccaggggagaggaaccacgctgggaaatcagttagaggtgataccggcggaccggacgtggcgtccacggctgcaaagcaaaccgaaggtggacgggccacagagcgccattgtcaccgggcctgcgggagaggaaatcttctgtgatgaacatggccgggtacgggtgaagtttcactgggacaggtataacccggcaac

SEQ ID NO: 10129 - DNA, 1200 bp, Escherichia coli
cggtcgtgttggttgcataaacttcctgccgcgccacttgattccgagtcctaacctgtgcttcgtatgatcatggtgtgtacccgctgggtagcgatttccattactaggagcctctcatcagctaaaggaatagaatactgagcagcgtaaaggcaatccgtgcttgtaacgagagaatcctcggtccaagtgcgaatcagtggttttgaagcgcattcgattccccctcgccgcatttctccccatcccttctgattgatgactcgcttgaactgtcggtattcacacttcgatctgtgcgtcctctgtttcatccaactcgtcgtaatactcattagagatgttaactgcgcatgctcctagtctgaggtttccgcaccttcaacccctcccagatgttcgtcatcacagtaatcaatccaatgctgtacccagtgtgaaggcatcactccttatacatctcttttgagcttatttccgaacttgatggtatacaaacaattcgtggtgattggtgacacaggataaccgtgaatagaaaaggtttttggataactcctcctcaccattttcggcaccgtgtcactgttatcttgtcctcaactcattgcatctgacgtaagggattgcgggagcagcaacaagtcaaactgttcaaaatgagtttttgggtgtcaccagggtggccgatggcacggcgatcagtcagtcctgctgaattcttgtcagcagcgattcttcgattcaatagaacttgggaggatcgaacccacggtctgctgtggtgcggaagctccgatgtagtctagctggttaggattcgtggctctcacccacgcgaccggggttcgagtccccgcatcggaatttgttacggttgtgtgagcagattggctcggtaaccaaaacagtccctcgacaagcagttagttgcatcattggtctagtggtagaatacaacgttgccatcgttgtgatccgagttcgattctcggatgatgcagattttcattggccccttctgacccctgcccaacgtttccgaacgcatcatgttgcacgctgagtttaacggatcctcgccaggctaggcgtgctggtcgtttcagctggctgttaagtcgacggtgagcaaccttgtccatggggcgtggggaatagaattcgaaatggtgttgggaggtcagtggccatgat

SEQ ID NO: 10130 - DNA, 1196 bp, Escherichia coli
ctaccagcgacagcttgaggcgatcatccattttgccagcgaaaatggcctgcaaagctggcagcaatgtgatgtgacgatggtgcgtaattttgctgtacgcagtcgccgtaaagggctgggagctgcaagtctggcgttacggctttctgcgctacgtagcttttttgactggctggtcagccagaatgaactcaaagctaacccggcgaaaggtgtttcggcaccgaaagcgccgcgtcatctgccgaaaaacatcgacgtcgatgatatgaatcggctgctggatattgatatcaacgatcccctcgccgtgcgcgatcgggcaatgctggaagtgatgtacggcgcgggtctgcgtctttccgagctggtggggctcgatatcaaacacctcgacctggagtctggcgaagtgtgggtgatgggaaaaggcagcaaagagcgccgcctgccgattggtcgcaacgccgtggcgtggattgagcactggcttgatttgcgcgacctgtttggtagtgaagacgacgcgctttttctgtcgaaactgggcaaacgcatctccgcgcgtaatgtgcagaaacgctttgccgaatggggcataaaacaagggctgaataatcacgttcacccgcataaattacgtcactcattcgctacccatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataatgcgtttttaccggcctttggggcgcatctcggcgctcacctttgacctggatgataccctttacgataaccgtccggtgattttgcgcaccgagcgagaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacatgcagcaatgatcaactttgccaaatggcgcagccggatcgacgtcccgcagcaaacccacgacactttaaaacagctggcgaagaa

SEQ ID NO: 10131 - DNA, 1196 bp, Escherichia coli
ttcttcgccagctgttttaaagtgtcgtgggtttgctgcgggacgtcgatccggctgcgccatttggcaaagttgatcattgctgcatgtgcgcctgcactggcttcttcggcactcagcccggcgtcgagcatcgcttgttcaatcgaacgaaaacgccagcgcgtcacgtcgtgataaatctcgggttccgcttcccgtaccgcctggcgcaggcgttgcagatcttcattctggaagctgcgcagcgccggatgataattttgcacaaaggtaagcgcctctcgctcggtgcgcaaaatcaccggacggttatcgtaaagggtatcatccaggtcaaaggtgagcgccgagatgcgccccaaaggccggtaaaaacgcattatttcccccgtttggcgcgtggatgcgccgcatcgtacaccgaggcaaggtgttgaaaatcaagatgagtatagatttgcgtggtggagaggttggcatgacccagcagctcctgcacaccacgaagatcgccgctcgactccagcatatgggtagcgaatgagtgacgtaatttatgcgggtgaacgtgattattcagcccttgttttatgccccattcggcaaagcgtttctgcacattacgcgcggagatgcgtttgcccagtttcgacagaaaaagcgcgtcgtcttcactaccaaacaggtcgcgcaaatcaagccagtgctcaatccacgccacggcgttgcgaccaatcggcaggcggcgctctttgctgccttttcccatcacccacacttcgccagactccaggtcgaggtgtttgatatcgagccccaccagctcggaaagacgcagacccgcgccgtacatcacttccagcattgcccgatcgcgcacggcgaggggatcgttgatatcaatatccagcagccgattcatatcatcgacgtcgatgtttttcggcagatgacgcggcgctttcggtgccgaaacacctttcgccgggttagctttgagttcattctggctgaccagccagtcaaaaaagctacgtagcgcagaaagccgtaacgccagacttgcagctcccagccctttacggcgactgcgtacagcaaaattacgcaccatcgtcacatcacattgctgccagctttgcaggccattttcgctggcaaaatggatgatcgcctcaagctgtcgctggtag

SEQ ID NO: 10132 - DNA, 1183 bp, Escherichia coli
caatcactacataagtgatatgcaccgctagtctaatggttaggatatctgccttccaagcagatggtccgggtccgattcccgggcggtgcagtttgtatcaacgagggaagggtctttaggctatcgtggaatagttatgctcagcacgtcagggcgatacaggagttgtacgcatgagcagcttggcgcagtggatagcgtgttgggctcataacccaaaggtcccttgatcgaaacaaggagctgctattcatcacaatacactcgagatggttattaaactgagaggtgcagcttaccgactgcatagatcagtcttaccgaaaaatttccactaaacagaaacggtgttttcgtaccattccgtgcgattggcccaaccgtgccagttcaggggaaaaagaacgttaataaagcgttgtccgtgcatagaaaagagctattcacctagagyagaactccttgcaggaatgatgaatgaccgcycggtacctcagaacgcgttgcgragatgaaccaacagcccaaattcacgagccgccgcatgcggattcaaaatgtgcttgcaatcaggaacttcgatgtcacgaaaaagttgtgcagcttgtgccragctagctgtagtatgtgatgagaaccttaccagttggagttatcaatcgagatagaatgcggcctaccatgcgagagatatagtagcagttcgcgatctcaggtacgcgtttaaggcccaawcagactcttggccgcgggatggttgacgacggtacgtccaagaagggattcagatgcccctctacaagtatcacaggaatactcagtcactacataggcgatatgcaccgctagtctaatggttaggatatctgccttccaagcagatggtccgggttcgattcccgggcggtgcagttcgtattaacgagagtggggtctctaggctatcgtggaacagttatgctcagcacgtcagggcgatacaggagtttttacgcatgagcagcttggcgcagtggatagcgtgttgggctcataacccaaaggtcccttgatcgaaacaaggagctgctattcatcacaatacactcgagatggttattaaactgagaggtgcagcttaccgactgcatagatcagtcttaccgaaaaatttccactaaacagaaacggtgttttcgta

SEQ ID NO: 10133 - DNA, 1180 bp, Escherichia coli
tccaccaaaacatcgcgttcataaagtgctactctataatttcaaggacgttccgattggtgtggtatgagtcaaaatattcatcagtgaattccctgcgcatcacgggtgaatctcgttgtcacggccgaatttcgttgttgagttggccgtttaactcagtcggttagagcatcgtgctaataacggggggcgcaggcaagagtcttgcacgaagcactagcatggcttactcattgcactatccaagtgattaagttcacatcaactttttactcgctttgtaagaaatccattcgtgtgaaattcctgacctgcgttgaacgttcggcttatgaaatgcaatcgcctcaatttcgagctcttcgctcgattcccagactccccttaccctgcccaatgtgggctgttgttcgtagagttcgagatcgcctcgtgcaaaggaaatccgtgtgaagttcacgaagaattctgttcctgtgtacccttgatgatgccagccacaaattgactacaactgaaaagtgcattgaggagatgtgttggaaaagatcactgttggtgactggtgacaccgggagttgtacaaaagaatgtaaactatcactcttcctctcattcacaggccagtgtgtcaccaatcacaacctcggaggtttctctgcaccgatctatcaaaacatgacattccaaaacatccatctgacaacggttgcccgccaaaatccgtggtagataacaaaagaaaatggtcatgttatgagcgactttcggggaccagcttgtgaggcttaacgatatgatggctgtgtggtctagtggtatgattctcgcttcgggtgcgagaggtctcgagttcgattctcgactcagccctcgtaagggtgagtttgggcacagtggtaggtgcggctggcggatgtagatagctacggaaaccaggtagtgcagatccctccggaagctaggcaaactgggccatgtgcaaaccgtcggtcactgggaaatggtatagctggtcgagacgcatgaagcactcgagtgctcgaccccgcacccctggacaaagattacagtcagttggtgaactcttcactcgcgtgactaatcgtttaggctacatccttcacgggctcattccgtccaacagtggacatggggtgaggggaacgagcatgat

SEQ ID NO: 10134 - DNA, 1175 bp, Escherichia coli
atggcttcagcccccgttttcacacgaaggtcgatgcggcggccaaatcgttgcaaatccccgtaaaggcagatgcgtgccattcccggtgacgccagagggagtgtgtgcgtcgctgccatttgtcggtatacctctctcgtttactcagttgttcaggaatatggtgcagcagctcaccgtcgccgcagtaaatggcggcgtgattcggcaccgatgaaccaaaacagcacagcagcacatcgcccggctgcgcctctgtcagtgcgacacggtaaaaaccagtagcctccatattgtcaagatagagattctgaccgtgacgccaccagtcatccccgcgatgaaaatccggcatctcaatccccgccagatggtaagcatcccggaacagtgtgtaacagtctgtcaccccgtactcaaagcgccgcccggtgagatgcggcacacagcggaacttgtgaatcgccccccggcagaccagccaccacggcaaatcgctctgcacctgcagccgccggtcagcctcactcagccagggcagaccaccggggtggctgtggaccagcgccacaatctcaccctgcatctctgcctgcagccagtcctccggagccatccggaaatacgcctccggctcaccggagatattcacgcaggggaaatatctttccccctccggcgtgcttaccacgaagccgcacgactccgctggcgcacatcgccgggcgtgcgccagaatcgctgattctgtctctgtcatgggattactgcgaaagtttgttaatggaaaggaagccgccaaagttgccgacgttattgcgaaacttacagccgctcaggcatttgctgcatttatccttcgtgatatcggacgtcggctggtcatattcatccgcgactgccggaccgtgataaccgcactcatcaccgcgataggtccaggtgcaggtgttggccagcatgatacgccccggaaaaacagcgccatccgtttccgtcggcgtggacagtacaaaggaggcactcaccgcgctcagttcgctgcactgctcgatgcgccagcggctgatcacctcctgctccggatcggcgtctctgtttccgttgacgaagttcaccgcatccagaaaacgggcgtaaaccttacgccggaccaccgttccgccgaccag

SEQ ID NO: 10135 - DNA, 1169 bp, Escherichia coli
tcgatgcggcggccaaatcgttgtaaatccccgtaaaggcagatgcgcgccatgcccggtgacgccagagggagtgtgtgcgtcgctgccatttgtcggtatacctctctcgtttactcagttgttcaggaatatggtgcagcagctcgccgtcaccacagtaaatagcggcatgattcggcaccgatgaaccaaagcagcacagcagcacatcgcccggctgcgccgctgacaacggcacctgatacagccctgtggcctccagattatcaagatagagattctggccgttacgccaccagtcatcctcacgatgaaagtccggcatctcaatccccgccagatggtaagcgtcccggaacagcgtgtaacagtccgtcaccccgtgctcaaagcgccgcccggtgagatgcggcacacagcggaacttatgaatcgccccccggcagaccagccaccacggcaaatcactctgcacctgcagccgccggtcggcctcactcagccagggcagaccaccgggatgactgtggaccagcgccacaatctcaccctgcatctctgcctgcagccagtcctccggagccatccggaaatacgcctccggctcaccggagatattcacgcagggaaaatatctttccccctccggcgctctcaccacgaagccgcacgactccgctggcgcacatcgccgggcatgcgccagaatcgctgattctgtctctgtcatgggatttactgcgaaagtttgttaatggaaaggaagccgccaaagttgccgacgttattgcgaaacttacagccgctcaggcatttgctgcatttatccttcgtgatatcggaagtcggctgatcatattcatccgcgaccgccggaccgtgataaccgcactcatcaccgcgataggtccaggtgcaggtattagccagcatgatgcgccccggaaaaacggcaccatccgtttccgtcggtgtggacagtacaaaggaggcactgaccgcactcagttcgctgcactgctcgatgcgccagcggctgatcacctcctgctccggatcggcgtcgctgtttccgttgacgaagttcaccgcatccagaaaacgggcgtaaaccttacgcctgaccaccgttccgccgaccagactctgcagatcttccaccatcc

SEQ ID NO: 10136 - DNA, 1148 bp, Escherichia coli
aacggaaatttcccagtgttgagttacgtaatatcctcaataacttaaatggcgaagcctcacgttggcctggtgactcagaatttctcaacgcttgcatcaatgctccactttatcctggcaggctcgacgcaccgaaaatgcgctcaatgttaacggaacttgaaagagaactttgtcgccaagtaaagacagaaaagcctgatgttccaaatctttctaatctcgatatcgatcatcttatgcctcaaagttggtattcctgttggcctctcgaaaatggtcgtatggtgacaaattcagatgctacggtattgaaccaaattgttctgtctggaaccgatcttacccctgaacagctactggtaaggaaacggcaacaagcgatatctactttgggaaatctaactttgcttaaccttagcgtaaaccgttctgttcagaatgctgtatttctgaaaaaacgtgatgctctcatcgtccacaccaatctacgactgaacattccacttatagttaaggataaatgggatgaggatgaaatcctggagcggggtaaaaagttgggggaaattgcattgaaagtatggccaaaacacgattaatgcaattaataaaatgattatagtggccttacattagtaaggccgctactcactattaaatactttaatttgcatcaagaacagcagtgtcagccctaggtctcggactttgtaccgcttatcttgtcttcaaaaatcagctcgcatcctgcacagttcagcgcattacgttgtagatctgtgttctggtcatttgttgacacacgtacatagccaataagcatggtagatctccctgacaaaagcaggaatgatgccatttgctcgttatttctgcattttcataaacgttggtttgggagaagcggcaaaacggaatgtgggcaacggggaaaaccaaatccctgatatgtctttctggacggttactggtggcaatggaaattttgtgattcgtcaacctgacgggctaatcattcagatggttactgtaagtataagcggcccagtggcgatgaatggaatgactgataatgcttatgccatcacaggttctaataagtcttatattgccacagccacattgccctttgtatttcctaa

SEQ ID NO: 10137 - DNA, 1147 bp, Escherichia coli
tggacgaaaacgctcttgacagaattatattcaacccaattttcccccatggtcattcgacagtctgctcttaagttgagttgcctatggttgtcgcatcagcgtgactatcacggtcgtagtatgacctgttctcaaaacgttcaatatccatgagtggaattagactagtcccggagggggtcgaacccacgacctatggctcataagaccatcgctctaaccactgagctacaggaccgtgaagacccaggcttgggaatctttcatggttaagatgtgttgatacctcgactaaaacgtgcgttctacggtatcacttcacaccatacgacaaccgtccagtcctggcacaggctgaccgcatgacctatgatcacccgcatttacataccccagctcatcgtcgcgtccatcgcctttgaacaaccaccgcctgacgcgagcactaacctatgcatgactaactctgctccgcccggggtctagctggcacacccgttgaacttgccaacaacttctctctcaaaattccacaacaatatctcaccgccatgatccaaggagttatccgcgaggtgtggtaatataggggctgatggttccgcacaagtgaacatgaagagaggcgtgtcaccgtgttgcgcattcagaatgacgaggatgccggctctcagatgtccctggctctgccttggagtgggacttggattttgggagctggtgataccagcgtaaacacagagtaaacccacatatgatttcttgaaatgaattcagtagtgtcacctatcacccttatgtagagcacttgcctagcggttgagcctaaaaactaacagtctagacactttggccgagtggttaaggcggcggcctgctaagccgttgggctctgcccgcgggagttcgaatctcccaggtgtcgttgcaagagttaaacattgcgtttcgcggcttttgtggagcatccatattaaacggatgaagccgagaactcacatgaaacgataaagatcgagatactttggtcgagtggttaaggcggtgggccgtcaagccactggatttcacccgcggaagttcggatcttgctggtgtcgttgtacgtagcctttcctgccgcagggcctcaccacacacgaat

SEQ ID NO: 10138 - DNA, 1142 bp, Escherichia coli
actccttatcctctaaacccatatacaatttccatttcagagtgtactctagggtaggagaccctaggtagtataactccgaagataacctctccaaccgcttgataaagaaatatacagaatctttcccttgtcgacagttctcgaacgccttcagcgacctctgtaatttctcatccgtatcataaagtcttctgactctcttataaaccttagccagatgcttcgcatatgagttatgacaacgataaggtgtcttttgcctatccacgactgtatcccagcagtcgctctcggtatgttgtttcaaccataaatattgcacaacctcaggatgcccttctgttttccgttccatctcagccaaccacatggtgccagaccttcgatcttcgttacctcggaaacgataatccggctttaatttgagagcggtttgttgagcactatcgaactccttaatagcgatggggtccctacatctcgtcgccccacaaccgtcatagcttctcctttgcctatgcaaccttcgcatcggacgataatgagaccctctcgtcaacttatacctcatatcactctgtgagctcgaatttgccacggacgaactttcactgctactttcgtaccgtttccgtgccctatcccgccggctataatccgaggaacttgaacttgaactcgagtcactcggcgatggcgaacccttcttacgagatcgacgggtagtcctagtccgtcttctcgacctcctaggctccctcgaatcgtcgctcggtatcacataccttstgctatcttctctggagtcccctctataccttcttcgactactcgactttgcayctttccgtcgctctctgcgttcattcactcgttcgctcgttcgctcgttcactcgctcgctcgttcgctcgctcgctcgctcgttcactcgcttgattccatctcgtactcctctcaactcatccttcagcgcgcgatcctcgaatccatccctctttcccctctcccgttgcccgcgttgctcacctttttccttaactaatccatccgaagatgttcctctccatctttattatccttatccgtcaagtctcgagcggactctccgggggggtcttgactggatgggtatctat

SEQ ID NO: 10139 - DNA, 1136 bp, Escherichia coli
acattgtctcagtgccaaaaactctgaatcagccattgagtacagatttgaatcttgaatcgtgattaaggatcaggaatcggattcagcggctgattaaaatcaaggatcaaggatcttgctcatgattatgtaatctgactctgtctcaagtactcatactcagaaatctcgactctttttcgtaagctaagaatctgaatcagctctctcgaatcaaggtgtgacttgaattctgaatcaggatcagagcgtgagttgaatcatgaactcagattcatgaatcaggatccgcatacggcccctgctcgatgactcttctcataaaccaaacatgcattaacgacgatatcttcgtccatcaaaacttgatttaataacacagcaagaacacctcggtagccttgtaacttatccaatgacaagctgggagtagatctcaagaagtctatcggaacaaccctatgatatgaaaaatacctttggtcgcccgttaacggatctatagaatgaatatatgtacactatcttagcgaggaacaggccatattgaacatacttgaagagaaaatagcactacctcagtgccagtactatactcactgcgaacaaacagccttctcgacatctacattgacggaagcttcaaaagtctcactatattttctactgaagtaattttgaatctgttcgaaggtcatgccttttgtctctggaacaaccaacagaacaaagatgaccgtcacaagacaaacaacggcaaaactccagaagacaccctggtatgttatagcctctccatagtcatctaagaacatggtgactatccaagaacagataaagtgaacgccagtggcgatagatgcagcgagacccctaacttcatttggaaagatctcagccatgatcaaccatgggatggcaccaacaccgatggcgaaggaagcaatatacaagaaggcggagaagatagccaaccagctgatatcgttatcattaagatcatcaaggaggaagaatacacccagtagaatagctgctacacacataccagcagcacccgctaccaaaagaactcttcttcccgcgatatccatgatgatgcaagcaattagagttacaaccacttgagcagc

SEQ ID NO: 10140 - DNA, 1118 bp, Escherichia coli
tagagaatttcttttgcggtgtccgtccccacttcacacagatacacgccccgctgattgcgggtttttggcatggtgatcaccggcttgccatagacagatgcgccttttaccggcagcacccggaaaacaccgtgtttttttgacctctgataaacgatttcgccatcgatccccccgatgtcccagcagacacgggaaatggtcatttcggttccgtctgcatggcggtattttttgttgatcgccgcatccacacgtaacagcgtctcttcctcatcgggacgccccataatgatgattttatccaccagaaaggcttcctctcccggagcccatccccagacatacatctcaaaacggtttcgctgcgagtcaatgcccgccgtcagataaaccacccgggcaggcaccgccgccgtgtaacgcacaaccttatccatcagcacctggtgatcgagtttttcgcccacagcctcttcccaggtctcgcccagcgtggtgttcacaaaggttttcaggccgttgggatctttcagtgcatccagccagtcatagacaatctgtacccaggtggtgaacggactgtacgccgtccagatatggaaagtgatggagcgcggcggcggaatttcatcaccccgggcgctgaaaaacatcaggccgtcacgggtccacatgcccgtgttttcacagatccaccgcccgttactctggtcaagctcagactgatggatcacacagccatgatgctcacaaaggtagaaaacactttctggcttattcttctcccacttaagaccgaaaggcgaggcatcatcgccaaatttcagatactgctcctccccacagtgcggacagggcacataaaaacgcatgaagtgtgccgactcgttagcggctttttcgatctggcaggagcctttgattttaggcgtcgagccgcgaatggattttggccatacagagccctcaatacgtttatcccccagcagggttggcgaaccctctttttcaacatccggttcgaacgaggaaagctcgtcataacagaccacatccacggatttttcacggtagttttttgctgccgctccccccagacaccagaaacccac

SEQ ID NO: 10141 - DNA, 1115 bp, Escherichia coli
tctcaacttactggtctcgtggcctaatggataaggcgttggtcttcggaaccaaagactgtgggttcgagtcccatcgagatcgcctccacgccgggaagcgcccatatacggatgccactggccgtacagatgtcgatattgattgtatacccttgtgactcgtcgggatacatgctgaggctaagggtacaagaagattgttggtctgccaacgaacgatctccaatgaattgacctcatttagaacactatgtaacgggggcccctctatgaggagcaagagttttgtgatctattcagcgtgtcggatgcgaactcatgtgtgccgttaagtcagtgttgcgcatrgtgacgagatagtgggataaatctcaaactcgttggtctcgtggcctaatggataaggcgttggtcttcggaaccaaagattgtgggttcgagtcccaccgagatcgtcttcaagycgaaaagtgcccatatacggatgccactggccgtacagatgtcgatgttgattgtacacccttgtgactcgtcggaatacatgctgaagctaacggtacaagaagatygttggtctgccamcaagcgatctccaatgaattgacccctttragaacactatgtawtggaggcccctctatgaggagcgagagttttgcgatctattcagcgtgtcrgatgggaaaccatgtgtgccatgaagtcaatgggscgcagagatggtgggacaaatctcaaactcattrgtctygtggcctaatggataaggcgttggtctwcggaaccaaagattgtgggttcgagtcccatcgagatcgtcttttacgccggaaagcgcccatatacggatgccactggccgtacagatgttggtgttgattgtatacccttgtgactcgtcggaatacatgctgaagctaacggtacaagaagattgttggtctgccaccaagcgatctccaatgaattgacccctttaagaacactatgtaatggaggcccctctatgaggagcgagagttttgcgacctattcagcgtgtcggatgggaaaccatgtgtgccatgaagtcaatggggcgcagagatggtgggacaaatctcaaactc

SEQ ID NO: 10142 - DNA, 1102 bp, Escherichia coli
gaacgaagaacaaattcttgaactcatgaccgttgtagtttgttatctcaatagttttcgtcatttatataaaaataaacttaaaaataattttaaaaaaaataaacttaaaaattaatgatatcaccaccctcacacgtatgaaaacatagcacaaaaataaatttaggtgaagtggtgagatctcacctcttttttcacctsttttytcaccccgttgaattcattgctttataactctcttccttggtttctttttagttgctttcttcacgtctgtctccaacttgactgtctttcttcttcgtccgtaatgataccagttacttccaccagtcaatgggtcaaatggtctttcgtaaggatttccatacattccatagggaccatacggaagaactactggtggagaagaaacattttctttagttccatcgactctatttaaatgcattgtttcacctttcatctggtcattaaagtcttttgcgtgttttgcaaactcatcgtcctttcctaaagcattttctgactcagtcgcaaccaaattggatgctttatttatgagccctattttatttaatcttaacttctttgcaacccagcctccaatctttcctttatttgcatctaatgtcttcgaaactcttcctccactcattttatttactgcgtcataagccccaagtgcttttgctccaaatgctaatgcttttgttcccattgcgcctaaagctgtccaagctaccatttacaccatattaaaatcatctctcttcaatattatctcataaaagttctcgttactggagaaagtcaatgaaacataaacattctcattcataaacttctttcttatctcatctatacgcttcaaaatgtctgaacaattgctaacatcttctacaacagttatttcatcatgaacgacctttaagaacaagctcatttaatatgctattaaaatcatctcaataatgagtccatcctttccatctttaggtagcacaacatctttcattgaagaaggttcgacaagtcttatgttaaacttactgacaaagtttgttatactataatgcttcggtggcgaatacatgta

SEQ ID NO: 10143 - DNA, 1100 bp, Escherichia coli
acagacaacggataacggcaaacagaacacctatttctcctcactggataacatggttgcccagggcaatgttctgcccgttctgtacggtgaaatgcgcgtggggtcacgcgtggtttctcaggagatcagcacggcagacgaaggggatggtggtcaggttgtggtgattggtcgctgatgcaaaatgttttatgtgaaaccgcctccgggcggttttatcgtttatggagcatgacgaatgggtaaaggcagcagtaaggggcataccccgcgcgaagcgaaggacaacctgaagtccacgcagttgctgagtgtgatcgatgccatcagcgaagggccggttgaaggtccggtggatggattaaaaagcgtgctgctgaacagtacgccggtgctggacagtgaggggaataccaatatctccggcgtcacggtggtgttccgggcaggtgagcaggagcagacaccgccggagggatttgaatcctccggctccgagacggtgctgggtacggaagtgaaatatgacacgccgatcacccgcaccattacgtcggcaaacatcgaccgtctgcgctttaccttcggtgtgcaggcactggtggaaaccacctcaaagggtgacaggaatccgtcggaagtccgcctgctggttcagatacagcgtaatggtggctgggtgacggaaaaagacatcaccattaagggcaaaaccacctcgcagtatctggcctcggtggtggtgggtaacctgccgccgcgcccgttcaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggca

SEQ ID NO: 10144 - DNA, 1082 bp, Escherichia coli
ttccttttcgttatcacgcgagcttctatcattcaagttgcacaggtcattctccacgaatatgaaatcgatcgctccgttgccacgaataaggcaagtgttgtgggtccagtttgcctgcacccttgttatctcatcaaaccttcgccttcctcattatagcgaatgagcccaatatcggatcgatattgagctcattcgatatcatcgattactgtgctgctaagagtgtgkgtattcgtacagaacttaagtgcaggtagtgcgcttattgttattgtcctagggtcgtagtattggttgttcttagagttcatcaaccgataccccgacacaagcacctaacgcagcgtgagtgacgcttactacacgtgcattactgacagttagtaccgtcgtgggattactggcagcctgtcagtgacaggtatcggctcatgatgttgatagttgggtccgactcggaatcatatatctcgaacaatgacgcttttaatactgactacgctactgtgttcagcgtgagtcgctttggagcaaatccgcaagtacagggtggcgagtcgacactgtcgacttgaaatggctctgccgccataacttctcatagccaaggatctatgagacctatcattggaaacccttctcgaggtctacatagaatgtgtctccaacggtttcattcactggctctataacttaggaggccttctttaaggaaggatcgtaagatcctcgaggaaggagcgcctccttataactaagttactcaaggaaggaggctgaggagctgcgcctaataatactcaggagccgctcctcaaggtccttgaggaaatagccttaggagcataagcttggtcaggctaagcttacccctggctcatgaggtcgagaccgagaatttcggcgtgcagcgcatgcttcgcacacccttcatggaattcgccggtgcgagtggtcgccgatgagttatcggagactaagcgccgcctgcgcgatctcccgtctccacagtatcttccggcgcttgggacctgggtgattacctcacttagcgaggctcgctgaatggccgtagt

SEQ ID NO: 10145 - DNA, 1072 bp, Escherichia coli
atactgcaaagctccgacgagcacgaaagtgctagtctcctatcatgtagtgcatcgtcttgatgccatgtcgctgtcagtcgaggctatacagcccgcaccagttccacaaggtcagctatggaactctgagaggctaagcttaggatctggcagttttgagcatcaatatgatgttacactcccgaggatagccgctggcggcgaggttgctaagtgggttgccaagatgtgtcagtcgcatcgcgccaacaactctyaagtagcatcttaattcagagaagaacktcaaaatctgattgttcgagctggacaaggytctgatcttgatgaccttcgctccagcggcatattagaaaccgcaaaaacgatcatgacgagggaatcgagcaccgacgctttgaagagtagctacaacatccatttatccctccattacagagcgacgtgatcttgacactcaggtcttgctgggtcactcatcacccttcttaccgatctcccgatatycagcaacgtagcggacgttgccactggtgccgacggtcacgtaacaagtgagtacatgagtataatataaatgtccgctcgtgttcgaaaatatcaacgatctgttttgtagtcgtcattcctcgcccctcacgagtatatgagcattagccactgacygatcaatgccccttccatctgactattcgatgccgtgtggtttgcggagaactggtttgaattagactttgtcgaactgatcccgctgatttggatatgaccggccgcattctattacgtcttctcctctggggatttgctcaagcaatcagaattgagcatctccttyacgacaagatgcttgatgctctctcacttctttttgatgaacaagcgctgaacgagacgatgaatatgatgggcgcaaagtgcagccaacagagtgtatcagcgtgttaatcatgcaccccactgtgatctcggcgctggagatggagaaaccgttacatcgctcgaccaatcaatcagacgttacttgtaggtagacttcgaagcaagtgatatactgcgtgtctcattcagt

SEQ ID NO: 10146 - DNA, 1072 bp, Escherichia coli
cggcggagatgctgctggagaagaacgcaacgctgactatctggcagggtgtcatcccgctgcgttatgtcacaggcgtggtggcagggtttggtatgcaggagaacaacggctggcagatgcgttatcacctgcgtattgagccgccgttatggcggtgcgggctgcggcggaacttccgtatcttccagcagcaggatatccggacgatatcggccacattactgaacgagaacggcgtcacggagtggacgccgctgttttatgaggaccatccggcgcgggaattctgtgtccagtacggggaaagcgacctggcgtttctggcgcggctgtgggcggaggaggggattttcttctttgagcggtttgcggcggacagtccggagcagaagctgacgctgtgcgacgatgtggcggggctgtcacaggcgggggagcttccgtttaacccggacacatcggcaggagcggagacggagtgtgtcagtatgttccgttatgaggcgcatgtccgcccgtcatcggtgcagagccaggattacacgtttaaggtgccggactggccggggatgtatgagcagcagggtgagagcctgaacggacagcttgaacagtatgaaatatttgattatccgggaaggtacaaggatgaacagcacggcaaggatttcacgctgtaccggatggagagcctgcgcagtgatgcggaaaaggccacagggcagagtaattcgccgaagctgtggccggggacgtggtttacgctgacggggcatccgcagaagatgctgaaccgtgaatggcaggtggtacagagcattctgtcaggagaccagccgcaggcgcttcacggcagccaggggagaggaaccacgctgggaaatcagttagaggtgataccggcggaccggacgtggcgtccacggctgcaaagcaaaccgaaagtggacgggccacagagcgccattgtcaccgggcctgcgggagaggaaatcttctgtgatgaacatggccgggtacgggtgaagtttcactgggaccgttatcacgggatgacggaggagagttc

SEQ ID NO: 10147 - DNA, 1071 bp, Escherichia coli
actgaatgagacacgcagtatatcacttgcttcgaagtctacctacaagtaacgtctgattgattggtcgagcgatgtaacggtttctccatctccagcgccgagatcacagtggggtgcatgattaacacgctgatacactctgttggctgcactttgcgccatcatattcatcgtctcgttcagcgcttgttcatcaaaaagaagtgagagagcatcaagcatcttgtcgtraaggagatgctcaattctgattgcttgagcaaatccccagaggagaagacgtaatagaatgcggccggtcatatccaaatcagcgggatcagttcgacaaagtctaattcaaaccagttctccgcaaaccacacggcatcgaatagtcagatggaaggggcattgatcrgtcagtggctaatgctcatatactcgtgaggggcgaggaatgacgactacaaaacagatcgttgatattttcgaacacgagcggacatttatattatactcatgtactcacttgttacgtgaccgtcggcaccagtggcaacgtccgctacgttgctgratatcgggagatcggtaagaagggtgatgagtgacccagcaagacctgagtgtcaagatcacgtcgctctgtaatggagggataaatggatgttgtagctactcttcaaagcgtcggtgctcgattccctcgtcatgatcgtttttgcggtttctaatatgccgctggagcgaaggtcatcaagatcagarccttgtccagctcgaacaatcagattttgamgttcttctctgaattaagatgctacttragagttgttggcgcgatgcgactgacacatcttggcaacccacttagcaacctcgccgccagcggctatcctcgggagtgtaacatcatattgatgctcaaaactgccagatcctaagcttagcctctcagagttccatagctgaccttgtggaactggtgcgggctgtatagcctcgactgacagcgacatggcatcaagacgatgcactacatgataggagactagcactttcgtgctcgtcggagctttgcagtat

SEQ ID NO: 10148 - DNA, 1067 bp, Escherichia coli
ctactccggcgaaagcaaagaaaatggctgctctgatagaaaactggactccacctgatggttggtgcaatgggaatgatcgagattggcacgaaaaaatgaagggctatatctgcgattttttacgtaaatgcaacggcttcagggggatgtgatatgaccaaaattaactatcaggcactgcgtgaggcggcagaacgtgcaattccggcaatggaacgcctgttaatgttgccagttgatgatgatttgttaagtgaacaggaacttaaggattacggtgtggatattgatgcgctcaacgccttcaaatttctgaccggaccagaaaccgtgctggcgctgctggatgaacgggaaagaaaccagcaatacatcaaacgccgcgaccaggagaacgaggaaattgcgctaacggtagggaagctgcgcgttgagctggaagctgcagagaagcgcattgcagaactggaagccgaacctgtaagccaaacttacaagttgaacgagctgtcgggcaactatccggtaactccggatggttggataagctgtagtgagcgaatgcccgctcaagatgattggattttaatttattcaaagcacggcgagtatatggcaggacaggtacaaggggaatacgtggagttgagcgacggcactttatcgtggttagggaacgccttgtactggatgcctctaccggaaccgccgcaggaggttaattgatggtctccttcgcgaaatatacgattattgactggatagcattcattcaggttttgctcatctggttttatatggcttacaggagtggacagtggattgtcagtgtagcctgtagcaatggatgggcgttggtggaaccgaaagaataaaaaagcgctggccttggcttcgttttacgaagcattcaatcttaacagtcttcagcctggttctgtcgttgtagtcaccactcaaagcggcatgacgatacaaattcacaagccaaaggaggaaggtcgtggctaacctgcaacttgccgttaaaggtgaatacttcgatgccatgatcgcggagagaa

SEQ ID NO: 10149 - DNA, 1066 bp, Escherichia coli
ttctctccgcgatcatggcatcgaagtattcacctttaacggcaagttgcaggttagccacgaccttcctcctttggcttgtgaatttgtatcgtcatgccgctttgagtggtgactacaacgacagaaccaggctgaagactgttaagattgaatgcttcgtaaaacgaagccaaggccagcgcttttttattctttcggttccaccaacgccatccattgctacaggctacactgacaatccactgtccactcctgtaagccatataaaaccagatgagcaaaacctgaatgaatgctatccagtcaataatcgtatatttcgcgaaggagaccatcaattaacctcctgcggcggttccggtagaggcatccagtacaaggcgttccctaaccacgataaagtgccgtcgctcaactccacgtattccccttgtacctgtcctgccatatactcgccgtgctttgaataaattaaaatccaatcatcttgagcgggcattcgctcactacagcttatccaaccatccggagttaccggatagttgcccgacagctcgttcaacttgtaagtttggcttacaggttcggcttccagttctgcaatgcgcttctctgcagcttccagctcaacgcgcagcttccctaccgttagcgcaatttcctcgttctcctggtcgcggcgtttgatgtattgctggtttctttcccgttcatccagcagcgccagcacggtttctggtccggtcagaaatttgaaggcgttgagcgcatcaatatccacaccgtaatccttaagttcctgttcacttaacaaatcatcatcaactggcaacattaacaggcgttccattgccggaattgcacgttctgccgcctcacgcagtgcctgatagttaattttggtcatatcacatccccctgaagccgttgcatttacgtaaaaaatcgcagatatagcccttcattttttcgtgccaatctcgatcattcccattgcaccaaccatcaggtggagtccagttttctatcagagcagccattttctttgctttcgccggagtag

SEQ ID NO: 10150 - DNA, 1060 bp, Escherichia coli
gaaacctcrttgctggaagcctgkaarawgtatcgggtgttgctgaaccgwgttgatacatcaactgccmctgatattgagtggcctrygaaccctgtcagrgagtaatcattgggattatgccgcagcacgtcttaagcaagaacgtgctgcggytggatgctattttttccctgaagcggaaaacattactacagtaccttgaaccttggttttaacattctcgaaatgctctgagagtatatgtgttaagccttcttcggaatcttttgtgtttgaaaagatgcctttctgattgtaaatgcgcatcagtttttgaccgaagctattgtgcacaackccrtcrccaagaattgtggctccgtatagagttccatcgtcagttaaggcctgcgccgcattgcgtattacacagctttttgtagatatatttccaggcaggcagtgaagaaggtaaaacatggaaatggaatcaaattgaccatgtaacgccgcgggataaggwtcaaaaacatcatggctaattttatgtttaatttttgattccccagcccttgtmgatgccgcgttcaggctagcttcgttcaaatccattaaagatatcagactactctcaggtacgtgagtaaggtaaaacccagttccaacaccaatatccagatggttgttacctamatgttccagaaagtgtggaagaaggtgttcctttgtaggacatccccatgcaagccgatttgatactcccaaaacccaccagtcataaagctttagggtaagtggtgtgtaaattttagccccatcatctgtgttttttttcattgatttcaccatgttatagttttatttgtgaattaaatcaattatggcgatgaattacaaggggttaaatgctgccgcagcatagcgatattgaaatagcctggtatgcttcgatacagcaggagccgaatggctggaagaccgtcactacacagttctacatccaggaattcagtgagtatattgcgccactgcaggatgctgtagatctggaaatcgcaacggaggaagaaagatcgtt

SEQ ID NO: 10151 - DNA, 1054 bp, Escherichia coli
taagtaaaaccaaaactatcagttccaacctcagcgacattcatatttgcagatttaccccaagaagctggagttgctgaattcaacatgtagttggttcgctgaccttcaatcaataaaccttctttttcaaatcgtggctcattaatttccgccgttttcagttcgccagatttgttgatatatgttgccgttgatgcgcgactgaaattaacctgtttatcactggcaacctgaaccacattatcaccaatcttcacttttttataacccggagaatagcccgtaatcatatccagcgaatcattaaagggtatccacacatccggcagcggctgtaaaacatatctgtacggctctgctgtctggtttgcgtattctctggcagcatcttcacttgcttttgctgccgtctggcttgctgccgatgctttcgccgagttcgccgccgctgtttcgctcacctttgcgttggcttcactgtctttggcattcgtctcactggttttcgctgccgtctggctggattttgcgtttttttcgctggcctttgtggctgtctcgctatttttcgcgttggtttctgattttttggctgctgtcgcggagtttgccgatgcagtctgcgaggccgctgccgcctgtgcgctgttagctgcattcgtttctgaggttttcgccgcattcttcgatgaggctgctgccgtttcggatttctttgccgccgctgcactctgtgatgacgctccggcatgacgtgccacttcattcaccatcagctcaaaacggcgcagtgcctccggacgaacatcatcctccgtcatggcaccgagaaaatcattcagcgtacctggtctggaaccttcatagacggtaatggtcccggcatgtgaaggcggaaaaccttcaaccagcaggrtgacgctgtactggccatactcaacatccatgctgtaacgcccggcttcatccggattttcagaggccaccgtgttcaccasyaccgtggtgctgttacgytttgcyttcarctgaatagtgcagttctgtattg

SEQ ID NO: 10152 - DNA, 1054 bp, Escherichia coli
caatacagaactgcactattcagttgaaggcaaagcgtaacagcaccacggtactggtgaacacggtggcctctgaaaatccggatgaagccgggcgttacagcatggatgttgagtatggccagtacagcgtcatcctgctggttgaaggttttccgccttcacatgccgggaccattaccgtctatgaaggttccagaccaggtacgctgaatgattttctcggtgccatgacggaggatgatgttcgtccggaggcactgcgccgttttgagctgatggtgaatgaagtggcacgtcatgccggagcgtcatcacagagtgcagcggcggcaaagaaatccgaaacggcagcagcctcatcgaagaatgcggcgaaaacctcagaaacgaatgcagctaacagcgcacaggcggcagcggcctcgcagactgcatcggcaaactccgcgacagcagccaaaaaatcagaaaccaacgcgaaaaatagcgagacagccacaaaggccagcgaaaaaaacgcaaaatccagccagacggcagcgaaaaccagtgagacgaatgccaaagacagtgaagccaacgcaaaggtgagcgaaacagcggcggcgaactcggcgaaagcatcggcagcaagccagacggcagcaaaagcaagtgaagatgctgccagagaatacgcaaaccagacagcagagccgtacagatatgttttacagccgctgccggatgtgtggataccctttaatgattcgctggatatgattacgggctattctccgggttataaaaaagtgaagattggtgataatgtggttcaggttgccagtgataaacaggttaatttcagtcgcgcatcaacggcaacatatatcaacaaatctggcgaactgaaaacggcggaaattaatgagccacgatttgaaaaagaaggtttattgattgaaggtcagcgaaccaactacatgttgaattcagcaactccagcttcttggggtaaatctgcaaatatgaatgtcgctgaggttggaactgatagttttggttttactta

SEQ ID NO: 10153 - DNA, 1047 bp, Escherichia coli
taaggatgcccagggtccaccagtcaactgctttaccatggccctacaccactaatatcagtctacctccgtgaaccacttcgcccaccttattgagcaggacctcaggggcgatgcactccggtgtgccacagagtgtatacgttcgttgttcgacaatctatgaacaccaaatgtggacactacccgttcggttactctcactttagcaaagccaaagtctgtgagcttcaagtaaccgtccgaggcgagcaggatgttttctggctttagatcacgatagatgatattcttcgagtgaagatattcaaagatgctcacaatttgagctgcgtaaaatcgggccgtctcgttttcgaaccgccccactttacgtaaatgcgtgaaaaactcaccaccgacgacgtacctgaatcactcccttggtagttctgagagctccagggaaaacggactactccagtgcaagataaatatgacgactgtcatggaaacacccataaaggttgacgatcatagggtggtgtatggtcttgaggatcgctttttccgagttgatgtgatcaacctgataggaatggggttactatgattttgatgagctcgtctcacttgtttgagccgtacgatcgcgatctttttcagtatcttcaacgcatagtgtttcccagtgtccctgtgcgtcacgaatcggaccctcccaaaggagcccgtccccaacgtcttgcccaattggaagctctctggaccacacgtgtccaacatagagcactcagcgggcgatggtccaagtggctgcatcgggcagctgaccaccgtaatcggtatattcaccattgcccttgggctctctactcctgccatcaattaagatacaacgtcaaactgaaatggcgaccagagttgggagctctgagttccacacgtgtagtctcggcacggcgaaaattacaagggaagtttcgattgattccaacatcacgatagatgcctagggatagatgcccaacgccaaccccccaataaaacccaagggaatttaaggcc

SEQ ID NO: 10154 - DNA, 1047 bp, Escherichia coli
gacgtgtttcagactaccaagaacttcttggtaatctggaacacgtcagcttcttggcaagaagcgagaaatgtttyyactagtccatgattatgcactgagaactcgtcgccaagacggcatgaaaaatacgttgaagttggactgktcaacactgctaatcccgttcctacgawatgatttagccgctgacgagggcatccagccatctgcagtatcctgggtccycaatyctgcccaaggcgaccaacacatcgcacttgataaccagcaatacgtagagcatgaaccggttgcgactgarcaaccagtgatcaaaatatagagggcgatacgcgttaataatctctagagtaatccctatgagtgttaagagtaaactcacctcatattaccctcattagctgctgagctactagctgtgctggacatgaaatagctggacattgtcaagtaaatagttacactagcaaagttagtgtgtgcgatagattgaacaactccaacaaaacaccttcacatgtggtggtacagaattaatcgagtgtcgtttgacaatcggcacgagaggagcgagtcctcaggagtcatagttgaaataagttgatatcggttggggttttgtcgccacggactgagcttgtaatgagttcaatgagaacctcattcccattaagatctcaatggaaatgttatgaagtaatcggatatatccgataatagggatggccatagctcggcccgagcaaaagcacacgtgtcattaattatcacacacaagyacaccgagtattagaaggagcaaatgaggttggcctgcacaacaaggccacagaatactgcccacgagcgtttttcctcaatggtatcaatcattgattcgccttgtcagtatggcagcccttacgctgacaaaagcacaaagcatcgtcatcaacgtgagaccgtcattagggagaagcgctataccgcacataatactttcagagactagatcaagattgaaaatggtgcaacaggagcaggattactgatggcaatccatac

SEQ ID NO: 10155 - DNA, 1047 bp, Escherichia coli
gtatggattgccatcagtaatcctgctcctgttgcaccattttcaatcttgatctagtctctgaaagtattatgtgcggtatagcgcttctccctaatgacggtctcacgttgatgacgatgctttgtgcttttgtcagcgtaagggctgccatactgacaaggcgaatcaatgattgataccattgaggaaaaacgctcgtgggcagtattctgtggccttgttgtgcaggccaacctcatttgctccttctaatactcggtgtrcttgtgtgtgataattaatgacacgtgtgcttttgctcgggccgagctatggccatccctattatcggatatatccgattacttcataacatttccattgagatcttaatgggaatgaggttctcattgaactcattacaagctcagtccgtggcgacaaaaccccaaccgatatcaacttatttcaactatgactcctgaggactcgctcctctcgtgccgattgtcaaacgacactcgattaattctgtaccaccacatgtgaaggtgttttgttggagttgttcaatctatcgcacacactaactttgctagtgtaactatttacttgacaatgtccagctatttcatgtccagcacagctagtagctcagcagctaatgagggtaatatgaggtgagtttactcttaacactcatagggattactctagagattattaacgcgtatcgccctctatattttgatcactggttgytcagtcgcaaccggttcatgctctacgtattgctggttatcaagtgcgatgtgttggtcgccttgggcagrattgrggacccaggatactgcagatggctggatgccctcgtcagcggctaaatcatwtcgtaggaacgggattagcagtgttgamcagtccaacttcaacgtatttttcatgccgtcttggcgacgagttctcagtgcataatcatggactagtrraaacatttctcgcttcttgccaagaagctgacgtgttccagattaccaagaagttcttggtagtctgaaacacgtc

SEQ ID NO: 10156 - DNA, 1046 bp, Escherichia coli
tggctacttacggctggttttcaatggctataaaaaagccagttttgtgctggctaaaaaacttgagcaatgcacgtcaggtgcaattacgaaatctgacttaagaccggatatctatccgaaagattagcagaacactttcaatttttaaccacagaacgatgaggctaatcgtgggtaagcatcactggaaaatagaaaaacagcctgagtggtacgtgaaagctgtcagaaaaacgatcgcggcgttgccgggtggttacgctgaagcggctgactggctcgatgtaacagaaaacgctttattcaaccgccttcgtgcagatggcgatcagattttcccgctgggatgggcaatggttttacagcgtgctggtggcactcacttcattgctgatgctgtggcgcagtctgcaaatggcgtctttgtgtctcttcctgacgtcgaggatgtggacaacgccgatatcaaccaacgcctgctggaggtcattgaacagatcggcagttattcaaaacagattcgttcagcaattgaagacggtgtagtggaaccgcatgagaagacagcaattaacgatgagctgtacctctcaatttcgaagctgcaggagcatgcagcactggtctacaaaatcttttgcgtttcagaaagtagtgacgcccgcgagtgtgcagctccgggcgccgtggcgtgtcgtgactgtggagaaactaacgcatgaacagtttaacaacacactaccgtcgctcgcaactgattgcgcttcctgtaccgggtggaaaagcgaaggtggagtattgctatgcagtaaatgtaccaggtgacagggaaattgtaacccacagctttgctgagtgggctgtgggtgatttcaaccggcagaaggagacagtcctttgcgacaagttaaccgctggttcaaagatcactacggagtgcccgtcagagtcattcgttgggaaccggaaacacaacgggttatctacctccgcgaaggctatgagcatgaatgcttcagtccgctcgaacagtttcgtcgtaa

SEQ ID NO: 10157 - DNA, 1041 bp, Escherichia coli
taatcgcctggtgtttgttgatgttaccgtcgatggcagtgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtgcttgagcaaatcgaaaagcaattacacaagctggtcgatgtcttgcgcgtgagcgagttggggcagggcgcgcacgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcgataagcttgatgcatttttagcatcgattcgcgatgtggcgaaaattgtggaagttgctcgctctggtgtggtcggactttcgcgcggcgataaaataatgcgttgagaatgatctcaatgcgcaatttgcagcccaacatgtcacgttgggctttttttgcgaaatcagtgggaacctggaataaaagcagttgccgcagttaattttctgcgcttagatgttaatgaatttaatccataccagtacaatggctatggtttttacattttacgcaaggggcaattgtgaaactggatgaaatcgctcggctgggcgggagtgtcgcggaccactgcaagctatgttattaacggcaaagcgaagcaataccgtgtgagcgacaaaaccgttgaaaaagtcatggctggtggtgcgtgagcacaattaccacccgaacgccgtggcagctgggcttcgtgctggacgcacacgttctattggtcttgtgatccccgatctggagaacaccagctatacccgcatcgctactatctgacg

SEQ ID NO: 10158 - DNA, 1039 bp, Escherichia coli
taatcgcctggtgtttgttgatgttaccgtcgatggcagtgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtgcttgagcaaatcgaaaagcaattacacaagctggtcgatgtcttgcgcgtgagcgagttggggcagggcgcgcacgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcgataagcttgatgcatttttagcatcgattcgcgatgtggcgaaaattgtggaagttgctcgctctggtgtggtcggactttcgcgcggcgataaaataatgcgttgagaatgatctcaatgcgcaatttgcagcccaacatgtcacgttgggctttttttgcgaaatcagtgggaacctggaataaaagcagttgccgcagttaattttctgcgcttagatgttaatgaatttaatccataccagtacaatggctatggtttttacattttacgcaaggggcaattgtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctactatctgacg

SEQ ID NO: 10159 - DNA, 1037 bp, Escherichia coli
actcatcaccgcgataggtccaggtgcaggtgttggccagcatgatacgccccggaaaaacagcgccatccgtttccgtcggcgtggacagtacaaaggaggcactcaccgcgctcagttcgctgcactgctcgatgcgccagcggctgatcacctcctgctccggatcggcgtctctgtttccgttgacgaagttcaccgcatccagaaaacgggcgtaaaccttacgccggaccaccgttccgccgaccagactctgcatatcttccaccataccggtgaccatgccgtacaggttagagactgccagcgtgggccgcgtactggtgcctttgccattcagttcaaaaccgctcccctgaatgggatacgcctgatactgcctcccctgccaggtgaccggctcacctttttcgttctgctcattacagaaaaaataacgttctccaccgacctctgtcagatcgatttcccagagcaccacgctggccgactgctccgcacgggtgcattcattcagtgtttcctgccggatatcctgcatcagttcaccacctgtttaaactctgcgctgaacccaacacgcaacatactgacctgcgacgaccattttgcgcaggtcacctttatctgcctgtaaccataaggcggcgtccacagaaaggccttccagcccccgtgctcagccagaaacgactccagcgccgtggcctcctcacgggagacagacagcgtcacgctgtacgttttcaggtcagcgttcagcccggcaggcgcacgctgggaatagccatcaccaaagcgcacctccctgacggaaggagccgatgtcacatccatcccgggtttcactttccagcggaaggttttcatcgtccacctccggagaacagaccaccatcgcgcatctgtgcctggatttcatcacgggcacccttgcgggccatgtcatacaccgccttcatcatctgtggacctggcagaccattcgtaccgtcgttctgaatcaccacgtgattgttctgattaaaattaat

SEQ ID NO: 10160 - DNA, 1037 bp, Escherichia coli; identical to SEQ ID NO: 10159

SEQ ID NO: 10161 - DNA, 1031 bp, Escherichia coli
tcaacgcagttcaccccataaagtggatgaacctgcgtatcataacaatatttacagaagataaatcggcgtctgttgtcagaaacggtatccgataccaacaataaatgcatccgttcgccagtcgccactaccggaaccttcataagcaaggtcaatggtcacggattcggtcgggttaaactgcacgccagccccccacgccagagacgtgttgctgtggcgaccgtcatcacttccggtcagcacatcgtgcgttttccccttgttgtcagttacgcggagataatccccggagaaagtcgacacacggctgtaagccacacccgccatcgaatacgcgctgaaccattcattcacgcgtacagacggccccgccatcacgctgaaccagcggttacgcacggaatcttcatgccagcgggtatcgctgtagtgcgttttttgctcatcctcagcattggcataactgaaggacgtaatcagccccagcgcgtccgtaaactcataacggtatttcacgttaatcccgttcagattatcgctgccgggagcgttcgtacgggcatgaagataccccgcgctcagtgtggactgatgttcagacgcccatgcaggcgcaccggatacggacagacagatggctgcggacaaaatgactgcacaaactttacgcataattacctctcgcttttctgcaataaaaaaggcgccatttctggcgcccgtatatgggttataaaattcagctgatactgatgcctgcggtggctttcttcatcaccacaaccagcaaatcgctgatacttgctgtgggataccagttattcaccagccatgctgacaccgaaaactccagcgtcatgtggccgcgaccagctggcatatcaataacaccactgtaaatcagcgtattatccagcgcggtacggttataaatttcagcaccgtttttccgtactatcagcggcatgacgaataaatatcgttattctcccgctcatgtttagcgccgctgatgcacgcagata

SEQ ID NO: 10162 - DNA, 1031 bp, Escherichia coli; identical to SEQ ID NO: 10161

SEQ ID NO: 10163 - DNA, 1028 bp, Escherichia coli
ttaccgggtctcacggtcagtgatgaacgtgatgttgtcagcccccggcctttactccctctcatttattcacattacaaggatttcatacatgaaaacattgtctcagaacaccacctcttcggcctgtgcaccggagactggcctgcaacaactggttgccaccatagtccctgatgaacagcgcatcagcttctggccgcagcattttggcctcattccacagtgggtgaccctggagccccgkgtcttcggctggatggaccgtctgtrygaaractactgcggtggtatctggaatctgtacaccctgaacaacggyggsgcatttatggcmccygaaccggatgackatgatgacgaaacatgggtactgttcaatgccatgaacggtaaccgcgctgaaatgagcccggaagccgccggcattgcygcctgtctgatgaygtacagtcatcacgcctgccgtacggagtgttatgccatgacggttcattattaccgtctgcgggattacgccctgcarcatccggaatrcrrcgccattatgcgcatyattgactgaaagggggcaggaacaatgcaacagmtttcctttctgcccggagagatgacgcccggcgagcgcagtctcattctgcgggccctgaaaaccctggaccgycatcttcatgaacccggygtggccttcacctccacccgtgcggcacgggaatggctgattctgaacatggcgggactggagcgtgaagagttccgggtgctrtatctgaataaccagaatcagctgattgccggtgaaaccctcttcaccggcaccatcaaccgcacggaagtccatccccgggaagtgattaaaygcgccctgtatcacaatgccgcagccgtggtgctggcacacaatcacccgtccggtgaagtcacmcccagtaaggcagaccgccttatcacggaacgtctggtacaggcactgggcctggtggatatcccgggtgccggaccatctgatagtcggtggcagccaggtt

SEQ ID NO: 10164 - DNA, 1021 bp, Escherichia coli
ttttagcatatgagcacttagagcttgaagaccgcacttttcccatcttcgatgtcgacgcgacatcctagtggtatactccacggataccaagcagcattaatcttgcgagtgcggccttcaagcccgactcttcatggacaagcctagcttgtctccagacccacgtgtttcgagtgtggtaattcaagtagaaagcagcaatgatgaaaccgggctgacaagagaatcatcggtttgagaccaccatgagaagtgttcttttttcttctcaggaaaattcgaaagtttcctatttcgtaccaactaattgaagtagacgagtaacgttcaataatatcaccgtttcattttggtgtttaatgctttatgactatatctaagccttgttgaagtttcagcataaaacgtggaatgctaaatgtctctagtatttcaaattgtctatcattgcatatcatgtcgcgtgttatgtcacattcatgcttatttggaagtgtattacccgaaacttcgaatttatctattccgagttcatctacgagaaaatacgctccgtagaaggcttactattcctagccacattgctattgattcgaaagtctccgagtggcgatggccacctataatgtaacctccgataataacatatctagaaattgcaacgaagtctcatgaccaactgtagactcacagacacaatctgagagaatcgtgtttgaactgatgccaagctgatgaaccttcatgagacttcaacctacgcagagttctgagagaacaaccccctcgtgcaactgttcctgtccttctcaaggaaggaccttgacttactcgtaagtactgtatgctcccaaggccagcaagaacacgccttcgcagatattgtggatctttaccaggtgatcagcatcctttggtgtggtccggcggccagtttttgggtaaaaccagtaaatgccgaggacggtgacgcccaaccccagagccactaaccaccgagtaaccacgggacgtgagg

SEQ ID NO: 10165 - DNA, 1020 bp, Escherichia coli
ccggcgctggaggcgagttgctcagtcaggagtctgccaaattccataatctaggactcaataaataacagggaagttggagatgacaaatacaaaatggttcaggaaacgcttaacagattatcggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttcagcgcagacaatcacatcactgcccggctgtatgcgcgaggttaccgactgcggcctgagttttttaagtgacgtaaaatcgtgttgaggccaacgcccataatgcgggcagttacccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccagattatcaactttcattacttaaaaaattagatgacaagactccactacatccttcaagcgatgtcttccgctcctgtcctagtcgtgtggaaaaagcatttatagcaatggggaaatgggggct

SEQ ID NO: 10166 - DNA, 1020 bp, Escherichia coli; identical to SEQ ID NO: 10165

SEQ ID NO: 10167 - DNA, 1018 bp, Escherichia coli
gagacttttatgcgggcaaaacttctgggaatagtyctgacamcccctattgcgatcagctcttttgcttctaccgagactwtatcgtttactcctgacaacataaatgcggacattagtcttggaactctgagcggaaaaacaaaagagcgygtttatctagcygaagaaggaggccgaaaagtcagtcaactygactggaaattcaataacgctgcaattattaaaggtgcaattaattgggatttgatgccccagatatctatyggggctgckggctggacwacwctcgrcagccgaggtggcaatatggtcgatcaggactggatggattccagtaaccccggaacctggacrgatgaaagtagrcaccctgatacacaactcaattatgccaacgaatttgatctgaatatcaaaggctggctcctcaacgaacccaattaccgcctgggactcatggccggatatcaggaaagccgttatagctttacagccagaggtggttcctatatctacagttctgaggagggattcagagatgatatcggctccttcccgaatggagaaagagcaatcggctacaaacaacgttttaaaatkccctacattggcttgactggaagttatcgttatgaagattttgagctaggtggcacatttaaatacagcggctgggtggaagcatctgataacgatgagcactatgacccaggaaaaagaatcacttatcgcagtaaagtcaaagaccaaaattactattctgttgcagtcaatgcaggttattacgtaacacctaacgcaaargtttatgttgaaggcgcatggaatcgggttacgaataaaaaaggtaatacttcactttatgatcacaatgataacacttcwgactacagcaaaaatggtgcaggcatagaaaactataacttcatcactactgctggtcttaagtacaccttttaacramgttaamyagattttctccccggtggtattgtatagccccggggaatttgtt

SEQ ID NO: 10168 - DNA, 1014 bp, Escherichia coli
tggattggctaagaacaagaagtattcgatactctacgtatatcccctatatcaaaagcatcagcttcacaaaggagtggtagggctggtagggaaagacctggtgtatgctatagactgtaataataatactacatactattagggttatgggaatactagggtgtaggtatcccgagatagcatatgaaaaggagatgatacaacatagtatacctgagatattaaggtagtattaaggttagtcaatgttagttatgatcatcataatggtgtcttcatcataggagtgatatgtcctatgtattactacaattactagctatgggtgtagtaggaggagaaggagtaggagtatgtcataatcttattgatttcccatttgttgataaaccttcaccaaagaggataagaatgtaatactactaatactactattatcattatcttcgtcgtgtatgtagggcatcacgtttattacgacgtattggtgctattggatcggatctatcatcaccaatactaacatctaaagggagaaggatggctcaatatccactagaaccacttattagtaatatactcgttacagaggaggagatgaagggaaaggacgacaacaacaactgtctagctgaggtagtagtagtaatagtattgatgataatgatgatgatggtggtggtggtagatacttacattagtgtcaatgctatctactgataatatattcctatcatcagggaatattagagaatctaagaactctactgcatggtttatgggactcgatacacgatcaaatgatcggatctcatcatcatcacctagtagtagtaaaggagatcatgtatgtctagtagaattatataatacatggaagagagttccaacatcatcagttgttatgtggtgtaataagcgtaatatatcacataatgctatgctcaaggcaagatctatacgtactcaagttaaggatatattatcatcatctagtaatactattagtat

SEQ ID NO: 10169 - DNA, 1013 bp, Escherichia coli
cctctcctttatggttcttcgtacgtaaccatcagtacctcttgtattaccgctcctggcgataaatatcttggatccgtacatgacgtgttgtaatgatattttgagagatgagttattggcaagttcaacgggtgtgccagctggggcacgggtggagcataattagttatgcacaggcgagtgcccgcatcgggcggtggttctttaaaggcgatggatatgatgataatctgggttgagtgaatgcgggttttcgtttgtcggagacgtccccgctccccccagcgcaatgttgagagcctcgtctgatgttcgattgctatgcgatacttgacaagttgcggttccaggctaacgaactttgtccgtgggggggtggggtgcgtcgtaagaaccggtgatttatcttgcgaaggcctccactaggatccgctgggattcaagttcatggattcgaattacaatcacgtcggtggatgaaattgtcgtcgcgccatggctccgatggtgatccgggcatgacggcggtgtcttcaagtggtgagttcggctcatacctgcgggaggattccaaaagtaatccctcgacagcggcaggattcgaacctgcgcgggcagagcccagtggatttctagtccacctccttaaccactcggacacgctgtctgcgacgacgctgaatatcctagcacttccgatgaaacctatgtaggattgaccgttaatgtccttctgttcgctacaatgcgatagtccaagcagctcgagaatacctccgtttgctacgaatccctgtgacaaaaacggctgagtgcaacgacacctgggagattcgaactcccgcgggcagagcccaacggcttagcagccgccgccttaaccactcggccaaagtgtctaattgtactttgcaatatgagatctcaaatccacccgcttgagagtgctccacacaactgggtgactggtgacgctttggagtaatatatccaagaaatcctatgtgggt

SEQ ID NO: 10170 - DNA, 1012 bp, Escherichia coli
cctctccttatggttcttcgtacgtaaccatcagtacctcttgtattaccgctcctggcgataaatatcttggatccgtacatgacgtgttgtaatgatattttgagagatgagttattggcaagttcaacgggtgtgccagctggggcacgggtggagcataattagttatgcacaggcgagtgcccgcatcgggcggtggttctttaaaggcgatggatatgatgataatctgggttgagtgaatgcgggttttcgtttgtcggagacgtccccgctccccccagcgcaatgttgagagcctcgtctgatgttcgattgctatgcgatacttgacaagttgcggttccaggctaacgaactttgtccgtgggggggtggggtgcgtcgtaagaaccggtgatttatcttgcgaaggcctccactaggatccgctgggattcaagttcatggattcgaattacaatcacgtcggtggatgaaattgtcgtcgcgccatggctccgatggtgatccgggcatgacggcggtgtcttcaagtggtgagttcggctcatacctgcgggaggattccaaaagtaatccctcgacagcggcaggattcgaacctgcgcgggcagagcccagtggatttctagtccacctccttaaccactcggacacgctgtctgcgacgacgctgaatatcctagcacttccgatgaaacctatgtaggattgaccgttaatgtccttctgttcgctacaatgcgatagtccaagcagctcgagaatacctccgtttgctacgaatccctgtgacaaaaacggctgagtgcaacgacacctgggagattcgaactcccgcgggcagagcccaacggcttagcagccgccgccttaaccactcggccaaagtgtctaattgtactttgcaatatgagatctcaaatccacccgcttgagagtgctccacacaactgggtgactggtgacgctttggagtaatatatccaagaaatcctatgtgggt

SEQ ID NO: 10171 - DNA, 1012 bp, Escherichia coli
tggattggctaagacaagagtattcgatactctacgtatatcccctatatcaaaagcatcagcttcacaaaggagtggtagggctggtagggaaagacctggtgtatgctatagactgtaataataatactacatactattagggttatgggaatactagggtgtaggtatcccgagatagcatatgaaaaggagatgatacaacatagtatacctgagatattaaggtagtattaaggttagtcaatgttagttatgatcatcataatggtgtcttcatcataggagtgatatgtcctatgtattactacaattactagctatgggtgtagtaggaggagaaggagtaggagtatgtcataatcttattgatttcccatttgttgataaaccttcaccaaagaggataagaatgtaatactactaatactactattatcattatcttcgtcgtgtatgtagggcatcacgtttattacgacgtattggtgctattggatcggatctatcatcaccaatactaacatctaaagggagaaggatggctcaatatccactagaaccacttattagtaatatactcgttacagaggaggagatgaagggaaaggacgacaacaacaactgtctagctgaggtagtagtagtaatagtattgatgataatgatgatgatggtggtggtggtagatacttacattagtgtcaatgctatctactgataatatattcctatcatcagggaatattagagaatctaagaactctactgcatggtttatgggactcgatacacgatcaaatgatcggatctcatcatcatcacctagtagtagtaaaggagatcatgtatgtctagtagaattatataatacatggaagagagttccaacatcatcagttgttatgtggtgtaataagcgtaatatatcacataatgctatgctcaaggcaagatctatacgtactcaagttaaggatatattatcatcatctagtaatactattagtat

SEQ ID NO: 10172 - DNA, 1004 bp, Escherichia coli
cacgacgagggagagttcaatgttaacaacgtgttggctaatgatgtcgcccgcttttcatggaatagggactgtcgacttagatgcaactctttgaggagtatgaaatatgttgaagggagtcgaagagtaatacaatgtggtttatgtggaaaagacttgactgccagccatgtagtcacttgtgacactaacgtggatacaactgagctgcttcatcgagccatggctgggaaagtagatgagaaaagttgggcaacattatccagagccctcgatgatattattagaagatttggttttgactgctgattcagcagtgctgaagcctcactactcctgatgttatactttgtctactgtttggtcttatgacttagagatgccagcctttatcagctgtaccattgctcttgttgattactgctcgtgaagaagtactgcatatgtcattgaaagaaaagaaactgcaagagacccctttgatagcactacaaattgtagtctacaatataagaaccacagatgtatgatatatgattcacgtaatgtcgattatcacgaaacctcgacataacttacataatcattatgccataatggcattatgtaattcgggttcatgagtaatatggcatcatatgatgatgatgatcatgatgatgtttacacttctgatgatttgaccaactcggccacgcgaacgtgagcagtgcagcgaactgcgagtcaatatcaaaaaataggaacgttgattgtataggtcacagacttaggctgatggcctgccggataacgtgaaggaagatgactggcgaggagatgacccacaaggtgacaccaaagtgccgaggagcgacgcagcagacaggagccaaacaacctcggaaagcacaagcaagaagaattgagtttctaatccgaagagcaagataatactatggtacacgagacatcgtctcagatgactcgtcgccgacctcacagacgattcgtgtgtgaag

SEQ ID NO: 10173 - DNA, 1004 bp, Escherichia coli; identical to SEQ ID NO: 10172

SEQ ID NO: 10174 - DNA, 1000 bp, Escherichia coli
attactaataataacagtattggtgctaatagtagtagtgtgatagcaacaacaacaagagcatatgaggatgatatatggaaggagttagttgctcaacatcatgatcagactgttagaactgttgatttaaaacagatgatgtcccaagaatggtgataagtgttggtttaagcgtggtaactcaacaacaacaacaacatcatcataacaaagaacagtatggtaatcatcattatcagttgattattgtattattaatatcattagtattggaactaacaacgaagccatattgcatgttagtattaaacctgttgtgttaatatattatccatcacccacaacactaggactatgaatagctataaatcccgccgaaatggccactatactcaacatcgtattatgagggctacttagggtacttagtagaatatattaccaccacaaggtaaggtgaatagacaatagtcactatacagtactctatcatagtaatagtaaccatgcatgaaccttcactaagctttcatcatgttgttgttgtctaatactactagtatagaagctatcttacaaccaccatcactattaagtagctatattcctacactctagaggcgggggcgggggccttgttgagcctattatcgtgtatgatggttaaatcgtccaccatgtgtagcatatgatagttctgactctgaggatattcttattagatatcgttactatcctaatatgtatacaggtcctagacgggatcctttagtagtaaatgagccgtcctaccaatccttgggctacgactacgagaaaagaagaagaagaaataggagattcatagatataatcgttcctctcgaataatgggttaaaacgtcaccactcgaatccatcaatcccccatgataatcaacgcatgtttactaaacattgttcagacatactaaagagatctttattaccatgtcactaccctctcctactactacta

SEQ ID NO: 10175 - DNA, 997 bp, Escherichia coli
tagtagtagtaggagagggtagtgacatggtaataaagatctctttagtatgtctgaacaatgtttagtaaacatgcgttgattatcatggggattgatggattcgagtgtgacgttttaacccattattcgagaggaacgattatatctatgaatctcctatttcttcttcttcttttctcgtagtcgtagcccaaggattggtaggacggctcatttactactaaaggatcccgtctaggacctgtatacatattaggatagtaacgatatctaataagwatatcctcagagtcagaactatcatatgctacacatggtggacgatttaaccatcatacacgataataggctcaacaaggcccccgcccccgcctctagagtgtaggaatatagctacttaatagtgatggtggttgtaagatagcttctatactagtagtattagacaacaacaacatgatgaaagcttagtgaaggttcatgcatggttactattactatgatagagtactgtatagtgactattgtctattcaccttaccttgtggtggtaatatattctactaagtaccctaagtagccctcataatacgatgttgagtatagtggccatttcggcgggatttatagctattcatagtcctagtgttgtgggtgatggataatatattaacacaacaggtttaatactaacatgcaatatggcttcgttgttagttccaatactaatgatattaataatacaataatcaactgataatgatgattaccatactgttctttgttatgatgatgttgttgttgttgttgagttaccacgcttaaaccaacacttatcaccattcttggacatcatctgttttaaatcaacagttctaacagtctgatcatgatgttgagcaactaactccttccatatatcatcctcatatgctcttgttgttgttgctatcacactactactattagcaccaatactgttattattagtaat

SEQ ID NO: 10176 - DNA, 995 bp, Escherichia coli
tctgtaatgaggtaaaacaaaatgagtaaagtctttatttgcgccgccattccggacgaacaggyaataaaggaagaaggtgcmgtcgctgtagccactgccattgaagccggtgatgaacgtcgcgcccgcgcaaaatttcactggcaattcctggaacattatccggctgctcaggactgcgcttataaatttcttgtttgcgaggataaaccyggtataccccgccctgccctcgattcctgggatgctgaatatatgcaggaaaaccgctgggatgaggmgtctgcttcctttgtyccggtygagactgaatcmgatccgatgaacgtcacttttgacaagctggcccctgaagtacagaacgctgtcatggttaagttcgacacatgtgaaaacatcaccgttgatatggtkattagcgcrcaggaaytrttgcaggaagacatggcaacattcgacggacatatcgttgaagcgttgatgaaaatgccagaagttaacgccatgtatccggagcttaagytgcaygccatygggtgggttaagcataaatgtawkcctggtgcyaaatggcccgaaattcaggcagagatgcgcatctggaaaaaacgtcgcgaaggtgaacgcaaggaaaccggaaaatacacgtctgttgttgatctcgcccgcgccagagccaatcaacagyacactgaaaattcaacaggaaaaatcagcccggtcattgctgccattcatcgcgaatacaagcagacatggaaaacactggatgacgaactggcctacgctctctggcctggtgatgtggatgccggaaacattgacggcagcatccatcgctgggcaaaaaatgaagttatcgacaacgaccgcgaagactggaagcgtatctcggcatcaatgcgcaaacagcctgatgcccttcgctacgaccgccagactatttttggccttgtccgtgaacgcccgatcgacattcacaaagaccctgt

SEQ ID NO: 10177 - DNA, 992 bp, Escherichia coli
gcgcaagaaaattgtttcgctcttgctgggagtggctttcacggaatgccgccatccacaccgttgcagcacgacggtataarcccctggactccagttcttccgcctggcgggtcaggcacaaaatcacccggggatcgttagtgccgacatagaaattgcgcacaggtctggwttcwcgaactggttgyggttccggctcctgcgstmtctcagtcagscgcgggaaatgtctgcgtgtatcyccttcacaacggtgagccacacgcccactctgacgtaacttgcttgctgactgcagaacgcgctgtcgtgagtaacctgcaaaagcatccgcaatgtcwccggaagtacaccccggatgggcttcaatgaatttctgaacgtcattyaaaagactcatgatcaccccctgaatcctgccgggatctggctgtagtccacgttgtcgtaactggctttgaagtacgggtcytcgcgtttttcggtgtacgtgctgacggacggcgataagcgcagggaaagctcatcccatttttcccgcagcttcgacgggctgagcacgttacggcaccagaacggatcgcgactgacgcggctgtacatctcgcagatttgtttatgagtacgaccatcctgcacacacatcaggcgaatttcgtttgcccatgctgtccagttcggttctttgggacgaaccacctcgccgtcacattcggcggcatgctcgtacagggcgatgatttttttccagagccactgtgcgcaggtcaaatcatcctgcgtcccccactggcgctttttagggctgaatacaacmgcatcaggatggcgagttaaaaamtcctgttcagccgtctgcgtgtccggttgcgaagcgtccggacgagaagtttttttatctgacggatcatgttttgattttactgacggatccccgccagattctgacgggtgaaaacccgcttttttgccagatttcgacgcatcaa

SEQ ID NO: 10178 - DNA, 991 bp, Escherichia coli
caaatttgccgttttgtattaacagaaaactggctcgaatgaatatcgtttgcttgtttatatttcagtaaaattgctagaatatataaacgttgccgctatgtgaagtgctactatgtaacaaaattgagcaattttgctcaaagaaggggcaaaccgataaattgctccttccactattgagcaaattgctacttttcagaggagcaatttgtcgctttgcaaatggacaaccccgcaatggagcaactttttgctgttctacaatcggaggaagaaattgaaatttcgcacgcgagagtcgaaccttggtgggttgttggtgattgtgttgagcattgcattatagtttcgaagtctctgagtggtgactattttgcaaagttctttggttctgtcgctatagataagtatagttgcagcactgggagaatgatggatggactattgtaagtggtagtaggtcgttagtaaagacttacattcgttaagggttcgttggattttcatattttccacatcattgcagttcgcacatggtcacagaaggacgagggagaggatttgtgtttacatggtagttcgtattgggcggaatcactcgtactgagtgatccgagatcacttatttggatcagcatggatcactcatctgcagtgcagtgctggtattgcaggcacccaagtggtgcccatgcgagatgtcgtggctttcatacacacatcctgatccctacgtggcctattgcatgcgaaccaatatgctcttccgtagtctgagcaaatactggtcattgcagaaagatgcccctcgcgaacatcgaaattatcgaggaaagatgcaggctggcttagcagtgctaagctagcactccgcatctacccgacgctgaacaagttctcccgaggtaccagatgtgaggagaaagtgcgaaagttctcgcctaacaacaatgctattttattggtggaggagtatgagagccacgcg

SEQ ID NO: 10179 - DNA, 988 bp, Escherichia coli
gatcgccatctgcacgaaggcggttgaataaagcgttytctgttacatcsagccastcagcmgcttcagcgtaaccwcccggcaacgccgcgatmgtttttctgacagctttcacgtaccactcaggctgtttttctaytttccagtgatgcttacccacgrttagcctcatcgttctgtggttaaaaattgaargtgttctgytaatctttcggatagatatccggtcttaagtcagatttcgtaattgcacctgacgtgcattgctcaagttttttagccagcacaaaactggcttttttatarccattgaaaaccagccgtaagtagccwggtgttgagccaacttttccggccaactcgccctgctgttctttggttaaagagtcccaatacgctttcatacaatrtgtacctccgrtrtacatattacatgattgaratgaaccytcaagatacttgtaccttawcggtacaarggttttaatttckttatgaaaacartccatgacatccggcggtctaacgccagaaaactgagagatggtgttggcgggaattcttcctttgccacyatgattgatcgcgagccaacccagaccagcaggtttatgggagatggtgctactaaaaatatcggtgacagcatggcamgrcacatcgaaaaatgtttcgacctgcctgtcggatggctygatcaagaacaccagacmacgaacatcacaaaaaaacctgatgtttcaatcactaayaaacaaatmacrttagtccctgtcatatcatgggtacaggccggagcatggaaagaagttggmtattctgaggttgatttgagcacagcagaaacttatccctgccctgtaccctgtggcgaaatgacttatatcttgcgggtgattggtgattcaatgattgatgagtaccgcccgggagacatgatttttgttgatcctgaagtccctgcctgccacggtgacgacgttattgc

SEQ ID NO: 10180 - DNA, 987 bp, Escherichia coli
gagacttttatgcgggcaaaacttctgggaatagttctgacaacccctattgcgatcagctcttttgcttctaccgagactatatcgtttactcctgacaacataaatgcggacattagtcttggaactctgagcggaaaaacaaaagagcgcgtttatctagctgaagaaggaggccgaaaagtcagtcaactcgactggaaattcaataacgctgcaattattaaaggtgcaattaattgggatttgatgccccagatatctattggggctgcgggctggactactctcgacagccgaggtggcaatatggtcgatcaggactggatggattccagtaaccccggaacctggacagatgaaagtaggcaccctgatacacaactcaattatgccaacgaatttgatctgaatatcaaaggctggctcctcaacgaacccaattaccgcctgggactcatggccggatatcaggaaagccgttatagctttacagccagaggtggttcctatatctacagttctgaggagggattcagagatgatatcggctccttcccgaatggagaaagagcaatcggctacaaacaacgttttaaaatgccctacattggcttgactggaagttatcgttatgaagattttgagctaggtggcacatttaaatacagcggctgggtggaagcatctgataacgatgagcactatgacccaggaaaaagaatcacttatcgcagtaaagtcaaagaccaaaattactattctgttgcagtcaatgcaggttattacgtaacacctaacgcaaaggtttatgttgaaggcgcatggaatcgggttacgaataaaaaaggtaatacttcactttatgatcacaatgataacacttcagactacagcaaaaatggtgcaggcatagaaaactataacttcatcactactgctggtcttaagtacaccttttaacgaagttaaccagattttctcccc

SEQ ID NO: 10181 - DNA, 986 bp, Escherichia coli
caaatttgccgttttgtataacagaaactgctcgaatgaatatcgtttgcttgtttatatttcagaaaattgctagaatatataaacgttgccgctatgtgaagtgctactatgtaacaaaattgagcaattttgctcaaagaaggggcaaaccgataaattgctccttccactattgagcaaattgctacttttcagaggagcaatttgtcgctttgcaaatggacaaccccgcaatggagcaactttttgctgttctacaatcggaggaagaaattgaaatttcgcacgcgagagtcgaaccttggtgggttgttggtgattgtgttgagcattgcattatagtttcgaagtctctgagtggtgactattttgcaaagttctttggttctgtcgctatagataagtatagttgcagcactgggagaatgatggatggactattgtaagtggtagtaggtcgttagtaaagacttacattcgttaagggttcgttggattttcatattttccacatcattgcagttcgcacatggtcacagaaggacgagggagaggatttgtgtttacatggtagttcgtattgggcggaatcactcgtactgagtgatccgagatcacttatttggatcagcatggatcactcatctgcagtgcagtgctgtattgcaggcacccaagtggtgcccatgcgagatgtcgtggctttcatacacacatcctgatccctacgtggcctattgcatgcgaaccaatatgctcttccgtagtctgagcaaatactggtcattgcagaaagatgcccctcgcgaacatcgaaattatcgaggaaagatgcaggctggcttagcagtgctaagctagcactccgcatctacccgacgctgaacaagttctcccgaggtaccagatgtgaggagaaagtgcgaaagttctcgcctaacaacaatgctattttattggtggaggagtatgagagccacgcg

SEQ ID NO: 10182 - DNA, 985 bp, Escherichia coli
gtcctgacaccccctattgcgatcagctcttttgcttctaccgagactttatcgtttactcctgacaacataaatgcggacattagtcttggaactctgagcggaaaaacaaaagagcgtgtttatctagccgaagaaggaggccgaaaagtcagtcaacttgactggaaattcaataacgctgcaattattaaaggtgcaattaattgggatttgatgccccagatatctatcggggctgctggctggacaacactcggcagccgaggtggcaatatggtcgatcaggactggatggattccagtaaccccggaacctggacggatgaaagtagacaccctgatacacaactcaattatgccaacgaatttgatctgaatatcaaaggctggctcctcaacgaacccaattaccgcctgggactcatggccggatatcaggaaagccgttatagctttacagccagaggtggttcctatatctacagttctgaggagggattcagagatgatatcggctccttcccgaatggagaaagagcaatcggctacaaacaacgttttaaaattccctacattggcttgactggaagttatcgttatgaagattttgagctaggtggcacatttaaatacagcggctgggtggaagcatctgataacgatgagcactatgacccaggaaaaagaatcacttatcgcagtaaagtcaaagaccaaaattactattctgttgcagtcaatgcaggttattacgtaacacctaacgcaaaagtttatgttgaaggcgcatggaatcgggttacgaataaaaaaggtaatacttcactttatgatcacaatgataacacttctgactacagcaaaaatggtgcaggcatagaaaactataacttcatcactactgctggtcttaagtacaccttttaacaacgttaaatagattttctccccggtggtattgtatagccccggggaatttgtt

SEQ ID NO: 10183 - DNA, 979 bp, Escherichia coli
ttaccgggtctcacggtcagtgatgaacgtgatgttgtcagcccccggcctttactccctctcatttattcacattacaaggatttcatacatgaaaacattgtctcagaacaccacctcttcggcctgtgcaccggagactggcctgcaacaactggttgccaccatagtccctgatgaacagcgcatcagcttctggccgcagcattttggcctcattccacagtgggtgaccctggagccccgggtcttcggctggatggaccgtctgtatgaagactactgcggtggtatctggaatctgtacaccctgaacaacggtggcgcatttatggcacccgaaccggatgacgatgatgacgaaacatgggtactgttcaatgccatgaacggtaaccgcgctgaaatgagcccggaagccgccggcattgctgcctgtctgatgacgtacagtcatcacgcctgccgtacggagtgttatgccatgacggttcattattaccgtctgcgggattacgccctgcaacatccggaatacgacgccattatgcgcatcattgactgaaagggggcaggaacaatgcaacagatttcctttctgcccggagagatgacgcccggcgagcgcagtctcattctgcgggccctgaaaaccctggaccgtcatcttcatgaacccggtgtggccttcacctccacccgtgcggcacgggaatggctgattctgaacatggcgggactggagcgtgaagaattccgggtgctatatctgaataaccagaatcagctgattgccggtgaaaccctcttcaccggcaccatcaaccgcacggaagtccatccccgggaagtgattaaatgcgccctgtatcacaatgccgcagccgtggtgctggcacacaatcacccgtccggtgaagtcacacccagtaaggcagaccggcttatcaccgaacgtctggtacaggcactgggcctg

SEQ ID NO: 10184 - DNA, 977 bp, Escherichia coli
agaactgtgtggtgacggtcttccagccattcggctcctgctgtatcgaagcataccaggctatttcaatatcgctatgctgcggcagcatttaaccccttgtaattcatcgccataattgatttaattcacaaataaaactataacatggtgaaatcaatgaaaaaaaacacagatgatggggctaaaatttacacaccacttaccctaaagctttatgactggtgggttttgggagtatcaaatcggcttgcatggggatgtcctacaaaggaacaccttcttccacactttctggaacatgtaggtaacaaccatctggatattggtgttggaactgggttttaccttactcacgtacctgagagtagtctgatatctttaatggatttgaacgaagctagcctgaacgcggcatctacaagggctggggaatcaaaaattaaacataaaattagccatgatgtttttgaaccttatcccgcggcgttacatggtcaatttgattccatttccatgttttaccttcttcactgcctgcctggaaatatatctacaaaaagctgtgtaatacgcaatgcggcgcaggccttaactgacgatggaactctatacggagccacaattcttggcgatggagttgtgcacaatagcttcggtcaaaaactgatgcgcatttacaatcagaaaggcatcttttcaaacacaaaagattccgaagaaggcttaacacatatactctcagagcatttcgagaatgttaaaaccaaggttcaaggtactgtagtaatgttttccgcttcagggaaaaaatagcatccaaccgcagcacgttcttgcttaagacgtgctgcggcataatcccaatgattactccctgacagggttcgtasgccactcaatatcagtgcagttgatgtatcaacacggttcagcaacacccgatactttttccaggcttccagcaatgaggtttc

SEQ ID NO: 10185 - DNA, 970 bp, Escherichia coli
ataaagtggatcttgtgataaaatccatgctcttatttgaggctgaaatctgagccaactagcctcccgcaatagagattcatattgtgtgtttatacaacgcaaagcgatttgcaacacaactgaatcgctttacttacaaacgctcaattctattgaggagataaacaatatatacacaattccacacactcagaatatgactgtcatattatgacaattatgcagatgacatgactgatgtactactgtacatccatatgagaatctcacagtggcttgccgtcttccctcgaatgacgaacccaggtgctgctctcggcgctatcagattccgatccgacatcctcgcacatttggtcggtcaaatgaagcggagcgctccggcaccatgtggtgctgtctacgtcatcgagttccaaagtggatgaaacagaacgctcgagttggagtggtctagactctcgaatccatgtcgtactgtcagcgtcgtcaaagtctccttcagagttggaatctgatatgcgacaaacggttggattgaatattcgggttatatgggggatatgcttcatcttcaaagacagagaaaactcacgtaattactctggacgctctcacaacggcggccatcgaacgagagtgattcagcatcggatgaggagaagccgggtgacgaatcagggttagatcctttgtctactgctcatatcggtttcggatagaactatgaatgaaaggatatcatacagggaggaatcaatcagtaacatgtacgtaaatgggtcagagtagttatcatttccctcatccctctcggcatcgttcgggggctctaaaatgtgatcctgtagaataccagattgggctctatggaagttcagcatacccggagctgaaatagctgaattatacctcccgagaggtggaactcgtctctcagtcggccgaccgcgtcggactccaggta

SEQ ID NO: 10186 - DNA, 967 bp, Escherichia coli
gtgctaatggatgtcctaagtgagggatatgcattcaaccgcggacaatggcaacgcgttctctgaatgacagctaagatccaattcatcttcagatcgaatggctgtaatcgtggcaacctgattgaaggactgaacttcatgaaaaatcatggcattgttactggtaagaatattcgacacagatcactcaagtttggtgagttttggrtcgtcatggactctcttagcatcactcgtagccttcataggtaatgaattcaaaccggcggaccaactggctagcgctgatggctgctggccgtatccactyccgaagtgcaatcatgcaagctcagcggctagycaatatcccaaatgtccgtcagtaagtgtaacatagcgttcctcgtggcgtcatcacatggtggtggattctctggtcgtaggaggctctctcccagcctgcatgccaaactgaatgcatcaatgagtcatacaagaccagcctgcagcagtaggagcacaccagatggagacttcataatcactctatgttagagatcttcaccgtgctaagagctggggccgtctaccaacatctcctcagaagatcaagcaagagatattcgataatggaaccgtaggctaccgtagcttaactacggagttcacgtgatttcgatactgagttctagcagtggcgatgaagctagcctctctaataatgatctgataaactagattgagtttgatcatcaaacttggatgatatctctactatttgtgttattcaagaaaaccgaactcgactttgcgactgagaatttagatttctctcggatgatgtcgctggtagcctgagcggatcgcctctattatagaggctctaaatttcaggttctcggggtgatttctatgtatgaggatttccgactctacaagtctggtgtctacgtgcacacaactggtggcctcgtgggtgttc

SEQ ID NO: 10187 - DNA, 967 bp, Escherichia coli; identical to SEQ ID NO: 10186

SEQ ID NO: 10188 - DNA, 966 bp, Escherichia coli
ataaagtggatcttgtgataaaatccatgctcttatttgaggctgaaatctgagccaactagcctcccgcaatagagattcatattgtgtgtttatacaacgcaaagcgatttgcaacacaactgaatcgctttacttacaaacgctcaattctattgaggagataaacaatatatacacaattccacacactcagaatatgactgtcatattatgacaattatgcagatgacatgactgatgtactactgtacatccatatgagaatctcacagtggcttgccgtcttccctcgaatgacgaacccaggtgctgctctcggcgctatcagattccgatccgacatcctcgcacatttggtcggtcaaatgaagcggagcgctccggcaccatgtggtgctgtctacgtcatcgagttccaaagtggatgaaacagaacgctcgagttggagtggtctagactctcgaatccatgtcgtactgtcagcgtcgtcaaagtctccttcagagttggaatctgatatgcgacaaacggttggattgaatattcgggttatatggggatatgcttcatcttcaaagacagagaaaactcacgtaattactctggacgctctcacaacggcggccatcgaacgagagtgattcagcatcggatgaggagaagccgggtgacgaatcagggttagatccttgtctactgctcatatcggtttcggatagaactatgaatgaaaggatatcatacaggaggaatcaatcagtaacatgtacgtaaatggtcagagtagttatcatttcyctcatccctctcggcatcgttcgggggctctaaaatgtgatcctgtagaataccagattgggctctatggaagttcagcatacccggagctgaaatagctgaattatacctcccgagaggtggaactcgtctctcagtcggccgaccgcgtcggactccaggta

SEQ ID NO: 10189 - DNA, 961 bp, Escherichia coli
ttcggcctgaccaaaattcaagctgctatacctctggctgcattgacttgtggtcagagtgtatggtgatcatagcaattgcaagtattgggctcgataaatcctttgaagacgacttaattgcatccgggtattgtaagtgttgagagtaggcttagtcttacgatccactgagattcatcccgtgttgcgccgatttgtctcctcctattctatttccatctacggactcgatttaaaaaggcggattactccacactcaagagcttctgagagctctggtgtggggcacggtagagctggatcgcggtatagtgtcctggtgagggtttgaagttggatggaggattacaccttatgggttgaaaatcctcgacttgtccaaatttgggtgtgcgcggttgggggtaacttggctttttggtcgactttatgatcgccagcggccatactgcgtcgaatacaccggatcccatccgaactccgaagttaagcggcgcaaggcccggatagtactggggtgggggaccgcccgggaagtccttagggtgctgctggctttttgcaaaagtcgcacattttgctagttcccccctccccacctccttggacattgttccacttttcacttgtattgtgaagcacccaatgctagcccacatcacagcccagtagttcaatagagagacgagtgaacatagtttataacattgtccaaggggtggagggggatgcgcgaaatcgatgtgcacgtttggtcaaagatgctcgcgaaagctgcacatcaatttcgcacatgggcgaaattgacttgcaggtgggtataaaagttgatgtaggccatgtggctcgatttcaaccatatgggtatgcttctgaggatggggtgttacagtggaccatatgtggtaggtcatttggagatgtcaccaaaatggtctaaatctgcgcattccattta

SEQ ID NO: 10190 - DNA, 961 bp, Escherichia coli
taaatggaatgcgcagatttagaccattttggtgacatctccaaatgacctaccacatatggtccactgtaacaccccatcctcagaagcatacccatatggttgaaatcgagccacatggcctacatcaacttttatacccacctgcaagtcaatttcgcccatgtgcgaaattgatgtgcagctttcgcgagcatctttgaccaaacgtgcacatcgatttcgcgcatccccctccaccccttggacaatgttataaactatgttcactcgtctctctattgaactactgggctgtgatgtgggctagcattgggtgcttcacaatacaagtgaaaagtggaacaatgtccaaggaggtggggaggggggaactagcaaaatgtgcgacttttgcaaaaagccagcagcaccctaaggacttcccgggcggtcccccaccccagtactatccgggccttgcgccgcttaacttcggagttcggatgggatccggtgtattcgacgcagtatggccgctggcgatcataaagtcgaccaaaaagccaagttacccccaaccgcgcacacccaaatttggacaagtcgaggattttcaacccataaggtgtaatcctccatccaacttcaaaccctcaccaggacactataccgcgatccagctctaccgtgccccacaccagagctctcagaagctcttgagtgtggagtaatccgcctttttaaatcgagtccgtagatggaaatagaataggaggagacaaatcggcgcaacacgggatgaatctcagtggatcgtaagactaagcctactctcaacacttacaatacccggatgcaattaagtcgtcttcaaaggatttatcgagcccaatacttgcaattgctatgatcaccatacactctgaccacaagtcaatgcagccagaggtatagcagcttgaattttggtcaggccgaa

SEQ ID NO: 10191 - DNA, 955 bp, Escherichia coli
tcttcgacgaattctcgcttcaattccgaatcggtaccatccttttctaatccaatctgggtagggaaatatgatatttcgagtatcttcttttgcgctccacagtccaatctgaagtggacttcggcgctggtcattgggctcccatagcttagaaccacgttgatctcactctctggcaccttatagcattcaattctctcaatcatcctcgaaacttcagaattatctcttcaattctgatgattctatatctgtatagtctgttgaacagactctcttcctgactatcatcggtatttcatactctataggtcctatagggtatcctatagtactatagactcagcctgagtctacaaacctcaactggaccctcacattgacgaatcaaactcgtcgaattatcaatgacgatagatctccgcaatatccgtagtctcatacaagtcgcatcattcttccagaaaggtatgctttgatgggaaaaggacacaatatccttgcttgagcagggaatcatccaggaacctataatgctcccgcggagaactcattttgtatttgtcacatgactaggaatacattcttcaatcagtttcccatgttaatttcgcctcattaggaacattcccccatcactataaaaccccggggaacattatttctcaaagctggatgcgtttctgcgctcgaggcgccaattttcatccttccatataatcttcattcatatggccaaatcgccccgcggcatgttcgggctctttaagaaccggcaaaagagaggttttgcccatgataacctcccaaaggatccgtttcctttcctcagcttttcccacaaaagtttcccttagccttcggttccgaacaatacgtgtgtgacgatagcatcacacaacaccgcatagccggagttaatccattaacagacgtaaaatgcgtctcagtg

SEQ ID NO: 10192 - DNA, 955 bp, Escherichia coli; identical to SEQ ID NO: 10191

SEQ ID NO: 10193 - DNA, 952 bp, Escherichia coli
gacagtcaagctttatcaactttccccttagtgagatggatgttggtgaccctaaatggtagtagtaatatgctggtactgcaaatatgccttgaatgatcgttcttccctcagtgccgctaaagttgtcaactgggtcaatcgattcactgataagaatcatgttatggaatccgtaggggaccttgataagtttgccgagaataaccccttccttgctattggtcttttcgacaaagaacaagatggggaattgtgagttattgtatttcctgctgctcccaagctgtaatgtgtgtgctataatatgtagtttcaagcacagtacaatgcactttgacgatgtattcttcgctacggcatatggtgaagtagctgtggagatagtggatcatttatataacagacggtaagatgtatatagtaacacttttgctactgctcactaatgtctttatgcaccatcgtgtaactggattgttattcttcagtaaaataagcagtaaaccacctggatttcctgcaattatccttctgtatcatcatgatcatcaccatgctatctatcatggagaattggaatatcataaggtaagacatcattgtcgcaagttcttgtacgagcaaaatgctcgtcgatcctacatttttatgatgacaatgttatcttattactcaggtcgacagatttattctttcaagaagggtgccttcaatgacggagtatactcctgaaggtgcagagacagtgggtgcattattggcattgctcgtaatcaacgatgcttgtgtggtagctgctatcaagtggtatgccagtactgtatctcatacgggataaggatactcaggcaggcaaggaggcggaagctgacctcagagagatttccagggatttagctggtaataatgcattgtaccgatcttgccgatatgtcattggatcctctta

SEQ ID NO: 10194 - DNA, 950 bp, Escherichia coli
gacagtcaagcttatcaacttccccttagtgagatggatgttggtgaccctaaatggtagtagtaatatgctggtactgcaaatatgccttgaatgatcgttcttccctcagtgccgctaaagttgtcaactgggtcaatcgattcactgataagaatcatgttatggaatccgtaggggaccttgataagtttgccgagaataaccccttccttgctattggtcttttcgacaaagaacaagatggggaattgtgagttattgtatttcctgctgctcccaagctgtaatgtgtgtgctataatatgtagtttcaagcacagtacaatgcactttgacgatgtattcttcgctacggcatatggtgaagtagctgtggagatagtggatcatttatataacagacggtaagatgtatatagtaacacttttgctactgctcactaatgtctttatgcaccatcgtgtaactggattgttattcttcagtaaaataagcagtaaaccacctggatttcctgcaattatccttctgtatcatcatgatcatcaccatgctatctatcatggagaattggaatatcataaggtaagacatcattgtcgcaagttcttgtacgagcaaaatgctcgtcgatcctacatttttatgatgacaatgttatcttattactcaggtcgacagatttattctttcaagaagggtgccttcaatgacggagtatactcctgaaggtgcagagacagtgggtgcattattggcattgctcgtaatcaacgatgcttgtgtggtagctgctatcaagtggtatgccagtactgtatctcatacgggataaggatactcaggcaggcaaggaggcggaagctgacctcagagagatttccagggatttagctggtaataatgcattgtaccgatcttgccgatatgtcattggatcctctta

SEQ ID NO: 10195 - DNA, 949 bp, Escherichia coli
cacctcggttgtgtgcgaatccccggccgttgtctatcactgcaactccagtgctgttggatgcaacagcaacgacagtctcgaagtgtctgtgacattgagcttcaacgcaggtcgagactggagcttcacgtagggacatgtccagrttgaatcgctytaytccttgtattagctcagtgaacttcacatatgctccrcggagttcgatagtatccmtttggccrtcctttggcccggccactggaggcacaagactcaccgcgttagtcgtcaccagtgaattcttggtccgcaacttttgtgtcggcgatcaagtcatgccggtgaccagcaaggcctcgaatggcaacgcgactrtcaccgaaatcgaaggcatcgtaccaccactgcaacgaaatggtatgagtacytgccgcttgtaggcataagaccttacgcctcagacacaacgagaattagcacttggacagtcggagtttccaygatgcaggatgatggtcgttgcttagagagctccaataacttcacctacgtcgacatgtggaatgtagagagcgtcgagccaacccagggaatcttccagaatgtycacgactcrgcggccctgttggtcactggcaacaacttctatatgcattctgatgctgtgtaaatgwacctctactctgtgacaacaycgasagctcaggtgtcgattctcgatatcgatgatggtcaacgctagtgctttgggtactgctgcctacaacgtgtcctggcgctatggtgacttgtctaaacgcgccttgrcagtgaggatsgcatctgacctcgaatggctattgctatagtcaggacctgctgtctcaacgagactgtgatgtccaagtgccggccagagtgttggactggaaccgcctcatgtgtggtccagagttcggcgttgactacattgatcggaccatag

SEQ ID NO: 10196 - DNA, 949 bp, Escherichia coli
ctatggtccgatcaatgtagtcaacgccgaactctggaccacacatgaggcggttccagtccaacactctggccggcacttggacatcacagtctcgttgagacagcaggtcctgactatagcaatagccattcgaggtcagatgcsatcctcactgycaaggcgcgtttagacaagtcaccatagcgccaggacacgttgtaggcagcagtacccaaagcactagcgttgaccatcatcgatatcgagaatcgacacctgagctstcgrtgttgtcacagagtagaggtwcatttacacagcatcagaatgcatatagaagttgttgccagtgaccaacagggccgcygagtcgtgracattctggaagattccctgggttggctcgacgctctctacattccacatgtcgacgtaggtgaagttattggagctctctaagcaacgaccatcatcctgcatcrtggaaactccgactgtccaagtgctaattctcgttgtgtctgaggcgtaaggtcttatgcctacaagcggcargtactcataccatttcgttgcagtggtggtacgatgccttcgatttcggtgayagtcgcgttgccattcgaggccttgctggtcaccggcatgacttgatcgccgacacaaaagttgcggaccaagaattcactggtgacgactaacgcggtgagtcttgtgcctccagtggccgggccaaaggayggccaaakggatactatcgaactccgyggagcatatgtgaagttcactgagctaatacaaggartaragcgattcaayctggacatgtccctacgtgaagctccagtctcgacctgcgttgaagctcaatgtcacagacacttcgagactgtcgttgctgttgcatccaacagcactggagttgcagtgatagacaacggccggggattcgcacacaaccgaggtg

SEQ ID NO: 10197 - DNA, 943 bp, Escherichia coli
tttgagatatttgctctttaaaaatctggatcaagctgaaaattgaaacactgaacaacgagagttgttcgtgagtctctcaaattttcgcaacacgatgatgaatcgcaagaaacatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgrcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctctttatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctgggttc

SEQ ID NO: 10198 - DNA, 943 bp, Escherichia coli; identical to SEQ ID NO: 10197

SEQ ID NO: 10199 - DNA, 943 bp, Escherichia coli
ttcatacatgaaaacattgtctcagaacaccacctcttcggcctgtgcaccggagactggcctgcaacaactggttgccaccatagtccctgatgaacagcgcatcagcttctggccgcagcattttggcctcattccacagtgggtgaccctggagccccgtgtcttcggctggatggaccgtctgtgcgaaaactactgcggtggtatctggaatctgtacaccctgaacaacggcggggcatttatggcccctgaaccggatgactatgatgacgaaacatgggtactgttcaatgccatgaacggtaaccgcgctgaaatgagcccggaagccgccggcattgccgcctgtctgatgatgtacagtcatcacgcctgccgtacggagtgttatgccatgacggttcattattaccgtctgcgggattacgccctgcagcatccggaatgcagcgccattatgcgcattattgactgaaagggggcaggaacaatgcaacagctttcctttctgcccggagagatgacgcccggcgagcgcagtctcattctgcgggccctgaaaaccctggaccgccatcttcatgaacccggcgtggccttcacctccacccgtgcggcacgggaatggctgattctgaacatggcgggactggagcgtgaagagttccgggtgctgtatctgaataaccagaatcagctgattgccggtgaaaccctcttcaccggcaccatcaaccgcacggaagtccatccccgggaagtgattaaacgcgccctgtatcacaatgccgcagccgtggtgctggcacacaatcacccgtccggtgaagtcacccccagtaaggcagaccgccttatcacggaacgtctggtacaggcactgggcctggtggatatccgggtgccggaccatctgatagtcggtggcagccaggtt

SEQ ID NO: 10200 - DNA, 936 bp, Escherichia coli
tggtcagtcagtttgaacaatgcctttcgtctccgctcttcggtactttgtaggtaggtcatgtcgcgcccccggagtgttccatctccgagatggaagtgggaaagttgcgaaacgtgctttacttcgctccgccgtgccatagctaaagagcgaggtcacgccgagctctcatgacaatactttgttgatccctttcttgttcactctgctgtgaacctgtcatcagtcgtcaccaatactactagcctagcctaccttacaccatcttacgaagacttgagttgttagcagagaacaagaacacgcgttcgtctgctgaacgggacgcgctgaagatcgaaagtatcaatcgagtggcaccgtgtgcggatagcctggtcgtgagtgctagacgagatctgcctgtctgaacggagttatgagggcaacttgagatcccgttcaagcttgagatagcacgcgacaggaaaaatacgaacagctgggtcacacagaaagcaccgattagacgaacgagagtatcgaccgtagggaagcgatcaatccttcgagattatgagacatgtccgaccaactatgtatatttgttctgggcattttttttgaccagactatatctgccacgcccacagaaattgcacatctcggactcaacgatcaaccatccatcgaccccatccagagggcttattcatactgaggcatacttggctttgggctgatggactgaggtattgattgtactatgctgtggatggcatagactatgctatagactgacgtggtcttgtcaaggtcgatattgtaaataatgtaactctctttcgaagacctcgtccggtctccgctcctctctgaggcctgtcattacagactagtagtctgagactaccacaaaaaatatacccaggtacagccactgcactgcagtga

SEQ ID NO: 10201 - DNA, 936 bp, Escherichia coli
tcactgcagtgcagtggctgtacctgggtatattttttgtggtagtctcagactactagtctgtaatgacaggcctcagagaggagcggagaccggacgaggtcttcgaaagagagttacattatttacaatatcgaccttgacaagaccacgtcagtctatagcatagtctatgccatccacagcatagtacaatcaatacctcagtccatcagcccaaagccaagtatgcctcagtatgaataagccctctggatggggtcgatggatggttgatcgttgagtccgagatgtgcaatttctgtgggcgtggcagatatagtctggtcaaaaaaaatgcccagaacaaatatacatagttggtcggacatgtctcataatctcgaaggattgatcgcttccctacggtcgatactctcgttcgtctaatcggtgctttctgtgtgacccagctgttcgtatttttcctgtcgcgtgctatctcaagcttgaacgggatctcaagttgccctcataactccgttcagacaggcagatctcgtctagcactcacgaccaggctatccgcacacggtgccactcgattgatactttcgatcttcagcgcgtcccgttcagcagacgaacgcgtgttcttgttctctgctaacaactcaagtcttcgtaagatggtgtaaggtaggctaggctagtagtattggtgacgactgatgacaggttcacagcagagtgaacaagaaagggatcaacaaagtattgtcatgagagctcggcgtgacctcgctctttagctatggcacggcggagcgaagtaaagcacgtttcgcaactttcccacttccatctcggagatggaacactccgggggcgcgacatgacctacctacaaagtaccgaagagcggagacgaaaggcattgttcaaactgactgacca

SEQ ID NO: 10202 - DNA, 935 bp, Escherichia coli
ggcaactcctccaatataaaaaaagcccgctctgtaagtaaggtcttgtgagcaactgcctgtgtagtgtgagctgaattacggaaacagatatccaatgagggatatactctccccaggttcgatgatcctactcctgaagactgtggtggctacgacggtctactcaggaaggttcgtgaggattctattccggttcacatggtaaggaaactcctcgagagaataatgcctccgccagggatcgaactatcaatcactctgtcactgtttcgagaactccattaacctagtccgactaatttagtcgccctctcaatacactacacgtcgccatgcattcaaactagccatcttttgtagatccatgttattactcccgatcctgaatacctgaagtcggaagttgtcggacgattgaagggattcgccgcgtaagcgttccatgtctacttgctcattctatgtgcgttctgcgggtgatgacgttatcttggctatcagtgaggttagctccccatagtacatccttatgggttttgttgattcagctctgctggatactgcttgcgatgatggttatccgtgaaggatgcaagttcgatcccaagcgagtgtacttttaggtctcatggatgcgccgcagctcagtctttgtcattcctctgcgatattataccggcagcagcaaataagggatacggcattcgtgttttgaaggagcgccttggatgtgagtcgctgttgacgttttagctcgtgctaaaacgatccgttgtagataattctattgcttgcattggcgatgcaatgaacgacaaggagatgttacagaatgctgatgtacctgttgttatggggaacgcgatgaatgaaattaaggtgagttcccacacgccacgaaataggatctcacttttctcgccctcagactc

SEQ ID NO: 10203 - DNA, 935 bp, Escherichia coli; identical to SEQ ID NO: 10202

SEQ ID NO: 10204 - DNA, 931 bp, Escherichia coli
tcctaagcaccggcttaggcgcgtatattctgtcactcgacttcggcaacataggttggaccacaccaacactttggtcgcaaggcttttccttgctatcgatgccattcacgtgaggcgtcgtggtagcgggaacggtagggtaggggttggctggaccagaaaagagggggggctgagctgcgagctgagaggcttctgaagagcgctcgaagggaccccaagttctcgagacagcatgagcaggagaatctctgctttgtctcctgctctcggcggtagaagaaatctgtggactgctccgtgaggtaaaggacgactgttgtttatgatgagaaagagacatatggtacggtaaggcgtgctcctctgcagccgatggcacagggtttggttcgaacgaacgcggattaacctgaaaaggcccttcctacgaacagtatgcgggaaaatatgcacatgtgtcagtgatagtatgaggtgatttttggaaattcttgttacttactgagcatttctctaaacttgtataattgatgaggagagtctgagttcagctggggatagcgaacatatattcctacacattgtcatcaacacatgcagttgactatgtgcatattttcccacatttctcacgagagccgcccgttctccactaccacatcgaggcgaataaggccgttgcttctctgagagacctcaagagcatcgtcgaaggtctctggtgtcaagacgcacatatcgccttcatcgtccttatacctacttacaaccatgaatgcagacgagcaaatcctatgggatcgctcgaggctcacctgataatgcgaccttgctcaagtgataccatcttttccacaacttccctcactttattgtatgacacctcttctgtcggaacctttaatcgccatatgcactcttcgtg

SEQ ID NO: 10205 - DNA, 931 bp, Escherichia coli; identical to SEQ ID NO: 10204

SEQ ID NO: 10206 - DNA, 927 bp, Escherichia coli
agtaaatcaaaacatgatccgtcagataaaaaaacttctcgtccggacgcttcgcaaccggacacgcagacggctgaacaggattttttaactcgccatcctgatgcggttgtattcagccctaaaaagcgccagtgggggacgcaggatgatttgacctgcgcacagtggctctggaaaaaaatcatcgccctgtacgagcatgccgccgaatgtgacggcgaggtggttcgtcccaaagaaccgaactggacagcatgggcaaacgaaattcgcctgatgtgtgtgcaggatggtcgtactcataaacaaatctgcgagatgtacagccgcgtcagtcgcgatccgttctggtgccgtaacgtgctcagcccgtcgaagctgcgggaaaaatgggatgagctttccctgcgcttatcgccgtccgtcagcacgtacaccgaaaaacgcgaagacccgtacttcaaagccagttacgacaacgtggactacagccagatcccggcaggattcagggggtgatcatgagtcttttgaatgacgttcagaaattcattgaagcccatccggggtgtacttccggagacattgcggatgcttttgcaggttactcacgacagcgcgttctgcagtcagcaagcaagttacgtcagagtgggcgtgtggctcaccgttgtgaaggggatacacgcagacatttcccgcggctgactgagataccgcaggagccggaaccgcaaccagttcgtgaatccagacctgtgcgcaatttctatgtcggcactaacgatccccgggtgattttgtgcctgacccgccaggcggaagaactggagtccaggggcttataccgtcgtgctgcaacggtgtggatggcggcattccgtgaaagccactcccagcaagagcgaaacaattttcttgcgc

SEQ ID NO: 10207 - DNA, 926 bp, Escherichia coli
gggagaccccacactaccatcggcgctacggcgtttcacttctgagttcggcatggggtcaggtgggaccaccgcgctacggccgccaggcaaattctgttttatcaacacgtcctgttctgacctgtcgatttaatctgtatcaggctgaaaatcttctctcaatccgccaaaacagcttcggcgttgtaaggttaagcctcacggttcattagtaccggttagctcaacgcatcgctgcgcttacacacccggcctatcaacgtcgtcgtcttcaacgttccttcaggagactctaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggccaacgttagaacatcaaacattaaagggtggtattt

SEQ ID NO: 10208 - DNA, 926 bp, Escherichia coli; identical to SEQ ID NO: 10207

SEQ ID NO: 10209 - DNA, 923 bp, Escherichia coli
agtcagatcggctgactccacaggcccgcatcatccgtcgcgccggtagtcatagccrctggccaccatactggtgatcaaatctgacagtgccgggatatcgctcatcaccggataaatccgggactccatccacgaatccagctctgaatccggcacctgagcaggcaggaaaacttcaatatgcagctccgcctgccaggtatcgctgtccagctcttcgcccgtgtattcagcgccggtgagataaacggcaattgccggaaaatcttcctcatcaaaaacagcrgggcgaccatcaaaaagcgtcgccccggtgtcatgcttctccagtgcatccagtacggctgcacggagttcagtatgtttcatcgctttattaccattctcagttgatgctgcagcgcatagcccagctctttcggaagacgytcacgccgtatccgytcaatattctgtttaaacgccgtggtcagcggcaccgccatcgggattttcaccacatcaatggggtaacggtttttcccggccacacgctgcatracatgccaccggccrtttttcagttgctgaataaacgcgccgggaatacgacggttwcccaccacaagcacgctgccgccacctttcagggatgaacgctgcccctttttacgacgcctgcgkcgggacaggacaacccgcgcrttacccagcytgattacgggcaaatccccccggttaactttgattctggcctgcggatttttgaccgtggcccttttcagcctggccctttcctttaccagtttccggcgtacctttgtctcacgrgcaaccwgtgacgcmgactgcgatatcgcggatgaagcaacgcggttaatggccattgcggcggcaccgggcacygccgttttgctgatacggctgagttttcaacggcc

SEQ ID NO: 10210 - DNA, 919 bp, Escherichia coli
aactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccaatttcggccacgcgatggcgtagcccgagacgataagttcgcttaccggctcgaataaagagagcttctctcgatattcagtgcagaatgaaaatcaggtagccgagttccaggatgcgggcatcgtataatggctattacctcagccttccaagctgatgatgcgggttcgattcccgctgcccgctccaagatgtgctgatatagctcagttggtagagcgcacccttggtaagggtgaggtcggcagttcgaatctgcctatcagcaccacttcttttctcctccctgttttttccttctgtttattgcattcaacaagtcgggcatgttgcctggttgatgtggtgatatcaccgatttatccgtgtcttagagggacaatcgatgtctaaagaaaagtttgaacgtacaaaaccgcacgttaacgtcggtactatcggccacgttgaccatggtaaaacaacgctgaccgctgcaatcactaccgtactggctaaaacctacggcggtgctgctcgcgcattcgaccagatcgataacgcgccggaagaaaaagctcgtggtatcaccatcaacacttctcacgttgaatacgacaccccgacccgtcactacgcgcacgtagactgcccggggcacgccgactatgttaaaaacatgatcaccggtgctgctcagatggacggcgcgatcctggtagttgctgcgactgacggcccgatgccgcagactcgtgagcacatcctgctggggcgtcaggtaggcgttccgt

SEQ ID NO: 10211 - DNA, 919 bp, Escherichia coli; identical to SEQ ID NO: 10210

SEQ ID NO: 10212 - DNA, 909 bp, Escherichia coli
aaattgaaagtgttctgctaatctttcggatagatatccggtcttaagtcagatttcgtaattgcacctgacgtgcattgctcaagttttttagccagcacaaaactggcttttttatagccattgaaaaccagccgtaagtagccaggtgttgagccaacttttccggccaactcgccctgctgttctttggttaaagagtcccaatacgctttcatacaatgtgtacctccggtgtacatattacatgattgaaatgaaccttcaagatacttgtaccttaacggtacaagggttttaatttcgttatgaaaacaatccatgacatccggcggtctaacgccagaaaactgagagatggtgttggcgggaattcttcctttgccactatgattgatcgcgagccaacccagaccagcaggtttatgggagatggtgctactaaaaatatcggtgacagcatggcacgacacatcgaaaaatgtttcgacctgcctgtcggatggctcgatcaagaacaccagacaacgaacatcacaaaaaaacctgatgtttcaatcactaataaacaaatcacattagtccctgtcatatcatgggtacaggccggagcatggaaagaagttggatattctgaggttgatttgagcacagcagaaacgtatccctgccctgtaccctgtggggaaatgacttatatcttgcgggtgataggtgattcaatgattgatgagtaccgcccgggagacatgatttttgtcgatcctgaagtacctgcctgccacggtgacgacgttattgcattgatgcacgatacaggtgaaaccaccttcaaaaggttgatagaagatgggacacagcgttatctcaaagcgttaaacccaaactggcctgagccttacattagat

SEQ ID NO: 10213 - DNA, 908 bp, Escherichia coli
tcagcctgtgggggaatctcagcaatctcgaactttttgatactcatatcagaataaagaaatttttcaatgttatatcaatattgtttgtgtcgagttgaaagtgcacatcccattttcctgtgagtgtatttgtatcctcacttctttagtaagttcatatcactagctcttttttcgaccttcatttctacaggttcctccactaaattcgtatcactagcgtttgatactcccgttgtgttcttcggattctgtcatttaattttcggcctgtcaatttctagcctacggcacttcgaagttaatgagaaattgaaaagtgataaagaaatttctccacgtattcttagcatgcacgcgtcaaaatcgcgcctcaaaataccaacttccactagggaagtatatcaacaacttcgcgcctaatctagtgctataaatcagcagaaagaggatctttcgtaatggtatccctccataactcagccccatatttgccatttcggtcgctggccgaaattctctgtttcggcctcgtaaaacaggcgtaaactgagcccgacaaacctcacgctcccagaggctatttgctcaaggactttaaggagcggttcctaagtgttctgaagtggagctccttagcctccttccttgaggatcatacgttggaagatgagttaacaccccgtatttccccttcccttctcgtgacaacactgttgatacgggacgagttgtaccatgtcgttcaacactactatgtgccgccgcatattatcccagctcaactgagctgtatactcagcttgatgattccaccattcactgctgttgttcatgcgtgcagcggaccgcaccatgcggtacgcaagcgcatggcttctcatagcatgttatgtgctgtaatc

SEQ ID NO: 10214 - DNA, 908 bp, Escherichia coli
gattacagcacataacatgctatgagaagccatgcgcttgcgtaccgcatggtgcggtccgctgcacgcatgaacaacagcagtgaatggtggwatcatcaagctgagtatacagctcagttgagctgggataatatgcggcggcacatagtagtgttgaacgacatggtacaactcgtcccgtatcaacagtgttgtcacgagaagggaaggggaaatacggggtgttaactcatcttccaacgtatgatcctcaaggaaggaggctaaggagctccacttcagaacacttaggaaccgctccttaaagtccttgagcaaatagcctctgggagcgtgaggtttgtcgggctcagtttacgcctgttttacgaggccgaaacagagaatttcggccagcgaccgaaatggcaaatatggggctgagttatggagggataccattacgaaagatcctctttctgctgatttatagcactagattaggcgcgaagttgttgatatacttccctagtggaagttggtattttgaggcgcgattttgacgcgtgcatgctaagaatacgtggagaaatttctttatcacttttcaatttctcattaacttcgaagtgccgtaggctagaaattgacaggccgaaaattaaatgacagaatccgaagaacacaacgggagtatcaaacgctagtgatacgaatttagtggaggaacctgtagaaatgaaggtcgaaaaaagagctagtgatatgaacttactaaagaagtgaggatacaaatacactcacaggaaaatgggatgtgcactttcaactcgacacaaacaatattgatataacattgaaaaatttctttattctgatatgagtatcaaaaagttcgagattgctgagattcccccacaggctga

SEQ ID NO: 10215 - DNA, 886 bp, Escherichia coli
ggttccttgttgagacttattatgggacttcctatctcacatcatccccaggtcgcagtcgcatacctggttgatcgcatgaaattttccgtgacaaaatttcctttccgcggaatcttgacgcttgcccgcccgaaggacagaccctgcctcgataggagatcgatcgatggagggaagggccgttcgatcgagatgttcaagatgtttcacttcggtactgttaggagagggagatgatgtgccgggaaattcttggactggagtgtagtcgtaaggagccttgccgaccttagcaataaaacttgtaggaggcataatgttaagaggaagctcgatcttcttggtaagaagttcttgccaaatctgtgccgaaggttctcccggtaggacgctagatcattagcctcgttcttttgctcctgcctgcgacgtttggctgtacgccaggccctggccgcttcaatcagtgagactagatgtagtttgaagaattgttgttgttcagctgggatgcgaccagtcatacgtgtaatagtttcttcaccgacattggccagcagcatgatagaatatatctttccctcaatcagctgggtaacggttacccggtaaccatgagatctttgatcccctggtcaatgttctcaccatctagcagacgatctaatatattcttggtagtagtctccggctgatcagccataagaaaaaaatgatggaaacaaaccgtccctagagccaatgcatggatgaagtgtagtatacaaaagcacgaaggcttcacatcttagattctagcttgatgtactcagtcgtgacgtactcacttttgttcatagcgtcacacaggccagggggaccggatgattgtgcccagaggagt

SEQ ID NO: 10216 - DNA, 885 bp, Escherichia coli
ggttccttgttgagactattatgggacttcctatctcacatcatccccaggtcgcagtcgcatacctggttgatcgcatgaaattttccgtgacaaaatttcctttccgcggaatcttgacgcttgcccgcccgaaggacagaccctgcctcgataggagatcgatcgatggagggaagggccgttcgatcgagatgttcaagatgtttcacttcggtactgttaggagagggagatgatgtgccgggaaattcttggactggagtgtagtcgtaaggagccttgccgaccttagcaataaaacttgtaggaggcataatgttaagaggaagctcgatcttcttggtaagaagttcttgccaaatctgtgccgaaggttctcccggtaggacgctagatcattagcctcgttcttttgctcctgcctgcgacgtttggctgtacgccaggccctggccgcttcaatcagtgagactagatgtagtttgaagaattgttgttgttcagctgggatgcgaccagtcatacgtgtaatagtttcttcaccgacattggccagcagcatgatagaatatatctttccctcaatcagctgggtaacggttacccggtaaccatgagatctttgatcccctggtcaatgttctcaccatctagcagacgatctaatatattcttggtagtagtctccggctgatcagccataagaaaaaaatgatggaaacaaaccgtccctagagccaatgcatggatgaagtgtagtatacaaaagcacgaaggcttcacatcttagattctagcttgatgtactcagtcgtgacgtactcacttttgttcatagcgtcacacaggccagggggaccggatgattgtgcccagaggagt

SEQ ID NO: 10217 - DNA, 881 bp, Escherichia coli
ttaaaatcgttaagtttcgtcgtcgtaaacactatcgtaagcagcagggccatcgtcagtggttcactgatgtgaaaattactggcatcagcgcctaagacctgaggagagatttcaaatggcacataaaaaggctggcggctccacacgtaacggtcgcgattcagaagctaaacgcttgggcgttaagcgtttcggtggcgaatccgttctggcgggtagcatcatcgttcgtcaacgtggtaccaaattccacgctggcgctaacgtaggttgcggtcgtgaccacactctgtttgctaaagcagacggtaaagtgaaattcgaagttaaaggcccgaaaaaccgtaaatttatcagcatcgaagctgaataagtttttcgcatcccggtaacggatgaaagccccgcaacacgttgcggggctttttacattcgataaccggtaaaaatgcgcatggtgcgatgttaatccgcaaatgcgctttgcagggaatacggtatgaagcagcaggcaggcattggcattcttttggcgctcaccacagcaatttgctggggggcgttgccaatcgcaatgaagcaggtgctggaggtgatggaacctccgacaatcgtgttttaccgtttcttgatggcgagtattggccttggtgccattcttgcggtgaagaagcggttgccgccattacgcgtgtttcgtaagccacgctggttgattttgttagcagtggcgaccgccgggctgtttgggaacttcatcctgttcagctcatccttgcaatacctgagtccgaccgcttcgcagtaattgggcaactctcgccagttggcatgatggttgccagcgtatttatcctgaaagagaaaatgcgcagtac

SEQ ID NO: 10218 - DNA, 881 bp, Escherichia coli; identical to SEQ ID NO: 10217

SEQ ID NO: 10219 - DNA, 871 bp, Escherichia coli
aaattgcaagaaaccccaaaatgagcctttccaagaaatctgcgcttagcgaaatcgatcagtcgatcgatcggccctcgtagaaggcaggtaccgagaccaacgtctgaggggacttggtaataagggtatacggtggctgtcatcctctacgctcatgttgttggtctacgcgttgtagtagctgcttttcaatgccgttggaatgtattctgatcattgtcatggcggtgtctgcttactgtgacgatgttgatgatgttgttgttcaggaaccatgcaaatattcgtgaagaccctaaccggcaagaccatcactcttgatgtcgaggccgccgacaccatcgaggctgtcaaagctaagatccaagacaaggagggtaatttcacgtacctcttttcatgacgtactataactactactattttaggaatccctccggatcagcagcgtttgatcttcgctggcaagcagctcgaggatggccgcactctctctgactacaacatccagaagggtgagaatctttcatgccgttgctcagggcatttcgcttcctttcagaatctactcttcatctcgttctccgtcttcgtgggtggtgttatcgagccctccctagccgtcttggctaggaagtacaactgcgacaagatgatttgccgtaaatgctacgctcgtctcccccctcgtgcggtgaactgccgtaagaagaagtgtggtcactccaatcagttgcgccccaagaagaagctgcgataagaccctcattgtcgctgccgacgtagtctagatgccgtaacagctgtcgttttgggcgttggttattaacatccggatgggcgctgggttccccttgcccgctgggtt

SEQ ID NO: 10220 - DNA, 870 bp, Escherichia coli
aaattgcaagaaaccccaaaatgagcctttccaagaaatctgcgcttagcgaaatcgatcagtcgatcgatcggccctcgtagaaggcaggtaccgagaccaacgtctgaggggacttggtaataagggtatacggtggctgtcatcctctacgctcatgttgttggtctacgcgttgtagtagctgcttttcaatgccgttggaatgtattctgatcattgtcatggcggtgtctgcttactgtgacgatgttgatgatgttgttgttcaggaaccatgcaaatattcgtgaagaccctaaccggcaagaccatcactcttgatgtcgaggccgccgacaccatcgaggctgtcaaagctaagatccaagacaaggagggtaatttcacgtacctcttttcatgacgtactataactactactattttaggaatccctccggatcagcagcgtttgatcttcgctggcaagcagctcgaggatggccgcactctctctgactacaacatccagaagggtgagaatctttcatgccgttgctcagggcatttcgcttcctttcagaatctactcttcatctcgttctccgtcttcgtggtggtgttatcgagccctccctagccgtcttggctaggaagtacaactgcgacaagatgatttgccgtaaatgctacgctcgtctcccccctcgtgcggtgaactgccgtaagaagaagtgtggtcactccaatcagttgcgccccaagaagaagctgcgataagaccctcattgtcgctgccgacgtagtctagatgccgtaacagctgtcgttttgggcgttggttattaacatccggatgggcgctgggttccccttgcccgctgggtt

SEQ ID NO: 10221 - DNA, 856 bp, Escherichia coli
gagaacaatgctagtctttcaaagacgagtcgcagctgaggttctcgtatcagctagtcccgacgagcattctactgctagtcccwtagrgacgagtcgcagctgaggttctcayggagacgagacacacgccactgttagtccattagggatgagtggcagmtcatccggagtcgcaagcataaaaaaccccgagaaattctacaacaaatccttatgacaactctccaaggcctaaccgagcaacacttyctacagcgggctgctagtctctgagacgagtcgcagctgaggttcttatggggacgagaaacaatgccagtctttcagagacgagtcgcagctgaggttctcatagggatgaaaaatactgctggtttatgagggacgagtcacagctgaggttctcataggracgagaaatactctgtctcttaggaacgagtcgcagctgaggctctcgtatcagctagtcccgacgagcattctactgctagtcccatagagacgagtcgcagctaaggttctcatggagacgagacacacgccactgttagtcccttaaagacgagtcgcagctgaggttctcgtatcagctcgtcccgacgagcattctactgctagtcccttagggacgagtcgcagctgctattgaccggttattgactactaaccgaacgccactttttacagtgagctaacttgtcttatagggacgaggaacgcgccactgttagtccattagagacgagtcgcagctgaggttcttatagggacgaaaaatactgttagtcccttaggaacgagtcgcagctgaggttctcatggagacgagacacacgccactgttagtcca

SEQ ID NO: 10222 - DNA, 856 bp, Escherichia coli; identical to SEQ ID NO: 10221

SEQ ID NO: 10223 - DNA, 830 bp, Escherichia coli
tggcagtagaggtatttgtaggtatcgatattcgtatcaagaaccagtaccagtggaaaagttggtgactagtatatgcgatgtgaaacaacagtaagtccagtgttggaatatatgctcgctttccagctcaggagtttcctcactaattgtgggagattatatacgaactcgtgaagaagtgtttcggaaaccaacacgaatttcccagaatttcctcacttagttgcccatgtgcatattttcccacactgccaatcacaggtgttgaaatcgtcactttcttgcatcacaggtacacgcaattcggcggtctgcgtcccttcggcgtatccttcctctttgctggctatgacgaccattacggtttccaattgtaagtgttgttgttgctccctacgacttgaaggctcgttcagataccacactgacccctcgggcaatttgagtgggtggaaggccacggctatcggtgtgaataaccagacggcacagggcatcctcaaaactgactggcatgaggatatgtctactaaggtgagtttcgcattcgacgttttatcatctcagtgttggttggtgtaggagtgtttggacttggtagcaaaggtgttggtgaagtccatggacaccgccacgccgaccgctgagactcgtgagtggaccggtgctcatgtgagatgcgatcgatgcactttcagtcgagttcggcgttttgaccttgaataaggataaggaggttgccttccgaatgttgtctgatgatgaaatcaatactcttatggcggcggctaagcctgagaagccggctggtaagttctgtggtcact

SEQ ID NO: 10224 - DNA, 830 bp, Escherichia coli
tggcagtagaggtatttgtaggtatcgatattcgtatcaagaaccagtaccagtggaaaagttggtgactagtatatgcgatgtgaaacaacagtaagtccagtgttggaatatatgctcgctttccagctcaggagtttcctcactaattgtgggagattatatacgaactcstgaagaagtgtttcggaaaccaacacgaatttcccagaatttcctcacttagttgcccatgtgcatattttcccacactgccaatcacaggtgttgaaatcgtcactttcttgcatcacaggtacacgcaattcggcggtctgcgtcccttcggcgtatccttcctctttgctggctatgacgaccattacggtttccaattgtaagtgttgttgttgctccctacgacttgaaggctcgttcagataccacactgacccctcgggcaatttgagtgggtggaaggccacggctatcggtgtgaataaccagacggcacagggcatcctcaaaactgactggcatgaggatatgtctactaaggtgagtttcgcattcgacgttttatcatctcagtgttggttggtgtaggagtgtttggacttggtagcaaaggtgttggtgaagtccatggacaccgccacgccgaccgctgagactcgtgagtggaccggtgctcatgtgagatgcgatcgatgcactttcagtcgagttcggcgttttgaccttgaataaggataaggaggttgccttccgaatgttgtctgatgatgaaatcaatactcttatggcggcggctaagcctgagaagccggctggtaagttctgtggtcact

SEQ ID NO: 10225 - DNA, 826 bp, Escherichia coli
gttctcctgagacttcggcagagaaagcaaaaataaatgcttgactctgtagcgggaaagygtatyatgcacacccccgcgccgctgagaaaaagcgaagcggcactgctctttaacaatttatcagacaatctgtgtgggcactcgaagatacggattcttracgtcgcaagacgaaaaatgaataccaagtctcargagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgccygatggagggggataactactggaaacggtagctaataccgcataacgtcgcaagaccaaagagggggaccttagggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtacttttcagcggggaggaagggagtaaagttaatacctttgctcattgacgttacccgcagaagaagcaccggctaactccgtgccagcagccgcggtaatacggagggtgcaagcgttaatcggaattactgggcgtaaag

SEQ ID NO: 10226 - DNA, 826 bp, Escherichia coli
gttctcctgagacttcggcagagaaagcaaaaataaatgcttgactctgtagcgggaaagcgtatyatgcacacccccgcgccgctgagaaaaagcgaagcggcactgctctttaacaatttatcagacaatctgtgtgggcactcgaagatacggattcttracgtcgcaagacgaaaaatgaataccaagtctcargagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgccygatggagggggataactactggaaacggtagctaataccgcataacgtcgcaagaccaaagagggggaccttagggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtacttttcagcggggaggaagggagtaaagttaatacctttgctcattgacgttacccgcagaagaagcaccggctaactccgtgccagcagccgcggtaatacggagggtgcaagcgttaatcggaattactgggcgtaaag

SEQ ID NO: 10227 - DNA, 780 bp, Escherichia coli
acattcagaactgcttccataacagtcacgaagccgccggtctcctgggtcggagggagattgatgttggacgaaatatcggagttgttgtcgatagtcattcgattgacgagaaccgaaaacagtcactaagaaccgaaaacagtcactggaaccgaaaacagtcactaaaaatgtattcgagggaatgtattcgtaactccatgctcagagaagtcatggtctcacagataaaataccccgtaacattcgcggacttttcgatggctgaggtgacaagctcgatgttgaacggaatcagggcatcatttcctgccttgtttgcctctcgtgcgggcaaatccgatagtacaaagaccatgaactatgcagtaattagtagatactgtctacggcatctcaggcgatatgtacgaaaaatgttatgctgcatatatgtcaatgcaatgcgcgtcaatcttccccatgtgcacagtcccgcaggtggatgagcgagtgagtcgtatgtgacgctcctgtaccaggcttccgactcgctcgtccctgttgtcgggaaagtcccgctatgtaacacgctatgtcataatgtcttagcacagtgtcctggcttcaagtacagactgttcttctccgcattttgtactttccattttcagcctgaacgatgttgctggaccctgtgacttgtcttcggcacctccaatgtgtgccatggcacttttctctcgattggacgatatgcccccgcaatattccacttttgatgaatacgaccccttc

SEQ ID NO: 10228 - DNA, 780 bp, Escherichia coli; identical to SEQ ID NO: 10227

SEQ ID NO: 10229 - DNA, 572 bp, Escherichia coli
ggagaggcaagcagactaaggagggctgaggtcaaaccagctccatctcatgtgcaagaccacccagcagaatagaccaagcagaggaaagaatcccagagcttgaaaactggctttctgaaataaaacaggcagacaagaatgggggaaaaaagaaggaaaatgaatgaacaaaacatccaagaaatatgagattatataaacgaccaaatctatgactgattagtgtacgtgaaagagatgaggagaatggaaccaacttggaaaacatacttcagaatatcattcatgagaatatccccaacctatccagacaggccaacattccaattcaggaaatccagagaacctcagtaagataagccgcgagaagatcatccccaagacatataatcatcagattctccaaggtcaaaatgaaagaaataatgttaaaggcagctagggagaaaggcaacgtcacctgcaaagggaattccatcagacttagcagacttctcagctgaaaccctacaagccagaaaagatattcaacttcttaaagaaaagaaatttcacgtagtatggcagag

SEQ ID NO: 10230 - DNA, 572 bp, Escherichia coli
ctctgccatactacgtgaaatttcttttctttaagaagttgaatatcttttctggcttgtagggtttcagctgagaagtctgctaagtctgatggaattccctttgcaggtgacgttgcctttctccctagctgcctttaacattatttctttcattttgaccttggagaatctgatgattatatgtcttggggatgatcttctcgcggcttatcttactgaggttctctggatttcctgaattggaatgttggcctgtctggataggttggggatattctcatgaatgatattctgaagtatgttttccaagttggttccattctcctcatctctttcacgtacactaatcagtcatagatttggtcgtttatataatctcatatttcttggatgttttgttcattcattttccttcttttttcccccattcttgtctgcctgttttatttcagaaagccagttttcaagctctgggattctttcctctgcttggtctattctgctgggtggtcttgcacatgagatggagctggtttgacctcagccctccttagtctgcttgcctctcc

SEQ ID NO: 10231 - DNA, 510 bp, Escherichia coli
ttatctcaaagcttgggtcctccacaagtatcgctaaagggtaactcccactgcccagactgcccagaggcttgtaaatcagtccgaggctcttcaagaggaagcttttgccacatgccgagccgcccatgatcgcaatattacaattacgagttcggccttgtcgaatcatattgatgatggccctcgcgaacacggactcctttatgccattgttgatgagaatttgagaaatggcaagactagttgtgttagcgcacttgcaagatgcgttctgagccgcatcttcgagaatggacattctgctcagggatgatctcttggtggccctccgctgcatcctcaaaactcccagactttttgtagcatcgtactggcactctctctgctattcattagaaaattcktcacattcacttcacgagaagcagcctggagtagttcgtgctcagtccttattctcttactcgtaatccatccggctatatcagagaggtatctaattctcga

SEQ ID NO: 10232 - DNA, 508 bp, Escherichia coli
ttatctcaaagcttgggtcctccacaagtatcgctaaagggtaactcccactgcccagactgcccagaggcttgtaaatcagtccgaggctcttcaagaggaagcttttgccacatgccgagccgcccatgatcgcaatattacaattacgagttcggccttgtcgaatcatattgatgatggccctcgcgaacacggactcctttatgccattgttgatgagaatttgagaaatggcaagactagttgtgttagcgcacttgcaagatgcgttctgagccgcatcttcgagaatggacattctgctcagggatgatctcttggtggcctccgctgcatcctcaaaactccagactttttgtagcatcgtactggcactctctctgctattcattagaaaattcktcacattcacttcacgagaagcagcctggagtagttcgtgctcagtccttattctcttactcgtaatccatccggctatatcagagaggtatctaattctcga

SEQ ID NO: 10233 - DNA, 499 bp, Escherichia coli
cgaccaccgccaacattactcaagcgattgaacaaatgcgtggaggtgaaagcgtgaacgatcaaggtgctgaagaccaacgtcaggctttgaaaaaatataccatcgaccttaccgaacgagccgaacagggtaaactcgatccggtgattggtcgtgatgaagaaattcgccgtaccattcaggtgctgcaacgtcgtactaaaaataacccggtactgattggtgaaccaggcgtcggtaagactgccatcgttgaaggtctggcgcagcgtattatcaacggcgaagtgcccgaagggttgaaaggccgccgcgtactggcgctggcatgggtggagcgcaatattaaagtaccaatgaccgaaccacaaaaagcgggtatcgcgtcattctgtccctataacattggccccggtaagtgttttccgtcgacgttttataagcggctgaatgccggtgatcgtaagggcgcatgcgaggcgattcgctggtggat

SEQ ID NO: 10234 - DNA, 499 bp, Escherichia coli
atccaccagcgaatcgcctcgcatgcgcccttacgatcaccggcattcagccgcttataaaacgtcgacggaaaacacttaccggggccaatgttatagggacagaatgacgcgatacccgctttttgtggttcggtcattggtactttaatattgcgctccacccatgccagcgccagtacgcggcggcctttcaacccttcgggcacttcgccgttgataatacgctgcgccagaccttcaacgatggcagtcttaccgacgcctggttcaccaatcagtaccgggttatttttagtacgacgttgcagcacctgaatggtacggcgaatttcttcatcacgaccaatcaccggatcgagtttaccctgttcggctcgttcggtaaggtcgatggtatattttttcaaagcctgacgttggtcttcagcaccttgatcgttcacgctttcacctccacgcatttgttcaatcgcttgagtaatgttggcggtggtcg

SEQ ID NO: 10235 - DNA, 423 bp, Escherichia coli
ggtgtctgaaagacctccttggacttcgaccatattccgttgtaattcggccgtctctcaactaactaactacctacccaacacattctatatgctcatagaaacgagtactactgaatgggctttagggctctgataacaaccccaagagcagactactcacgctcgcattccatacgaaggttatgaaatatgtcgataattgaagcgtggtaatacttaaaagaaatacagtaattgttcaagtggcatggatgagactataacagttacggacgaaaatgataacagttcaagcactcgaacagcatcaagtccctacacagctccgaatctagtcaacaacttaatccaatacgagccagagaacccgaaaccaaacatcagtggttgaatcatgatgtaaaaaactaggattaccgt

SEQ ID NO: 10236 - DNA, 423 bp, Escherichia coli; identical to SEQ ID NO: 10235

SEQ ID NO: 10237 - DNA, 366 bp, Escherichia coli
aaacttcaacgtcgttctgtttcctcatgaacaggtgctgctttcatgctcccatgtgttccacaaagtaagtccacccctcacgcctgcccaggtgctgcacatgtcgctctcacagtgcagagaaaccatagtcattttcaaggctcctaaggagagccatttattttattcatcaccaccatctatagttaaagaaacatgactgtaggctgcagtacaattcatcctattttgaaaatcatgagttttgtgacaaaagaaccacaaatgtttatgtaacagattgttgtcagtaatgcatgtcaaagtgacagctaaattcacatgatcgatctgcatgtggccccatacacacgcgtgact

SEQ ID NO: 10238 - DNA, 366 bp, Escherichia coli; identical to SEQ ID NO: 10237

SEQ ID NO: 10239 - DNA, 343 bp, Escherichia coli
acgctagctagggttacacaaatgcaactactcaaaagcaatttctcaacactcctcggctacctccctggtataagccaccttcatctgtcacctgaataactactatagcctcccaatgtctcccagcttcaaccttcacctttgccctactgtctcttctccccacagctgccagagtggccctttcaaaatggggtcagatcaagtgactcgtctgctcagcacccaccaggggcatctcatctcacaccgagtaccagtcacagttcttccaagctcctattagctctcagacctcacctccactaactctcctactggctcacagtgctgcaactat

SEQ ID NO: 10240 - DNA, 343 bp, Escherichia coli; identical to SEQ ID NO: 10239

SEQ ID NO: 10241 - DNA, 268 bp, Escherichia coli
ccccacagcagctgtttaacgccctgcgcttccataaaatcacgcttcgctttgccaatcgggagtcggtcaccatccctcagtaaacggccttccaacccgccaatccccactttgagatcggtgctgcatgatcccattaccggcggaacatcaataccacccgcgaccgccagataactgcgcatcccgtgctgcgggcgtttaagcgttaaacgctggcctgctctcattggcaatcgccagcgtacccaccggaatgccgcgc

SEQ ID NO: 10242 - DNA, 268 bp, Escherichia coli
gcgcggcattccggtgggtacgctggcgattgccaatgagagcaggccagcgtttaacgcttaaacgcccgcagcacgggatgcgcagttatctggcggtcgcgggtggtattgatgttccgccggtaatgggatcatgcagcaccgatctcaaagtggggattggcgggttggaaggccgtttactgagggatggtgaccgactcccgattggcaaagcgaagcgtgattttatggaagcgcagggcgttaaacagctgctgtgggg

SEQ ID NO: 10243 - DNA, 236 bp, Escherichia coli
tataaagcaatgaattcaacggggtgaaaaaacaggtgaaaaaagaggtgagatctcaccacttcacctaaatttatttttgtgctatgttttcatacgtgtgagggtggtgatatcattaatttttaagtttattttttttaaaattatttttaagtttatttttatataaatgacgaaaactattgagataacaaactacaacggtcatgagttcaagaatttgttcttcgttc

SEQ ID NO: 10244 - DNA, 234 bp, Escherichia coli
tgtgggactgtgagccaggtgtgattatgtttcattttctagatttgattaaactgatacatatatctgcaacttgttgaggatcacaaaagtaagaagtatcaggactaaattagaaccagaactatttagtcctagaatctaagttattacctgatgtattcatctgttttcacactgatataaagaaatacctaaaacggggtaatttataaagaaaaacagtttaattga

SEQ ID NO: 10245 - DNA, 234 bp, Escherichia coli
tcaattaaactgtttttctttataaattaccccgttttaggtatttctttatatcagtgtgaaaacagatgaatacatcaggtaataacttagattctaggactaaatagttctggttctaatttagtcctgatacttcttacttttgtgatcctcaacaagttgcagatatatgtatcagtttaatcaaatctagaaaatgaaacataatcacacctggctcacagtcccaca

SEQ ID NO: 10246 - DNA, 223 bp, Escherichia coli
gcggctatatgcctattgacggaatgccagccatgatcctcggaatggggaaatacaaacttcccgaattctgggtgttctctgtaccaatgtatctcatccgcattctggcgctttgtgcaggcgctgtttttatcttcccaatgtaatctcagacaaaaaaagcggcagagaagatccctgccgctttttattgtctgatgcgacattgggaagataaaaa

SEQ ID NO: 10247 - DNA, 223 bp, Escherichia coli; identical to SEQ ID NO: 10246

SEQ ID NO: 10248 - DNA, 208 bp, Escherichia coli
atgtaacggtgatagctactatgcagcttacttgtggctactactcctattcatgctctatcccggatgcaccactgccattccacattacatgttttttctgggtttactcagtcagatttgatgatgttcacaggctctaattcacgatcagtagttctggctatatggacacttagtgttctatgggaaatagttccatttctat

SEQ ID NO: 10249 - DNA, 208 bp, Escherichia coli; identical to SEQ ID NO: 10248

SEQ ID NO: 10250 - DNA, 205 bp, Escherichia coli
agaggtgaagaaagtgggaccaggcagagagaaagaactgcccaatacaactggttggaggcttcagataattttatagttggcatgacctttagaattgttccagctgaggcaatatcctcggtatgtagaaccacacactgacctgtcaatagacgcaggctgcccccaagatggggcataactttgggaaagtcaatatggg

SEQ ID NO: 10251 - DNA, 205 bp, Escherichia coli
cccatattgactttcccaaagttatgccccatcttgggggcagcctgcgtctattgacaggtcagtgtgtggttctacataccgaggatattgcctcagctggaacaattctaaaggtcatgccaactataaaattatctgaagcctccaaccagttgtattgggcagttctttctctctgcctggtcccactttcttcacctct

SEQ ID NO: 10252 - DNA, 185 bp, Escherichia coli
cgcagcgtgctcgtcgcctcgcccggcggcgcggccaccgagctgcgcacggcggtggacgcgaccgcccgcaaccccgaggggaccagcgcgtcgccggtgcggtgcgcgtccaccgggcggctggaggggcgcatcgccgagcgggtgaagctgcgcctgctgggcggctgaggcggccgtgg

SEQ ID NO: 10253 - DNA, 185 bp, Escherichia coli; identical to SEQ ID NO: 10252

SEQ ID NO: 10254 - DNA, 180 bp, Escherichia coli
atcaaggattacgcacgcacaaggccccgacatacccggtgtcgtggctcaactcgtggcgtaccgacacccgggtcagtcccttgggacactgcgatgaaggcttaacaacatctttgacgtacctggcaccattctcatggcaccccaccgtcgggacacgcccatcgtcaactctcg

SEQ ID NO: 10255 - DNA, 180 bp, Escherichia coli
cgagagttgacgatgggcgtgtcccgacggtggggtgccatgagaatggtgccaggtacgtcaaagatgttgttaagccttcatcgcagtgtcccaagggactgacccgggtgtcggtacgccacgagttgagccacgacaccgggtatgtcggggccttgtgcgtgcgtaatccttgat

SEQ ID NO: 10256 - DNA, 179 bp, Escherichia coli
ctttcagggagccatcctgctcactcagcagcttgttgatctcattctgcttgtattcaggtgagaggcggtggccgaagcccgagcccttgcgggaaggtggattggagcggcgctgggctcggcgggcacaggcccggatgatgaggtacaccacctcggccacattgaggatgatg

SEQ ID NO: 10257 - DNA, 179 bp, Escherichia coli; identical to SEQ ID NO: 10256

SEQ ID NO: 10258 - DNA, 172 bp, Escherichia coli
gccccgctggctggaagcgaccctttgtcgaaacaggcagcgctataccaccagtcatcgatggctcggtgttggctggccgcggcgtggacgatgctgacccgccggctcatccccatcgccgacgcgtgtttgtcgagttccctgagcgtgacgagagtatcggcgaagt

SEQ ID NO: 10259 - DNA, 172 bp, Escherichia coli; identical to SEQ ID NO: 10258

SEQ ID NO: 10260 - DNA, 144 bp, Escherichia coli
ccaacgctggtcgctattcgggagatggagttcgagccagaacctgttctcgacgatcacgcgctggcagcagaagatgtgtcaatcatgtcaccggagcctgccgaaacaacagccaagccggcagaggagaccagttttcgg

SEQ ID NO: 10261 - DNA, 144 bp, Escherichia coli
ccgaaaactggtctcctctgccggcttggctgttgtttcggcaggctccggtgacatgattgacacatcttctgctgccagcgcgtgatcgtcgagaacaggttctggctcgaactccatctcccgaatagcgaccagcgttgg

SEQ ID NO: 10262 - DNA, 136 bp, Escherichia coli
cactggtatgatcacagcttattgcagcctcagcctctctcccagtttcaagcgatccccctgcctcagcttcccgagtagctaggactacaggcaaggctaatgcccagcctaatgtttgtactttttagtagag

SEQ ID NO: 10263 - DNA, 136 bp, Escherichia coli
ctctactaaaaagtacaaacattaggctgggcattagccttgcctgtagtcctagctactcgggaagctgaggcagggggatcgcttgaaactgggagagaggctgaggctgcaataagctgtgatcataccagtg

SEQ ID NO: 10264 - DNA, 132 bp, Escherichia coli
gtttttaacagaaacacctgaacttgaaaaatgatttcatccaactttcatttttcacccattttgtaaatacaaaaactgagacccatgggtgatgatcgtggtacaagttgtttcttgcttgattctggc

SEQ ID NO: 10265 - DNA, 132 bp, Escherichia coli
gccagaatcaagcaagaaacaacttgtaccacgatcatcacccatgggtctcagtttttgtatttacaaaatgggtgaaaaatgaaagttggatgaaatcatttttcaagttcaggtgtttctgttaaaaac

SEQ ID NO: 10266 - DNA, 129 bp, Escherichia coli
cctgtctcatcatctgtccctgcccagtgcctgcctcatgcctggaggaccccacttgcccccgaaatctcctagcctcagcctcagcagcccctccccactgcagtcctgaaaatatcagcagggccg

SEQ ID NO: 10267 - DNA, 129 bp, Escherichia coli; identical to SEQ ID NO: 10266

SEQ ID NO: 10268 - DNA, 122 bp, Escherichia coli
caaaagtttgccttacttaatttccacgagggtctaaacctgtgactttgaatcggcccttgagagtgacatttccattgcctgactctcacacacatgttgtgtagaaaggcagaaagaac

SEQ ID NO: 10269 - DNA, 122 bp, Escherichia coli
gttctttctgcctttctacacaacatgtgtgtgagagtcaggcaatggaaatgtcactctcaagggccgattcaaagtcacaggtttagaccctcgtggaaattaagtaaggcaaacttttg

SEQ ID NO: 10270 - DNA, 117 bp, Escherichia coli
aaaaagaaatagagttatattgttgctggaaattaaggaaggattctacctgtggactagaaatattaaggatgattttttttttagaaataggtttgaattgattttaaaaaaaaa

SEQ ID NO: 10271 - DNA, 117 bp, Escherichia coli
tttttttttaaaatcaattcaaacctatttctaaaaaaaaaatcatccttaatatttctagtccacaggtagaatccttccttaatttccagcaacaatataactctatttcttttt

SEQ ID NO: 10272 - DNA, 106 bp, Escherichia coli
ttcaacatcttgtggcctcagctcaccgggatcgtactcataaacttccagttcgccgcgcgcgtgtgcttcacgaatatcattcgctgtgatgagttttttcacc

SEQ ID NO: 10273 - DNA, 106 bp, Escherichia coli
ggtgaaaaaactcatcacagcgaatgatattcgtgaagcacacgcgcgcggcgaactggaagtttatgagtacgatcccggtgagctgaggccacaagatgttgaa

SEQ ID NO: 10274 - DNA, 5126733 bp, Escherichia coli (residues 1-1,708,911 of 5,126,733)
  misc_feature (1)...(5126733): n = A,T,C or G
ggagaaggtgtgtaggtcgcactttatgcgacctacacatcagtcaggaattacccttcacgttctaccactttaatttccaccatgccgatcccgagcttacgcggcgagtgcccgaggatattcccttcgttggttgagacaggttccggtggcacaattaccagtgtgtcggcatcggttgggttatcgaaatgcagtgtggtggtggtcacttcattgcccagcacaagggtttgttcttcattgcctacgcgtaccggaataggacggctggcgttattgccgtatgctttggcggtaatcaccaggtcaaatttcttcggcagcggatgcttgtactcgatttttacttcatcgcccagctgtgcgttggaccagcggccccacgactctggacgagaaatcccgctaaactgtttcacctcttctggcgcaccagcgacgttaaagatgaaactgtcggctttgtagcgaatatcgttatcaacaatctttagcgtatcgacattgcctttgtaacgcgccatgtcgatgaccgtatctttaaatgccgtttttcccttccatattgctttgtcaacatgctgaacaatttgctgaccgccaagctgcccttgcgagacacaccagtcggtggagagtgccagttccggagcccagagttgtgccatcttgtagcaacggtcaacccagacgaaattgtcgcgtggagcgaaatctgccagctggaaacgcagcggtgctgagtattcgctttccggcagcggttccacgcgtttgtctgaaacccgcaacagcagcggcaaacggaaatggctacctgagaaggcaatcatgtttttctgctggtcgatggtgaactctttcatctctttagggaatttccacaggcggatgatatccggcttccacgccaatgttttctctttgatattgaggaagatttccgacatcgactgcccggataaactgctacggccaagtccgagatagttatcgccaccgagaatgtccagcaccgtcgcgccgttatccatcgtattacgcttcactgccagcgtctcttgctgcggcttgtcgccacggatgacaaaaaacaggttattgcgatcctgcttattaaggtatttccacgccgtattgttcatcgctaaatggtcagaagagacgacgatgacggtatctttaaaccacggtgacgctttgattttgttgataaacgtcgcaatattctcctggctgcaacttaccgcgctgaatgactgattcggcttaccgtcaaaatcatattttttgcggttacaggtgcgcgagataaaaccatccgggtgatgggtatcgactgtcagggtaaacagtgagaatcgctgacctgagcgggaaagctcttcaaattttttccacgcttcatcgagaacggtatcgtcgtagaatccccagtcgttgcgatagtgcgggtcggccaccacgcttttcagctcttctgagccgtataagtggtcgaagccgtgcgatttcaggaacacatctttaccggcaaaacgcagattcgcgccctgcacgaaatagttctgataacccgagtttttcataatatcgcccagacagatgttctgcgggaagaagctggaaacagaagcggaggcgttgccttcaaatggggcaaacagcggtatgccgcactgagaagccaccatgcccgcaatcgtgtaatccgttcctggcagctgctgcgtgtggctgaaatccaggccttcatttttcaacgcgcccagttcaggcgtgagatccgggaaagcctcgttatcaaaataggtccgctcgagactttcgccgtagatataaaccaggttgagtttcgggtcagggatagttttcgacggctctttataataagccgcaaagtccgggtcgccgtcgcgtgactgggatttcaccagttccgttatctgacgaaatgccgggctggcatccactgaacccagcgccagtaagagtgccagcaggctgtaaccaaaatggtgcggatgatgacgacgacggcgcaggatccagcccagcgcaccgaacaccgccgccagccccagcacaatgccgataccaggcaggatgtatttgctgacaccagcaccggtcaggctgttggttaaggtatagagaaccgcgtcgttaataccatcgccagtaaaatagtcgctggcaaacagggtgatatttaaaacgacaaatagccccagtaccgttaatgtggctgcaaaccaccaggtgttacgtcccgctttccatgcgtaaatcagcacagaggcgagaaaaagggcgaaagagagtagttctgacaacgggcgatcctcactaaaccgggccgtttagccaacgtttaagctttttgagaagcacaatgtaatggcgtcgccatattgctgcaattctagtgtcaaaaaaatgcgatgttgttaggaattagtttataaacagacttttttgatcgcggtcgcttcccgtgtaacaggggtaaaaccgtccaggagcagggaaaagggcaggagagagccgcgtcagccgggtaacagctaaaacgcggcgtttcgcggttcaggaaatgaagttcagcccctgctttaacaccagatcgcaggctttggttttcaccttttctgccagcggagtcgttccaatattatccagattgagttgctgaccatctttggttttcagcaaaccctgaatgccatccagatagttggtgtcttctttttgctcttcactgttcaggcccagtttttccagtacctgattcttgatgttttcggcatcggttaccgaagccagcttttgcttcgcgcagtattgcagaatgcctgcggcgttgttcatgttatctgcgcttaaggcctggttcccgttgctaagcaagttagttaatgacgcgagcgaccaaccgccttcctgtgtcgtgttgttttggttgccaagttcgctggcggcgctggagagcgcatctttccaggacgcagcatgcaccccggtggaaattaatgcgctggcggcaatggcacagcacagaagatgtttaatagttttcatcatcattactcaaggttgaattgtgtcgcagtataccgccagaaacggggattaatactctttacctgttacacggctacggtagctatcccagttgaagatcacccacaaactgttacccaggcgcatacggtccatcacgcgttcgcccagcaacttggtcatctcttccatattactgttggtcagcatcccggttgggcgtttggaagaagagcggcgatcgacgatctggttgatgatcactttttcgtatttcgattcggtctgcacgccgatctcatcgatcaccagcagatcaacgttactcagatcgttaagcagttgttcttcgctggtaccgctattcctgaaggtatctttcatcgccgacataatatcggccacggtgatgatcaatacggatttaccgcgtagcagcagctcgttgcagattgccgccgccagatggtttttgccggttcctggcttgccagaaaagatgaagctggcgatgttgccgtcaaactcttcgacatactggcgcgctttgcttaacgcattcatttgcccttcacactcaacgcgatagttctcaaaggagcagttctgatgcagtggacgaataccggagcggttaaaggtgcgctgcattttcatcgcccgattttcacgttcgagagcggcggagcggatcgccccttgttctttctgccaggccagtaattcttcacccgttttgaaagcaggtttgatatgggcaggcatcattttttgcaggcgttgcatcaggtcgccaacgtttttcatcgttaccctctgaatcctggtggaatttggctgtcaggttcactgaccgtattcacatctcgtttcggcagtccgccgttgctggcacgaccgatttgcaggctgcgcgccagtttttgttgccactgcacatggtgaaagactttgccttccgcctgccagtaggcaatgaatgacgccagttcttcggcggtcaccgactctcttagtgccacgccccatagcgccgccaggcggataaagtcggcatcgggttgccagtctgggtacatggcaaatttccccatgggtacggcaacgggagcggtttgcggttcctgatagagttgatcgtccagagcgacatcgcttcccggacgcgccagcttttcttccagcgccagcagttcagccaggcgtgcaggagtgatggcataaaacgccggggcattgttagcaaatacggcaaccacaccgccttcagcttttgccagaacggtttggtgatcgtgtaccagggcgtcaataccaacgacgtccggggtcaaaactctggaagacatactgtttctcaaatatggaacgatgaacgagaagggagataacttttatagtaacacacggaggagaggaggctgtctctcatccgcgtgctttaagtgaggcaattttatacgcgagggcgcttgcggtacaaccataatccaggaatggaaagaccgatggataacgcaccaacaatcgatgaagctgtaagaaagttggttaacagggtaatcatcaacggttcgctgtaacctagctggctgatttttaccgccgaaatcattgcggtataagctgatatgccagggaacatagggataacagccgccacggtaaacactttcggatgcgccagataccagcgcgaccattgaataccaatggtgccgaccagcatagaggccataaaggttgaccattcaatattcagcccgctggtcattaagatcattcgggaaccatgacctatcgcaccaagcagcgcacaccagcgtaacgctcgaacgggaacgttgaacaccatcgcaaagccgaccgcaggaatggcggcgaggatcatatcctgcgccaacgctaacagaaattcgatcacacccatccgcgtagcccccaaatcgtcagtgccattactacgccgacacaggtagccagtgtcagcagactggcgattgcccagcgtgccagtccggtattgatgtggcctttaaacatatcggcgacggcatttatcaacggaaagcccggcaccagcagcagaacgctggcggccatcgcaatggtgggggtattgctgaaagtgggaagttgcaaaagcaatccggaaatggtggtggcggcgaaagcggtgaggcaaaagttgatctgtggatgaagatgacgttgtgccagcagctggcggatatacatcgcggccgtactggccaggaaggtgatgacggcaccatcccagccacctttattgagtttacagaaacaggcgcaggaaaggccaaccattaaggctaccagccatcttgggtaacgtaatggctgaatttggctaaatcgtttctctacgcctttgtaatccagcagatgatgctccgccagaattacaatgtgctggacttcagtcaccacatgcatattaatgccgcgatcgtgatttttacgtgtcgatgtcaggcattgcccatctttaatggttgtcagcactatggcgttcgaagagatagaactttcgacgctgtccattcccaacgcccgacccagtcgtgaggaaagctcatcaaccaacgcgctttccgcaccatgttgcaaaagaaataatccacactggatacaaagccgtgttacggctcgctgttgctcagtttgcataactcgccctttgtcatagacgtgctgcgtattgttcagataatgagaatccatttgtatcatgaagcacggttgttttgcggtaggttaagatcaaaattgcgctgattaatcctggttatcgggagatgctcggtgataaaaagcgaattatctctcgccgtaaacaaactatcgcatgaatattatcactataatgaatttgttatttggcctttacgagtcaggataatagatagctgggcgcgtttttttatgttaacaagttaaaaccatcagattttattgaataaatattgattgtgtgattcccgcactctgcgggaagaaatattatttaattataaattaaatgaatgagatttctgtttttcattaagtatttctaacaacttaatgtagatattttaaatgtctccaggctatttcaccaggttatcatttgatgctaaccttctgacacatgcagtggagttgttgtgcagcaggagtatgctgatatgaaagtgaatgctaaggataatttattcgcttaatctattaatttgctggaaatatttaaggaatgaatgccttgaataaaccatcatgatttttagacagtggatgtggaggaaatatgttgccaggatgctgcaaaaatggaattgttatcagtaaaatacctgttatgcaagcagggttaaaagaggtcatgaggactcacttccctgaatatgaaataatatccagcgcctctgcggaggaccttaccttattacaattacgtcgttccggattagtcattgctgatttggccggtgaaagtgaagatccacgttccgtttgtgagcattattactctttaatctcacaatatcgggaaattcactgggttttcatggtgtcacgctcctggtattcccaggcagtagaattgctcatgtgccctacggcgacgttattgtctgatgttgaacccattgagaatctggtcaagaccgtacgttccggcaatacgcactcagagcgtatcagcgccatgctgacctctccggcaatgactgaaactcatgattttagctatcgctccgtcattctcactctttcagagcgcaaggtactgcggctattaggtaaaggatggggcatcaaccagatagcttcattgcttaagaaaagtaataaaactattagcgcccaaaaaaacagtgcgatgcgtcgactggcaattcacagcaacgctgaaatgtatgcatggataaatagcgcgcagggtgcaagagaacttaacttgccttctgtttatggagatgccgcagaatggaacacagccgaattaagaagagaaatgtcgcactcatagaaaaatgcgtcatgagtcgtatcggtattgagagtttattcagaaagtttgcaggtaacccttataagctccatacctataccagtcaggagtcatttcaggatgccatgtcgcggatctcgtttgcagcggtcattttttctttttctgccatgagaagtgcgcgcagagagggattatcctgcctgactgaactggcgattaagtttccgcgtacccggcgtttagttattgcggatgatgatattgaagctcggctgattggttcattgtcgccatcaccgctggacggtgtattaagtaaagcgtcaacgctggagatttttcatcaggaactctttttgtcattaaatggtgtacgtcaggcgaccgatcgactgaacaatcagtggtacattaaccaaagccggacgttaagcccgacggagagagaaatattgcgctttatgtcgcgtggctactcaatgacacaaattgccgagcagcttaaacgcaatattaaaacgatccgtgcacataaatttaatgtgatgtcgaaactgggcgtcagttctgatgcagggttgttggaggccgcagatattctgttatgtatgcggcattgcgaaacaagtaatgtgttgcatccttattaatccgcatgatgccgggtttacttccccggcagtgctttcatttcagcgtacaatcgccacattgctgcacatccggtaagcgataacgctggcagcaagtgcggcgcaccagcaggccgtcgcgtagcaccacggtacgccagagtggattatcttcaccggtagtaagcgttttctcaaaaaagagggcatagcgcagcgattcaaccgtcgcctcgccgagcagctgtttcatctcagtcagataccagttgatcaaataaccggtattgctccagataagtttgccgttaatctctcccgttgcttctagtgcctgcagaaccggaaccagcgcctggctgattaacgtttccattcgctgctgcggcgaatgtagtgttgcgtttttatcttcacacacatcgacccagaaacaggcggcgcgtccggtttcgtgaaactcaacgtggacatgttccggcgacacatctaatgctttttcctgagtcagcagcgccagcattaatggtggtaccatcaggccgatataccattgcgcccacagtgagataagcggtttgttttcgcggatcatcaaaggttggttgcggtagatatgatcggaatagaccgcgagtagagaacttagcgcattcggtgatgaccattgcgccagcgtcatggcgttaagtggggcgggttcatccaggcggataaactccagcaaatgttcacgatgttcggcgatcgttgcccgcacggcttgtgcaagcccagcatcctgcggctggagatgcgttcgccagataacatcttcatagagcggtgcggaacgataggccataatcgtgatagtaatctaaatgataattattgctaatcctatcgataggtttacccgatagcaaggaatttctctggcttgcaaatgataaaaattatcatatgatattagttatcattatcaatgaaagagatgaaaccatgttgcaacgtacgctgggcagtggctggggagtgttgctgccgggattgctgattgcagggctgatgtatgcggatttatcgccggatcaatggcggattgtcattctgatgggattggtattgacgccggtgatgctgtatcacaaacagttacggcattacgttttgctaccatcgtgcctggcgcttattgctggcatcatgctgatgataatgaatttgaatcaggggtgataaaacagtgacgagacaagaaaagaagtaaagataattggtgcgaggggggggacttgaacccccacgtccgtaaggacactaacacctgaagctagcgcgtctaccaattccgccaccttcgcacagtcatcttactttttttgatatcgcctcgtttggtgcgaggggggggacttgaacccccacgtccgtaagaacactaacacctgaagctagcgcgtctaccaattccgccaccttcgcccagtgcgagcaatatcaacgtggtttttggtgcgaggggggggacttgaacccccacgtccgtaaggacactaacacctgaagctagcgcgtctaccaattccgccaccttcgcataccatcaattcttaaaaagaattgctaccacggaggcgcattctagtggttttcagcttttcgtcaatagttaattatcgacagaggtgtaattgctggaaaaatatccatcagcggattgtggataattcgtttgtcggtcagataaggcgtgtacgccgcatccgacacggtatgcggcgacatatatcagatactcaacctttcttcgcctggcgggtcataatggcgcgatacaccttgaagcgcccggtttgcgcgatcacttcatggaagccaaatgtctcatccagcacgtccgggtaaggcaggaaggcgttcgctacaattcgcaactcgccgccgctgttcagatgacgcaccgcgccgcgaatcagcgtttgcgcggcatccaggctggtttgcatcccatcgtggaacggcgggttggagattatcatatcaaagcgacctttcacctcggaaaagacgttgctggcaaagacttcaccttcaacaccgttggtcgcaagtgttgcgcggctggcttctaccgctggtgcagaaacatcacacagagtgaggcggatcttcggtgaatggcgcgcaaaagcaacggaaagcactcccgcgccgcagccgacatccagcactttacctttcgtgtgtggagttagcgtcgagagcagcaactgactgccgacatccagaccgtcgcggctaaacacgcccggcagtgttttgaccgtcaagccatcgacgctgtattcgccccagaatttattggcatcaaataccggctgcttttccagacgaccaaaatagaggccgcagcgacgggcgctgtctaccttattcaacggcgcataatcggccagcatctgctcggcgatgcgcacgccgctgcggttctcgccaacgacaaaaatatccgtgcccaccggaagcagagaaagtaaattcatcaactggaactgggcttccggtttgttcttcggccagtagtagatcagcgtatcgcaatctgcgacatcattcgccgtggcgaccaggctaaaacgggcgttatcccccatctggcggcttaacacctgccagtggtggaattgctgggtatgagcacggctggccgcggtatctaaacgcgcgggcaggtcatcctgtaagtctccggcaaacagaatacggctttgttcgaaatcatcactgtgacgcagcaagacttcacttgccggggtaaatgcagacatggaatgctcctcaattgatactggcggcgattatagccatatgttggcgcggtatcgacgaatttgctatatttgcgcccctgacaacaggagcgattcgctatgacatcccgacgagactggcagttacagcaactgggcattacccagtggtcgctgcgtcgccctggcgcgttgcagggggagattgccattgcgatcccgccacacgtccgtctggtgatggtggcaaacgatcttcccgccctgaccgatcctctggtgagcgatgttctgcgtgcgttaactgtcagccccgatcaagtgctgcaactgacgccagaaaaaatcgcgatgctgccgcaaggcagccgctgcaacagctggcggttgggtactgacgaaccgctatcactggaaggcgctcaggtggcatcaccggcgctcaccgaattacgggcaaacccaacggcacgcgccgcgttatggcaacaaatttgcacatatgaacacgatttcttccctcgaaacgactgatttaccagcggcttaccacattgaacaacgcgcccacgcctttccgtggagtgaaaaaacctttgccagcaaccagggcgagcgttatctcaactttcagttaacgcaaaacggcaaaatggcggcgtttgcgattacgcaagtggtgctggatgaagctacattgttcaatattgcggtcgatcctgactatcagcgtcagggattgggaagggcgctgctggaacatctgatcgacgaactggaaaaacgcggcgtggcgacgctatggctggaagtccgtgcctcaaatgctgccgccattgccctgtacgaaagtttaggctttaacgaggcgacgattcgccgcaattactaccccaccacggacggtcgcgaagacgccatcatcatggcgttaccaatcagtatgtaagacaaggtggaataatgaagtgggactggattttctttgatgccgatgaaacgctgtttacctttgactcattcaccggcctgcagcggatgtttcttgattacagcgtcacctttaccgctgaagattttcaggactatcaggccgttaacaagccactgtgggtggattatcaaaacggcgcgatcacttcattacagcttcagcacgggcggtttgagagctgggccgaacggctgaacgtcgaaccgggtaaactcaacgaggcctttattaatgcgatggcggaaatctgtacgccgttgccgggggcggtttccctgcttaacgccattcgtggcaacgccaaaatcggcatcatcaccaacggctttagcgccttgcaacaggtacgtctggaacgcacgggcctgcgtgattacttcgatttgctggtgatttccgaagaagttggcgttgccaaaccgaataagaaaattttcgattatgcgctggaacaagcgggcaatcctgaccgttcacgcgtgctgatggttggtgacactgccgagtccgatattctcggtggcatcaacgccgggcttgcgacctgctggctgaatgcgcacaatcgcgagcaaccagaaggcatcgcgcccacctggaccgtttcttcgttgcacgaactggagcagctcctgtgtaaacactgattgcctcccccccgttgatgggtaaaatagccgcaatttttcgttttcaacaagcgcggcgcgatgccgcttactcaagaagaaagaattatgacgttgtctccttatttgcaagaggtggcgaagcgccgcacttttgccattatttctcaccccaataattaagcccaaattaaagctcttttactctttcaaagtcctttcagttaattgagtactaatcatataactcatttaataacatgatgttatgtggtttctttaattgaaaattctttcatgtaactttaaatcgatcaggttgctttcatcaaaaatctgtacatgtgcttgtacataatgtacaaaacagcagaggtgtttttttatttgtacaaggtgagtaatggcgctgtctgatgcgtggttgcgttcagtcgttggaaaggaacgtgataaggttttggttaaatccgatcgtgatggtctgtctgtcagagtatcaccgaaaggtcgcgtagtgttccaatatcgttatcaatgggcagggaaaggtgagcgccttgatatcggaacttacccggcaactggattaaaagaggccagagaagaggttatccgtctccgtggtgaactcgagtcaaaccgcaatccacgattagtcaagcaggctgaaaaacgaaaagctactgaagccatgacggtagagtctgtgatccgtgcctggtatgaagcatattgtgtaaaaaataaaaaaggttctgaacagatactccgctcgtttgagctgcacctgttctctaaaatcgggaatatccctcacgatgcagctacattgcatgattggttagaagtcctggagcctcttagcactaagactccagcaatagcagaccgattgctaattaacgcaaagcaggcccatgtctgggcgtataagagaaagctcattgaaactcgcccgctgtcggatatcacgggtaaagatatggatatccgtaaaggtcagaagaaacggtttctgacacatgatgaaattaaaatcctttatgctgcgatcgatggttctcgaatggttcctaaataccgggccttcattaaactattgctgcattttggctgccgtagttcagagctaattaccgccagggtggacgattttgatttcattaataaagtatggactgtaccaccagaacgacataagactggggagataacaggcgaaccgctaaagcggcccattattgaaccggttgaagagcttataaagtacgctatttctatgaacaatggttccgatatgctttttactaaggaaggaagcagggaacccgttggtcggacatcattgcagtcgctgccttacaatttaatgcagtacgcatggcggcgtttggggtatcaattccctcattggtctcttcatgatttgaggcgaacagcacgaacaaacttttctgatcttactgcgcctcatattgcagaaataatgctaggtcataaactgccaggggtatggcaagtttatgacaagagcgattatctagaagaacagcgtaaagcctaccaggcatggtgggagagagttgaatcgattgttacttgttctggttcagacaccaactgacagtttgcatattttgaacgcaataaaatatgacagtccgctttgagcgaggagctgatatatgatgtttagaaaacgcgcgatttgcagttaagcaatctaagttactgatgtactatactggaactgctggccagtttgtgttgaacaccatcattatcacaataaggaaatgaaagtcgaaatgaatactaaacttttggcctatttaaacaatgagttacatggagtgtggatagatagtgaaaatcgtaatatccacataatacttaaatcaagccttcctataattaaatccgtctggtcaggagcacctatccactttttggtaggtttatctactaaaaatatactagtgattgggatgttgattgaagataatgtcgataatccatttttactagcctatccaccaagagaggcagatgaaattaaagggctggatttgttattgtcaggcgcttatgatggtattctattatcattttttgactcgcatacaatgcgtgttatggacctgaaaataaaagtttcggaaaatttaccgtgtgaatgtttaaaaaaattttgtgctaattcatattctctcaattcaggatttagggaaggtaatgaagcaatggatgaattctgcaacaatgctttgactggtaacgagaaaataattagtctgccactaagtgtaatcgataaaaaatcttacctagcaagtgttcatgaaccaaacgataccgtattaacatatgaatttagcgtcagtgaaaacggctctgagggatatgagcaggaagctcttatataccatgctttgcggcaggtcttttcaccggaggaagtgtttttttctccagatattattgagggtaataaaaaaagagaattagttgatattcttattgtagaaaatgactatgtattatctatacagtctaaagcatcatctttgattgaaatgggtttaaaatctcatgaaaagctttgtagcatgtataagaaaaaagcattgcaagggatcgatcaggttaaaggcgttatcccaattctaaataatgatgtggttattaattatgacgggagggaatgcttaataaagcgcagaaagggtatttatcatttagtgataatctcagatcttgttttagagaaagaaggtgctgaaaagatttataacgaaattagcaaccttaaagagtcaaaaggggcgaaagttttagttatgagccttgaaggtcttgtaaattttataagactatcaagattaaataaaagaatgttttgggcaatgctggagactaaatacaagttcagcataaaaaaccgtacaattttaattagagatatcgactctagccaagagaataatctaccattacttgccactgatcaatacctatcacttcttcgaggtgcgggaaaagtaaaataaattgtatcaatgatactgttgccacgtatcgagactggcttatgaacggaagggttttccagcagttcagcgaccggagctgcacatcgatgccggattgtgcctgcaattatgtacttggctaagaggtgctgctggctctggatagaataaccctaacgtccaaagagcgcgcattttcatgtaaaaaaataaatagcttgtctgctcttgatacagagcagacagtcagatctgtttggcttgtgccatagatgtgccagctcacatttgagctaatgtttgttactcaattactcctgcaaacctgtatatcttacgtgatgcccatttatttgggcaggatttaatatcaggatctggaaaatcaggccgatatttctgaccagtcctccggtttacactgttccagcgaagcaccgtcgatattgaaacgccacagaattcggcgacttgttttgttgtcattaagttgttcattgttgaccctcctgtggttgtgcagttgaaagactcatgcccgcgcgttgttgccagacgacccagccgagagccatatcccacgccatgtactcgttatcaccgttttttgctctccgacgatcgactgttttaccgaaacgcttttccataaataattcataggctgcgcgttcatctggctcaacttccagagatgccagtgcaatccgtgccagttctaaatcatcttcaagctcagcgcgaatctcagcgaatgcactctgtgttaaggcgaactcaatgctctgcactttattccgtgcgcgctcaagcagtgcatggtagttaatttcggttgtcatacccctacctcttcgaatttcaattctaattgatcaccccagatttcacatgactctgaacacgagccggtatcgaatcgcctggcctgtaccatcgcctgatacaaatttctgtagtcgctgttggcagacattctggcaattccgtcaagcgtcaggtgaccacggtacataacgtctttacctgttctgcgatgaccatccctgacgtgtttgcctgtaaccagctcattaaaaactcgcatcagaccaggttcgtctttacatgcaagccccagcttttgcgttgactttttgatgcagaaaacacagttcccgagatgctccgggatttgcaaatcaaaaggttgttttcgccaccaccggataacatccgacttatcaaaatctgacagttcggcaagataccggacgcccgatttcggtttcagcctacggggttcgtctgcacgaatacccagccatgtgatgtaattacctcgcccgaaatggttatcgcagtatttcgtgaaagggatgagttttagcctgtcagtacagaacgcgccgccgatgtatggcgtgccgtactttttaaccatgtccataaacggtttaagtaccggcattcgcgtctgaatatcctttggctcccattctgtataaccatttggctgcccaagctcaggattgatatcgacctgcaacacagttagtggtatgccccagaacttcacaacctcccgaataaagcggtatgtcagcggatgttcgcaaccggtatccataaagatgtagcagacgttattgccagcctttctttgttcttccatcaggtgaacaagatatgcagatgttctcccgccggaaaaactaactacatgagttatgcacatttgcgtaactccgataactcgttaaaacgttccataaacatcccgtaggcatgtcctggtgccagtggaatcactttgaacatctctgttgccgggataccttccagtacaggccagaaagagccatcatcaagcccgagatcgcggcgttcggttgccagcataatgagatcggcatatttcactggcgtgctcataacaggaggtaacccgtatttctcacggattacggcgtctattttttcttccatctgtttatagtcaggaagaaggcgtttcagtggcgcggggatgtcctgacaatacgcttctgttgcatcatgcattaacgcttcaaaagcaaactcctccggaaccagtttgctgcaaagcaccgcatgttgggcgacgctgtagaagtgtgaaagatgaccggcaaagcgacagatatttgaaagggaaactgcgatatcgttaatcgcgatgtcgtctttatttatcctgtcataataaaaatgcttcccggaaaaagttttaataaatgacattttgttctccactttatatgcgctgcaccgcgctgaattttggttaaagaaaaccctcgccatcaggcgattattgagttaattacgtttccataaatgcccccgcaggggcatttgcagtaatgaaatcaggcggtgaaagtaccaataaaggtttctactttgctgtctttgaatttttcaacaagcagatcacgaaattcgttagccatttcttcctgcactgctccagctgaataatgcgcagaaccagtacaggacgatcgccagtgataatgctgaggcgtaatttaaacggacgttctttcaggccttcaaacggaacgcatttaaattcaaatgccactggcataatatctttggttttcgcttcgacagactccatcagggagcgtttgccgctgaagtcattgtcttcaaaatcagcggtctggtttgcttcaatcgtgattttacggacagccgcagccgcttttgttgcctgaatggcgtcaccattagcatcaaagcccacaaggtagtcggcccagtcttcaatccattctgccagtgacttctgggagttacgctcgccgttaacagacaacagagcagagaacggtgctgtctttttcagtttgagagtggcggtgttatctgcgtgacctggttcatcaatagtacccaggttaagcacactgacggcacgcatattatcggcatcgataaagcagcgggtgccttcatctgcaagatctttagaataacgggtaaagtcatcgatgctggcagtggaaagcgcaccacggaaacggaagcgatttaaattaaatttttccagatcatgaatgcggaaattctcaggcaatgccacagcatcggcaccaatcttactgataatttcattaacaccctgagcagaaataagggcatggatttgattaattgcggttgcgtctaagttctgagacataataagtcctcactatataaagatattcagtgatgagataaataatcagtttattaaaaacgatattaacgacctgctgcgcggagttttccgtcaggttcaccggcaagagtcagtaattgtccctggtcttcctgcagaatagtcaggcgaccaccgcgattgacatacatcggcgtttcggtggtgtcttcttcggaaattttcccgcggttagtcgggcgaacatatgagagtttgtgtttgatttttacacggttctcatcaaacggttcgatttccaggttgagcgagaccttacctttggttttcgtgttcatcacaccggaagcgacttcactgagaacagcgccgattttggtttcaaatacgccgccgtccagctccccgataaatgcctgcacatcagtactgcgttcgctagccattttgctgctcctcatcatatcgaccctgcaaggtcggttggtttctccacaaaacagagaagaacacctgcggtggcagccgcccggatggattgggttatgagcccgtcgtccggtgatgcccttctctgttttgtaaaaagagcggtaccagccggaagcaagtgtacaaactggtaccgccaaagcagtggctgttgtggtgaccggtgctgatctccggcttgcggttatttcagactctcacgggcgtttaattgccccgccgaacagctcttttccgcaatagctgcatgtctttcgcgcatcagcctgcgcattcaccacaacgctgagagcattgccggtgtccgaatcgaacggaccttttccctgcccaaccctcccatctgaatgggactgtctggaattgaaccagcacttatgccttgctcgtcaatgctctcatcgttgcgtcctggtctcttcccaggcgtcaaaccggatcgccacgctggttaggcgtcttatcagcatcctcattgacttgcacattccggctacctggtttgtttgcccgagcaaggagtggattatcccctttaacgtccccagaccgctaacgacgcatgtgccatacgccgtgttacaaccaaattttgtttgaatcttgcctgtctcatgtttcttttggatacattatgtatctcatagtacatgtcagtataaaaaactgcgagcagatcataaayattgatargcgttkatktgtatctyytgrttttcccgagaaaatcacwgtaccaattatagagcaattaccgttratcttaatgtaaggctcaggccagtttgggtttaatgctttgagataacgctgtgtyccatcttctatcaacckcttgaaggtggtttcrcstgtatcgtgcatcaatgcaataacgtcgtcaccgtggcaggcaggkacttcaggatcracaaaaatcatgtctcccgggcggtactcatcaatcattgaatcaccwatcacccgcaagatataagtcatttcsccacagggtacagggcagggatamgtttctgctgtgctcaaatcaacctcagaatakccaacttctttccatgctccggcctgtacccatgatatgacagggactaaygtkatttgtttrttagtgattgaaacatcaggtttttttgtgatgttcgtkgtctggtgttcttgatcragccatccgacaggcaggtcgaaacatttttcgatgtgycktgccatgctgtcaccgatatttttagtagcaccatctcccataaacctgctggtctgggttggctcgcgatcaatcatrgtggcaaaggaagaattcccgccaacaccatctctcagttttctggcgttagaccgccggatgtcatggactgttttcataaagaaattaaaacctttgtaccgwtaaggtacaagtatcttgagggttcatctcaatcatgtaatatgtatatcggaggtacatattgtatgaaagcgtattgggactctttaaccaaagaacagcagggcgagttggccggaaaagttggctcaacaccaggctacttacggctggttttcaatggttataaaaaagccagttttgtgctggctaaaaaacttgagcaatgcacgtcaggtgcaattacgaaatctgacttaagaccggatatctatccgaaagattaacagaacaccttcaatttttaaccacagaacgatgaggctaaccgtgggtaagcatcactggaaagtagaaaaacagcctgagtggtacgtgaaagctgtcagaaaaactatcgcggcgttgccgggaggttacgctgaagctgctgagtggctggatgtaacagagaacgctttattcaaccgccttcgtgcagatggcgatcagattttcccgctgggatgggcaatgattttacagcgcgcggctggcactcactacattgcggatgctgtcgcacagtctgctggtggggtgtttgtatcgcttcctgaacttgaggaagtagagaacgccgatataaaccagcgcctgctggaagtcatcgaacagatcgggagttactcaaagcagattcgttcggcaatcgaagatggggtagtggagccacacgagcagacagcaattaatgatgagttgtatctgtcaatttcgaagctccaggagcatgcagcactggtctacaaaatcttttgcgctccagaaaagagtgacgcccgcgagtgtgcagctccgggcgtcgtggcgttttgtgtctgtggagaaactaacgcatgaacagtttaacggcaaataaccgtttgtcgcaacagctggtggtcagcgtcgctgaacacctgttgttacggcatgaatgcagattaccaaatcacatggctgtaagtaaccacagagaactttacctgactgtggggggcgagttgtgcaggaacttaaccgctggtttcgtgacggaagagggctttatgtccatgttattcgttgggagccagaaacacagcgcgttatctatcttcgcaaagactacccgcatgagtgctttagtcctttgtggaaattcaggcgtgattttgttgagtgtgaaggaccaccagcacattgattctgccattccgggacgttacactgttcaggcaccttataaagcgggtgtcgggattggcgtcctggaattgcatacggcgacaattggcgcgttagcgtcttttttgttgctacaactcagctatacccaaattatggtgggctgggtgggggcaccgaaaggtgcgccggtttccgtatgcgccggttacgccaaccctgctcagttcaccaccagcgaaattggcgtttccggtggtggaagttatccattgcatacggaggctgccatcatggctactgtcccagccctctctcgtctgaatgatgaagacttacataaactcagttatgtaacaactgcactacatgctctgcgcaaggtaactctttcggatccgcaggcgcatcaggttttggtagaaacccttcttaacttgcaggctgaacgtattcgtctggcggataaggctaattttcatattcaccgtctcctgaatatcagcggagggcatcgtcatgcttaatccgttgatcctcaatatttgccgtttgcttcagcgtaaaaaaacatcaattcctacagttgggcagtggtacaccacgcctgcagggcatgttctacgtgttagcctggttgaccgtgaatgccagaaggtgatttgtgaaccgctgggccgtaattaccgcgtcagtatgccgcttatagcctttcgctccggaaaaaacatgaagcatctcggaggtgcagcatgagtatggagctgatggttaaagcgatgaaaattcgagtgggtaatccattgcgaaaactggttctgatcaagctggctgataatgccagcgatcagggtgagtgctggcccagctaccagcatattgctgaccagtgcgagattagcaaacgttctgtgatgaatcatattgcggccctttgtgagtccgggctggtaaaaaaagtcacccggaaaggtgaaaaaggtaactcaagtaatatctatctccttcatctggatggtgcaggagattcactagggggtagtgcaaataattcactatctggtgcagcaaattcactaggtagtgcaggagttgcaccagggggtagtgcaggagattcacccagaaccagtcactcttttgaaccagtcaaagaaccagtcaatgaaccaatagctgttggtgcatcagttgatgagcccgtgcgagttcgttcaaaccgaccggaatactctccggagtttgagcaggcatggctggcatatcccaaacgtgctggtggcaattcaaaatctgcagccttcaaagcctggaaagcccgtttgaatgagggagtaaaccccgaaaccatgctggaaggtgtgaaacgctacgcgggctgggtatctgcgatgggtaacagcggcacacaatttgtgaaacaggctgtcacgttctttggtccggatcgtcatttcgaagaattctgggaagttcctgcggtatctgcagccagacgcgaggacccgtacttcaaagccagttacgacaacgtggactacagccagatcccggcaggattcagggggtgatcatgagtcttttgaatgaagttcagaaattcattgaagcccatccggggtgtacttccggagacattgcggatgcttttgcaggttactcacggcagcgcgttctgcagtcagcaagcaagttacgtcagagtgggcgtgtggctcaccgttgtgaaggagatacacgcagacatttcccrcgcctgactgagagagcgcaggarccggaaccacaaccagttcgwgaaaccagacctgtgcgcaatttctatgtcggcactaacgatccmcgggtgattttgtgcctgacccgccaggctgaagaactggagtccaggggtttataccgtcgtgctgcaaccgtgtggatggcggcattccgtgaaagccactcccagccagaacgaaacaattttctggcgcgtcgtgagcrgtgyttacggaaaagcagcaagcgcgctgyatcgggtgawgagtggtatctgtcagggaattacgtgggggcttaatgagtaataaatattgccaggmgctggtggagctgcggaacaaaccagcccatgaactgaaggaagtgggygatcagtggcgcacgccggacaacattttctggggaattaacaccytgtttggcccgtttgttcgggatctgtttactgacggtgataacgccaaatgtgctgcgtattacacggcggaagacaacgcgctggcgcatgactggtcagaacgtcttgcggagcttaaaggtgctgcctttggtaatcccccatacagccgcgccagtcagcatgaggggcaatacatcaccggcatgcgttacatcatgaaacatgccagtgccatgcgtgataaaggtgggcgctatgttttcctgatcaaagctgccaccagcgaagtttggtggccggaagatgcagaccatattgcttttattcgcgggcgtattggttttgaactgccagcctggtttatcccgaaggacgagaagcaggtgccgacaggcgctttcttcgctggtgctattgctgttttcgacaagacctggaagggaccggcaatcagctacatcgggcgcgatgaacttgaggcatgtggtgaggcctttctggcgcaggttcgccagcaggcggaaaaactggtcagggagatggcggcatgacgacattaactcaatgccagcagcaggtgctggatatgctgatttcttaccagaaagaacgtggcttcccgccaaccaatcaggaggtggcaaccatgctgggataccgttcagtgaatgcagcggtggagcatcttcgcgcactggagaaaaaaggcgtcatcacgataaagcgtggcgtggcccgggggataacgcttcataccgcggtgaaggacgacgacagcgaggcggtcgggattatccgctcactgcttgccggtgaggaaaacgcaaggctgcgtgcaacccactggttacatgagaggggcctgaaagcatgaagctgatcctgccttttccgcccagcgtgaacacgtactggcgacaccccaacaaaggggcgtttgcaggtaagagcctgataagcgcggcggggcgcaaattccagagcgcggcgtgtgcagcaatagttgagcagttacgtcgtctgccaaaaccaacgtcggcacctgcttcagtggagatcgtgttgtttcctccggataaccggatccgcgatctggacaactataacaaggcgctgtttgacgccctgacccacgcgggtgtgtgggaagacgacagtcaggtgaaaagaatgctggtggagtggggaccggttatcccggaagggaaggtcgagatcactatcagtaagtacgagaaaacggcgggtgcagccgcctgattaagaggagaaacgaagtatgaataatctgatggtcattgatggtattgaagttcgtcgtgatgcttatggacgttacagcctgaacgatctgcatcgcgcagcagtagcatctggtgcaaatgccagaaccaaggagccgggaaagtttctttccagccaacagattactgagctggttcaggaattgatcgatacccaaaatctgggtgtcggttcattcaatgaaactacccaaaatttgggtagtaaacctgtcagtaaaatagaagggcggaatggcggaacatatgtctgtaaggaactggtgtatgcctatgcaatgtggatcagcccgtcattccatctgaaggtgatccgcactttcgacatggtaaccagcgcaccggaaaaattatccgggcaggctgctgacaagatgcaggctggcgtgattctgctggactttatgcgccgggagttaaatctgtctaactcatcagtgcttggtgcctgtcagaaacttcaggaggctgttggcttaccgaatctggcaccgcgctatgccattgatgctcctgctgatgcacacgatggctcaagtcgcccgacactgtcrctgagtgcactgctgaaacagtatggtatmcgcctgacggctaatcaggcatatcaccagatggcgaagctggggatcgttgaacaacgygaacgatacagccgyachgcgattaacaacatcaaaaaattctggtcgctgacggcgaaaggctgcatgttcggcaaraacatcaccagtccygcaaatccgcgcgagacgcagccgcatttcttcgaatcccgattccctgagctgttaaagctgctcgataccgttcattgaggtgaccgtgagagcactactgacccctgaaattgccccgcgtatggggatcgtattgttcagrcccggttcagagctgatgcccctgtttatgcaggggcgtgtcctgctggagcctgagccggaacgttattcatctttcgccagtggtgccgttccggcggcatcacaaccgctggcggatgatcctgccgttcgggccgtgttccgcaatgaggcagtgatccgtcgtgckggkggcgtggaatgtcttgaaagctggttacttcgtgaaaagggctgtcagtggcctcattccgamtggcacagcgagaacatgaccacaatgcgacacgcgccgggcgcaatccgtctgtgctggcactgcgataaccwgctkcgcgatcagttcacggaacggctggaatcaatggcaacggataactgtgcccgctgggtgttgtctgttgtgcgtcgggatctcggttttgatgacagtcacgttgtgacaatgccggaactgtgctggtggctggttcgtaatgayctggcggatgccttaccggaaagtgcagcccgtaaggcactgagattaccgaagcckgttgtgccgtctgtcacccgggaragtgaccttgtkccttcggttcctgccaccagcatyatccaggataargcgaaaaaggtgctggcgctgaaagtggatccrgagtcgccggagtcttttatgttacgcccaaaacgtcgccgctgggttaatgaaaagtacacgcgctgggttaagacacagycgtgtgcatgttgtggaaagccygctgatgatccccaccacctgataggccacggacagggtggaatgggtacaaaagcgcatgacctttttgtgttgcctttgtgcagaaagcatcacgacgagctgcatgcggataccgtggcatttgaagagatgtatggctcccagctggagctgatatttcgttttatcgatcgtgcgctggcaattggcgtactggtgtaagtggagaacgagcatgaaccttgaagccttaccgaaatattactccccaaaatctccaaaattgagcgatgacgcatcggcgacaggctcgggtggtttaacaattacggatgtratggctgcgcaggggatggtgcagtcgaaagcaccgcttggttttgccttattcctggcaaaagttggtgttcaggaccctcagtttgcgattgaaggtctgctcaattacgcgatggcactggataacccgacattgaacaaattgagtgaagaaaaccggttacagatcatcccttaccttgtgaattttgcctttgctgattattccaggtctgcggcaagtaaggctcgctgtgagcattgtgcaggtacgggatttcataatgtattgcgcgaagtggtgaaacactccagaagcggggagtctgttgtcaaggaagagtgggtgaaggaactatgtcagcattgtcatggtaagggagaagtcagcacagcgtgcagagggtgtaagggtaaaggtattgtactggatgagaaaagaacccggcttcatggtgcgcctgtttataagatttgtgggcgttgcaatggaaaccggtttagccgtttaccaaccacactggcgcggcttcatgtccagaagctggtaccagacctgacggattatcagtggtacaaaggatatgcagatgtcattgataaactggttacaaagtgctggcaggaagaagcatatgcagagatacaattgagaaaggtgacaagataaatggttttcgccgaagataacgacatgatgcttgcatttttcaaaaaatatggataagattttcccaacgatgggctttgtatgtctaccgttgataagatttaagaacccgccgctgagcgggtttttttgtgcctgatgtctcatgaaactatgaaatggattggtgcgttaaacattttttcttattatcttttagattttggagagatgggtaacgtctgtattccagaaactcgatgaatatttaataaattagtttcaatgatgcttctaggttatgagtgtaatgaaaaaggtattaatagcagcgataggtttttgtttagttggttgtgcaggtatgaaattacctgagtattcgcaagttaaagcaagtccgtattatacagattgccgtgcgtttgccatggatgtttataaaaatgatggatacagcaaaattgcgaaaaccactatccttagcatggatgatgtgaaggctagatatattgtgacagggtgtgtagttgctatggggaaaaacactgtagaggaaattaaagctgatctctctgctaaagggagttcttttgggcttatcagtggtgcttgttctagtgctgcatgtcgggttgatgtagagcagcaaatgaacgcttatatacttggtagttattatgctgcaaataaaaaattcccggataaaatgaaagcagagttttaagcaaaccttgttttcgattatatgccgaagataaatgttagtaacggcataataagtaaatatatagctgtgatagcaacccgccactgagcgggttttttgtacctgtaaacttggtgcagtacagtaaacacgctggtggacaagtgaaaaacagcatttaatcaggccttctgaagatattgcagtattaattccgtaacgttattattctgcgcgcggccctttagctcagtggtgagagcgagcgactcataatcgccaggtcgctggttcaaatccagcaagggccaccaactgccactagctcatcaggaaggagcttcaaccctttaagtgcgaggttcgagtccccggtggcggtccagtgccgacttagctcagtaggtagagcaactgacttgtaatcagtaggtcaccagttcgattccggtagtcggcaccatatgcgggcatcgtataatggctattatctcagccttccaagctgatgatgcgggttcgattcccgctgcccgctccagttagagtctttcagtctgcgatgatgggaaatcccggagtgactgaaagacgtttaagttatgaatgatcgctttttttgcaaaattgctgtgcagaaatactaaccttcgggcaggcgatcattcataagcactctgcttttattccgattaactgtgggtggtttgttggatagagtgcttcccttactgtatatattgtttcgcccgtttttgcgggtttttcttttcaaatccctttcatttctcagtgtaaaactacgccatccgttatttgcggaggtgaggctatgaaatccatggacaaaatttcaacgggcattgcctacggcacctccgcaggtagtgccgggtactggtttttacagttgctcgataaagtcacgccctcacagtgggcggcaataggtgtgctgggtagtctggtatttggcttgctgacgtatctgacaaacctttatttcaagattaaagaagataagcgtaaggctgcgagaggtgaataatgtcaccatcattacgcaaggctgttgctgctgctattggtggtggggctgttgctatagcgtctgtgctcatcactggtccaagtggtgacgatggtctggaaggtgtcagctacataccatacaaagatatcgttggtgtatggactgtatgtcacggacacaccggaaaagatatcattcccggtaaaacgtataccgaagcagaatgcaaagccctcctgaataaagaccttgctacggtcgccagacaaattaacccgtacatcaaagctgatataccagaaacaacacgcggcgctctttactcgttcgtttacaacgtgggcgctggcaatttcagaacatcgacgcttcttcgcaaaatcaaccagggcgatatcaaaggtgcatgtgatcaactacgtcgctggacatatgctggcggtaagcaatggaaagggctgatgactcgccgtgagattgagcgtgaagtctgtttgtgggggcagcaatgagcagagtaaccgcgattatttacgctctggttatctgcatcatcgtctgcctgtcatgggctgttaatcattaccgtgataacgcaatcgcctacaaagagcagcgcgataaagccacatccatcatcgctgacatgcagaagcgtcaacgtgatgtagcagaactcgatgccagatatacaaaggagcttgctgatgctaatgcgactatcgaaagtctccgtgctgatgtttctgctggtcgtaagcgcctgcaagtctccgccacctgtgcaaagtcaacgaccggagccagcagcatgggcgatggagaaagcccaagacttacagcagatgctgaactcaattattaccgtctccgaagtggaatagacaggataaccgcgcaggttaactacctgcaggaatacatcaggacgcaatgccttcgatgatagcgatagttttactcatcatccttcacatctggctctgtagacagggtggtgctcacttctggagtgaatccagattaaacatctcattgctgatgcttgatattgagcatctggcgcgcggtaaggggcagcgttgagataagagtcagttcattacaaagcctatctacggatgggcttgataatggtttgttaacctcgcttagcacgaacggcattaccgcaggcattcactgagtgcctgcgataatacttttgatagtcagattacaggataaaaattagatcgaagtaataacctccttccattgtgatttttccttcacggtataactcgcaaagagaatcgaaagtttcttcatgattatcgttctcagggaaccatgctggctggaaagcaacttttcctttttcattcattacttttaacatataagggataatatattgtttcttcataaaaaaacctcttattgtgattgaaaagttttacgtgccatttagagtacttgaagtcacttctcatctttaacgacctccgcaaatacatcgaaaataatattcactttgtgatttgtagttaccttggaaaggtacatgactaacgagaattacttcatcattgacgggtcctcccggtggggtggcctgccacggggcgggagcgtcgcggaaaaaggctagtttttgaaatttcattcgtcatcaccactactgtaatgtgttgatattactgtggttttatttttatggtgtcgattttgattgtttttcgctcatcactaacaccgtttgcctaaagttgttcgcaagatgcatgtttaaaacattctggagcggatatggatcgagagttaaaaaatctgacgctgaatatcagtcaactggcggcactgtcaggtgtacatcgccagactgctgcggcaaggctgcaaaatctacccgttgcaggggggcatgaaagcaacctcaagctttatcgggtggttgatattgtgtcggcatttctggcattaccaccgccggttgcagaaggcgaaatggacgcgcatgagcgcaaagcctggtatcagtctgaacgtgagcgtcttaagttcgaacaggaaacggcacaactcattccggccagtgatgtcagacgggagtttgccatctgggcaaaagctgtcgtgcaggtgctggagacattaccggatattctggaacgtgactgcggtctgcagcctgccgctgtgagccgtgttcagtccattattgatgatctgcgcgatcagatagccctgcgggtgactgaagcaggtgcggatgatgaggaggaattacagcaggaggagtaatgctgaatcaggaaaccgcaaaggcagcacgaaccgattcaggttatatccttcgcgcaccgagacgaatgcgggttgctgatgccgttgctcagtatatgcgggtgcccatgggggcagggaactcagtcccgtgggatccgctggtggcaccgtatgttattgagccgatgaactgcctggcctcgcgtgaatacgacgcagtgatatttgttggcccggcacgaaccggcaagactatcggcctgattgacggctgggtgatttacaacgtgatttgcgaccctgcggatatgctgatcattcagatgacggaggaaaaagcccgcgaacactccaaaaaacgactcgccagaacgtttcgcgtcagcccggaagtggtcagtcgcctgagtccgaacaaaaatgacaacaacgtttatgacagaacattccttgctggcaactacctgaaaatcggctggccgtcagtcaatatcatgtcctcatcagattataaatgcgtcgcgctgacggattatgaccgttttccggaagatattgatggcgagggggatgctttctctcttgcctcaaaacgtaccacaacatttatgtccagtggtatgacgctggtggagagttcccccggcagggatgtgaaggatgtgaaatggcgacggacttcaccgcatgaggctccaccaaccactgggatactgtcgctctataaccgtggcgatcgccgtcgctggtactggccctgtccacactgtggtgagtattttcagccctgcggcgatgtggttgctggtttccgtgatattgccgatcccgtgctggcaagtgaggcggcttatattcagtgtccttcctgttcaggacggattatgcctgaacaaaaacgtgagctgaacggacgtggggtctggctgcgggatggtgaatccatcaatgcggatggcagtcgttatggtgatccccgacgctcacgtattgcgtcattctggatggagggtccggcagctgcttaccagacactctcgcaactcgtttacaaactgcttactgcagaacaggaatacgagacaaccggaagtgaagaaacactcaagacggttatcaataccgactggggattaccttatcttccccgcgccagcatggagcaacgaaaaagtgaactgcttgagcagcgggcagagccagttccttcccgcagtgtgccggatggcgttaatttccttgtggcgacagtggatgtgcaggcgggacgtcatcgccgttttgtggttcaggtaacgggctatggcagccgtggcgaacgctggattattgatcgttacaacatcacgcagtcattgcgcggtgacagcgacggggagagccagcgaattgatccggccagttatccggaagactgggatgtcctgctgacggatgtttttcataaaagctggccgctggcctccgatccttctcaacaaatgcgactgatggcaatggcggtggactccggcggtgaagacggggtcactgataatgcctataaattctggcgtcgttgccgtcgtgatggccttggtaaacgtatttacctgtttaagggcgacagcatccggcgcgcaaaactgatcacccgtacattccctgataacaccggacgaacgggccgacgggcgcaggccgcaggtgatgtaccgctctggcttcttcagacggatgccctgaaagaccgggtgaataacgcgttatggcgtgactcgccaggtcccggctatgtgcatttccctgactggctggggagctggttttacgacgaactgacgtatgaagagcggagcagtgacgggaaatggagtaagccgggtcgcggtgccaacgaagcttttgacctgatggtgtatgccgaggctctggtcattctgcatggatacgaaaagatccgctggccggatgcaccggagtgggcgagccgggaaacctggctggagtgtgtcccggacagtaccgaactgtcaccctcaccggaaccggtatccacgcctgttaaaaaacaaaaacggaagaaaacagtaactgacgatgttaacccctggctgacttccggaggatggttatgaaccagaatgatatcgaagccatgattcagcgttatacggaagctgaaatggcggtgctggacggaaaatccgtcacctttaatggtcagcagatgaccatggaaaacttatctgagatccggcagggacggcaggagtgggagcgccgccttgcggctctgattacacgacgacgggggcatcccgggtaccggctggcgaggttctgatggcaattcttgatgatgtgattggcgttttttcaccaggatggaaagcggcaaggctgcgttcccgtgcggtgatccaggcttatgaggccgtaaaaacgacgcggacacacaaagcccggcgggagaaccgaactgccgaccagttaagccagtacggggccgtgtcgttacgtgagcaggcccgttaccttgataacaaccacgatctggttattggtgtatttgacaagctggaagaacgggtggtggggaaaaacgggattattgtcgagccacatccggtattacgcaatggggccattgcccgtgatctggcagcggagatacgcacccgatggagtgaatggtctgtcagtccggaagtcaccgggcagtttacccgtccgatgctggaacgtctgatgctgcgtacctggctgcgcgatggtgaggtgtttgcccagatggtttccgggcgcataaacagcctgacgccttctgccggtgttcatttctggctggaggcgctcgagccggactttattcccatgaccagtgatgagagcaacaggctgaatcagggcgtgtttgttgatgactgggggcgtcccgaaaaatatctggtgtataaaagccgtcccgtatccgggcggcagatggaaaccaaagaagtggatgcagagcgaatgctgcatcttaaatttgttcgccgtctgcaccagatgcgcgggacgtctttgttgtccggtgtgctgatccgcctcagtgccctgaaagagtatgaagattctgagctgactgcagcaaggatcgccgctgctctggggatgtacatccggaaaggcgacgggcagagctatgaaccggatggtaatggcagcaaggagaatgaacgcgagcttaccattcagccaggcattatttacgacgatctgaaacccggcgaagaaatcggaatggtgaagtcggatcgtcccaatcctaaccttgaaacttttcgtaatggtcagttgcgtgccgtggcggcgggcagtcgtctgagtttttccagtacggcacgcaactataacggcacttacagcgcccagcgtcaggaactggttgagtctactgatggctacctgatcctgcaggactggtttattggtgccgtcacccgcccgatgtatcgtgcctggctgaaacaggctgtggcatccggtgttatcaggctaccccgcgatcttgaccgttcttcactgtataccgcggtgtattccggaccagtgatgccgtggattgaccctgttaaggaggctgaggcctggaaaatccagattcgtggtggagcggcgacagaatcagactgggtacgtgctggtggtcgtaatccggatgatgtcaaacgtcggcgcaaggccgaaattgatgaaaaccgcaagctggatctggtatttgataccgatccggccagtgataaaggaggcagcagtgccgcaacgaaacgacaggagccgcagcacaccgacgaccagtccgaagaataattcctggttcaggatgcaggctggtcaccagagtgacgcggatatttatatttatgacgagattggtttctggggtgttacagcgaagcagtttatcagtgatctgaatgcactgggcgatatcacccacattaatctccatatcaattcaccgggtggcgatgtctttgaaggcatcgccatttttaatgcgctgaaaacacatggtgcgtccattaccgtttatgtcgacggtgtggcggcgtcaatggcgtcggtcattgcgatggtgggaaacccggtcattatgccggaaaacaccttcatgatgattcataaaccatttggctttacgggcggtgatgcggaggacatgcgcacctatgccgacctgctcgataaggttgaggcggttctgttacccgcttatgcacagaaaaccgggaaaaccaccgatgaaattgctgccatgctggcggatgagacctggatgtccggtgccgaatgtctggcacatggatttgctgatcaggtgacgccagccgttaaggcaatggcatgtattcagtcaaaacgtacagaggaatttaaaaagatgccggaatccattcgaaacatgattactccgccacgcaacagtgctccacgcgtacaggatgatgaacctgcagcctcccggacgccagtgcaggccgcagcacccgtggtggatgaaaacagtatccgtgcgcaggtactggcagagcaaaaagcgcgtgtaaacggtattaatgatctgtttgccatgtttggcgggcgttatcagacgctgcaggctcagtgtcttgccgatcctgaatgttcgctggagcaggcccgcgaaaagctgttgaacgagatggggcgcgagtccacgccatccaataaaaataccccggctcatatttatgccggtaacggtaattttgtgggggacgggatccgccaggcgctgatggcgcgtgccggatttgaaaaaaccgaacgtgataatgtctacaacgggatgaccctgcgtgaatatgcccgtatgtcactgactgaacggggtattggggtttccagttataacccgatgcagatggtcggtgcggcgttcacacacagtacgtctgacttcggtaatattctgctggatgttgcgaacaaagccattctgcagggctgggaagatgctcctgaaacctatgaacagtggacgcggaaaggtcagttgtctgattttaaaattgcccatcgtgtgggtatggggggcttcagtgctctgcgtcaggtgcgtgaaggggcggaatataaatacgtcaccaccggagataaacaggccactattgcactggcgacctatggcgagctgttcagtatcacccgtcaggccattatcaatgatgatctgaatatgctgaccgatgtcccgatgaaactgggccgtgcggcgaaatccactattgccgatctggtttatgccattctgacgtctaacccgaaaatctccacagataatgtaagtctgttcgataaagcgaaacatgcaaacgtactggagagcgctgcaatggacgtggcatcgctggataaagcccgccagttgatgcgcgttcagaaagagggggagcgtcatctgaatattcgtcctgcgttcgtactggtaccgacggcgatggagtctgttgctaaccaggtcattcgctcctcaagtgtcaagggggctgacattaacgccggtattattaacccggtgaaagattttgcgaccgttattgcagagcctcgtcttgatgataacagccagaccaccttctacctggctgcgtcaaaaggctccgatacgattgaagtggcttatctcaacggtgtggatacgccatatattgatcagatggagggcttcagtgtggatggcgtgacaacgaaagtgcgtattgacgccggtgtcgcgccagttgatcaccgcggtctggtgaaatgtacggcgtaaacgtcgcagacaacaactctgatggcccgtaagggctttttttgtacctgaaatcagcccctgaacggggctgtgcggagacagttatggcaaagaattttgtagaagaaggaaaaacggtggcgattgttgccagtgcagccatcagcagcggagatctggtgcaggtgggtgatgtttttgcggtggcactgaccgatattccacagggtgaaacaggcgacggcctgaccgaaggtgtgtttatgctgcctaagctgaaaacggatgatatgaaaacgggtaagaaggtttatctgaagtccggaaaagttcagctgactaacagcggctctgatccgctggtcggggttgtctgggcagatgccggaaccagtgcagaagaagtgccggtaaaactcaatgtctgatcccttttcccggctggcagcgcgtatggatgcgatcacggtcagaaagatgggaaagacagcctcgattaatgatgtcgatatgactgtgatcccgggagaaatactggcagagctgaatgctctgtccggacctgcggtatctctggtggtgttttcttcgggataccgcccacgtcgcggggatcgcgttgtttatgacggacaacaatggacggtcacacggcatgaacgctttaacggtaagccaatgatctttattgagtaaagaggtgtgggatgaaggggcttgagaatgccatccgcaatctgaacagccttgatacccgtatggtgccacaggccagcgcatgggcgataaaccgtgtggcacagaaagcggtctcggttgccacccggcaggttgccgggaataccgttgcgggagataaccaggtgaaagggatccccctgaaactggtacgtcagcgtgtccgggtgtttaaagccagtccgtcaggaaaaatgacggccaggatccgcgttaaccggggcaatctgcccgccatcaaactgaacacaacacggcggcgtgctggtgaaggactgagagtgggaaaatactttttccggggggcatttgttcagcaactggcgaatggccgctggcatgttctgaggcgtcttcctgaagcgcgttttgcaacagggcatgaccatcagggcaggccaagaaaaaatcgtcttcctgtggaggtagtgaaaatcccgctgtccggaccgctgacacaggcatttgaagatgcccgcgatcgcatcattgctgcggaaatgccgaaacagctggggtatgcactgaaacaacaactgagattatggctgacccgatgaaccgacatacacaaatccgccaggtcgtactggcacgccttcgggaacagtgtggagacagcgccacgttttgtgacgggcttccggcatttattgatgcgcaggaactgcctgccgtggcggtgtggctgagtgatgctcagtacaccggaaaaatgacggatgaagatgactggcaggctgttctgcatattgccgtcttcatccgggcacaggcaccggattcagagctggatatgtggatggagagcaccatttttcctgccctgaatgatataccggcactttccggactcatcgacaccctgatcccactcggttttaactatcaacgtgataatgagatggccacctgggcgatggcggaaatcacgtaccagatcacgtacacgaattaaggaggtggtaatgaccacaccaaatccactggcaaagacgaaaggtgcggggacgacgttctggatgtataccggcaacggcgatgcgtttgcgaatcctttgtcggacactgactggctgcgtcttgcgatggtgaaggatctgcaacctggcgaaatgaccgctgatgcagaagatgacacttatctcgatgatgaagatgcagactggaaaacgacaacccaggggcagaaatccgtcggtgatacttcggcgacgctggcctggcgtccgggtgacagcgggcagaaaaaactggttcagttgttcgactccggtgaagtctgcgcgtttcgtatcaaatatcccaacggcactgttgatgttttccgtggctggctgagctcactgggtaaaaccattgcctcaaaagacgtgatgacccgcacagtgaaaatcagcggtgtggggcgtccgtatctggcagaggaaggcactgaaacagtgagcgttaccgggctgacggtggcaccggcatctgccagtgtaaaagtgggagcaaccaccacgctgacctttacagtaaaacctgacggagccagtgacaaagcgatcagtgtgcattcgacagatccacagactgccacggtgaccctgaacgggcttgtggccacggtgaaaggcgtgaagcagggcagtgtcagcattgtgggcatgacttctgacggcgattttgtggcagtggctacggtggctgtcagcgccgcaggttaacaggacgatactcatcatttgccccggttatccggggcttttttgcaggtggagaacatgatgtttctgaaacagggcacgtttaattatgaaaagcagtccgtggtgctcagtgagctatccgggctgcagagaattgaatatctggcgtttgttcagcagcgaacggcaaagtttgatgccgaagagggagaactgccggaggctgaacgacagattgcttttctgcggatggggatggatatcaatgcctggctggtttcccgctcactgtggaatgcggaacagtctcaggatgttgagacgctttgcgcatccgttattacaacatggtcgtatgatgccctgggagcgggggcggagatggttctgtcgctgagcggtatgggagccattgagaatgccggggatttggagcatgaggtgctgacgccggaaaagtcctgacgcgggaaatgcagtttgtcatgcggcttgcccgggagttccggcgggcagactggcggcggatgctgtcggaaatgtcggccactgagcttggtgagtggggcgattatttccggatgcagagcttcagtgatgtgtggatggatgcgcagtttgcctcgctgaaggcattgatcgtgagaatggtgtccggtagcagtgatgctgcggtggctgatttcagccttttaccggaagagaacgggataccggagcgaacggacgaagaactgatgcatcttggggaaggtatttccggaggtgtgcgttatggaccagatagccaacctggtcattgatttggggattgatgcggcagagtttaaaaatgaaattccccgtatcaaaaaccttctgaatggtgcagccagcgatgcagaacggtcttctgcccgtatgcagcgttttatggagcgtcagactcaggccgcccggcagacaatgcaggcggcttcttcggctgcaacagccgcatccgtccatgcgcagacggtggagaagagcgcacaggctcatgaacgcatggcccgcgaggtggagcaaacccgccagcgtatggaggcactgagccagaaaatgcgcgaggaacaggcgcaggccatggctctggcggaggctcaggataaagcggctgctgcgttttatcgtcagattgacagtgtaaaacaggccagtgcggggctgcaggaattacagcgtattcagcagcagatccgacaggccagaaacagtggcgggattggtcagcaggattatctggcgctgatttctgaggttacggcgaaaacccgtgttcttacacaggctgaggaagaggctacccgacagaaagtggcgtttatccgtcagcttaaagagcaggcaacccgccagaatctttcttcttctgagttgcttcgtgctaaggctgcccagctgggggtaagcagtgctgcagaagtgtatatccgcaaaatggagcaggcaggaaaagcaacgcattcgctgggtctgaaaagtgcagcggcccgtcaggagataggcgttctgataggtgaactggcccgcggcaatttaggtgcgctgaggggatccggaataacgctggctaaccgtgccgggtggatagacacattgatgtcaccgaaaggcatgatgcttggcggggttattggcggtattgccgcggctgtctatggtctgggtaaagcctggtatgacggtcagaaggagggggaagaatttaaccgccagctgtcgctgacggggcattatgccggagtcactgccgggcagctgtggacgctcagtcgtgctatttccgggaatggtatcacgcaacatgctgcagccggtgcgctggctcaggtggtggggagtggtgcatttcgtggaaacgatatcggtatggtggcgagagctgccgcacagatggagcgatcggttggccagtcggtcagcgataccataaatcagtttaagcggctgaaggatgatcctgtaaatgccgcgaaggctctggacaatgagctgcattttcttactgccactcagcttgagcagatacgcgtccttggggaacaggggcggtccagtgatgcggcacggatagccatgtctgcactggcagaggaaaccggtcggcgtactgcggatattgataataacctcaatgcgctgggcagtacgctgaagtatctgtctgatttatggagtcgtttctgggatgcggccatgaatattggtcgtgaagactcgctggatgaacagatttccgctttacaggagaaagtgtcgcgggcgaaaagactcccctggacggcatcatcttctcaggttgagtacgatcagcagcgtcttaacgagcttcaggagaaaaaacgccagaaggatttgcaggatgcaaaagagcaggcagagcggaattatcaggagcaacagaaacgccgtaatgctgaaaatgctgcactgaaccggatgaatgaaacggaagcagcacgacatcagcgtgaaattgcgcgtattaatgccatgcagtacgccgatcaggctgtcagggatgcggcgatacaacgtgaaaatgaacgttacgagaaagccctggcatccggtaagaaaaaaacacgcgaaacccgtaatgatgaggccacccggttattgctgcagtacagtcagcaacaggcacaggtggaaggacagattgctgctgcaagacagtcagcaggcattgccactgacaggatgacagaagcgcataaacagcttctggctctgcagcagcgcatcagcgatctggacgggaaaaaactgacggcagatgaaaagagtgtgctggcccgtaaagatgaactgattcaggcactgacgctgctggatgtaaaacagcaggagcttcagaaacagacggcactcaacgatctgaagaaaaaaacaattcagctgaccagtcaactggctgaagaagagcgcgctcagcgccagcaacatgacctggatatcgccacggtgggtatgggtgatcagcagcggcagcgatatcaggtacaactgagtcttcgccagaaataccagcaacagctggagcagttgaggcgggatagtgagcagaaagggacatataacacggatgactacagaaaggctgagcaggcgctgacggagagcctgaaccgacaactgaatgagaatcgccgttactggcaacagcttgaagttgtgcagggtaactggaaaaacggagtcctgcgtgcatttcaggattttaccgtggatgcagataatacggcaggaacagcagaacaggtgttctcgtcagccttcagcaacatgggaaatggcctggcaacttttgtcactaccggcaaactcaacttcaaatccttcacctcttcggtgctgtcagatatggcgaaaatcctggcgcaggcaaccatgatgaaatcgataaaagggattggcagtgtactgggatttgatctcagcagcctttccctgaatgccaatggggggatttatcagtctgctgatttgagtcgctacagtggcacggtggttaaccgtccgacgttttttgcttttgcaaaaggcgcgggtgtgatgggggaagctggacctgaagccattctgccactgcgtcgtggtgctgacggtaagctgggggttgtggcggatattggtggttcaggtatggcgatgtttgccccgcagtacaacatcgagatcaataacgatggcacgaacgggcagataggtccggctgccctgaaggtggtttatgaccttgggaaaaaagcggcagcggactttatgcaacagcaggcccgtgatggtggtcggttaagtggagcatatcggtaatggagacgtttcactggaaagtgcgcccggatatgaatgtggtatcagagccgaaagtggtgacagtgaagctgggcgatggttatgaacagcgtcgtgcggcgggactgaataaccagttgtcgacttacagcgtgacgatacgtgttcgtaaatgtgaacacccatctttaaaagcctttctggaacggcacggtggcgttcgcgcatttcagtggacgccaccttatgactggaagccgatcagggtggtttgtcgtaaatggtcggcaagcgtgggggcgctgtgggtaaccataacggcagattttgaacaggtcgtggcataggaggccctgatgcaggatattccacaggaaacacatcatgagacgacacgcctcactcagtcagctcaggtggtgctctgggaaatcgatctgacagaggtcggtggtgaacgttattttttctgtaatgagcagaacgaaaaaggtgagccggtcacctggcaggggcggcagtatcaggcataccccattcaggggacaggatttgaactgaacggcaagggcagtgctgcccgtccgacactgacggtttctaacctgcacggtatggtcaccggtatggcggaagatctgcagagtctggtcggcggaacggtggtccggcgtaaggtttacgcccgttttctggatgcggtgaacttcgtcaacggaaacagtgatgccgacccggagcaggaggtgatcagcagctggcgcatcgagcagtgcagtgaactgagtgcggtcagtgcttcttttgtactgtccacgccgacggaaacggatggcgctgtttttccggggcgtatcatgctggccaacacctgcacctggacctatcgcggtgatgagtgcggttataacggtccggctgtcgcggatgaatatgaccagccgacgtccgatatcacgaaggataaatgcagcaaatgcctgagcggctgtaagtttcgcaataacgtcggcaactttggcggttacctttccattaacaaactttcgcagtaaatcccatgacagagacagaatcagcgattctggcgcacgcccggcgatgtgcgccagtggagtcgtgcggcttcgtggtgagaacgccggagggagaaagatattttccctgcgtgaatatctccggtgagccggaggcgtatttccggatggctccggaggactggctgcgggcagaaatgcagggtgagattgtggcgctggtccacagtcaccccggtggtctgccctggctgagtgaggccgatcggcggctgcaggtgcagagtgatttgccgtggtggctggtctgccgcggggcgattcacaagttccgctgtgtgccacatcttaccgggcggcgctttgagcacggggtgacgggactgttacacgctgttccgggatgcataccatctggcgggaattgagatgccggattttcatcgcggagatgactggtggcgtaacggccagaatctctatcttgacaatatggaggctactggtttttaccgtgtcgcactgacagaggcgcagccgggcgatgtgctgctgtgctgttttggttcatcggtgccgaatcacgccgccatttactgtggtgacggtgagctgctgcaccatattcctgaacaactgagtaaacgagagaggtataccgacaaatggcagcgacgcacacactccctctggcgtcaccgggcatggcacgcatctgcctttacggggatttacaacgatttggccgccgcatcgaccttcgtgtgaaaacgggggctgaagccatccgggcgctggccacgcagcttccgtcgtttcgccagaaactgaatgagggctggtatcaggtgcgcattgccgggcgtgatgcaggcgaaaatgaattatctgcccgtcttaatgaaccgctggcaaatggtgccgtgattcacatcgtgccgcgtctggcgggagctaaaagtggcggtgtgtttcaggtggtgctgggggcggcgctgattgcggtggcatggtggaaccctgtgggctggctgggtgctgcggctgtatcgggcatgtatgcggcaggggccagtatgattctgggtggtgtggcccagatgctggcaccgaaagccaggacgcccacggcagccagtacagataacggcaacagaacacctatttctcctcactggataacatggttgctcagggcaatgttctgcctgttctgtacggtgaaatgcgtgtggggtcgcgggtggtttctcaggagatcagcacggcagacgaaggtgacggtggtcaggttgtggtgattggtcgctgatgcaaaatgttttatgtgaaaccgcctgcgggcggttttgtcgtttatggagcatgacgaatgggtaaaggcagcagtaaggggcataccccgcgcgaagcgaaggacaacctgaagtccacgcagttgctgagtgtgatcgatgccatcagcgaagggccggttgaaggtccggtggatgggttaaaaagcgtgctgctgaacagtacgccggtgctggacagtgaggggaataccaatatctccggtgtcacggtggtgttccgggcaggtgagcaggagcagacaccgccggaggggtttgaatcctccggttccgagacggtgctgggtacggaagtgaaatatgacacgccgatcacccgcaccattacgtcggcaaacatcgaccgactgcgctttaccttcggtgtgcaggcactggtggaaaccacttcaaagggtgaccggaatccgtcggaagtccgcctgctggttcagatacagcgtaacggtggctgggtgacggaaaaagacatcaccattaagggcaaaaccacctcgcagtatctggcctcggtggtggtggataacctgccgccgcgcccgtttaatatccggatgcgcaggatgacgccggacagcaccacagaccagctgcagaacaaaacgctctggtcgtcatacaccgaaatcatcgatgtgaaacagtgctacccgaacacggcactggtcggcgtgcacgtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacattcgtgcaggaccgaccgtcggataaggtgtggacctataaccgcagtaatgtggtgatgccggatgatggcgcgccgttccgctacagcttcagcgccctgaargaccgccataatgccgttgaggtgaactggattgacccggayaacggctgggagacggcgacagagcttgtggaggacacgcaggccattgcccgttacggtcgtaacgtcacgaagatggatgcctttggctgtaccagycgggggcaggcacaccgcgccgggctgtggctgattaaaacrgarctgctggaaacgcagaccgtggacttcagcgtgggtgcagaagggcttcgccatgtaccgggcgatgtcattgaaatctgygatgatgactatgcgggkatcagcaycggcgggcgcgtgctggcggtgaacarccagacgcggacactgacgctcgaccgtgaaatcacgctgccatcctccggcaccacgctgataagcctggttgacggacaggggaatccggtcagcgtggaggtccagtccgtcaccgacggcgtgaaggtaaaagtgagccgkgttcctgayggcgttgccgartacagcgtgtgggggctgaagctgccgacgctgcgccagcgcctgttccgctgygtgagtatccgtgagaatgacgacggcacgtatgccatcaccgcygtgcagcatgtrccggaraaagaggccatcgtggataacggggcgcactttgacggcgaccagagcggcacggtgaatggtgtcacgccgccagcrgtgcagcacctgaccgcmgaagtcaccgcagacagcggggaataycaggtgctggcgcgctgggayacgccgaaggtggtgaagggtgtgagctttatgcttcgcctgaccgtggcagcggatgacggcagtgagcggctggtcagcacggcccggacgacggaaaccacataccgattcacgcaactggcgctgggaaactacaggctgacagtccgggcggtaaatgcgtggggacagcagggcgatccggcgtcggtatcgttccggattgccgcaccgtcagcgccgtcgcggattgagctgacgccgggctattttcagatcaccgccacgccgcatcttgccgtttatgatccgacggtacagtttgagttctggttctcggaaaagcggattgcggatatcaggcaggttgaaaccacagcccgctatcttggcacggcgctgtactggatagctgccagtatcaatatcaggccgggccatgattattatttttacgttcgcagtgtgaacaccgttggcaaatcggcattcgtggaggctgtcggtcgggcgagcgatgatgcggaaggttacctggattttttcaaaggccagataactgaatcccatctcggcaaggagctgctggaaaaagtcgagctgacggaggataacgccagcaaactggaggagttttcgaaagagtggaaagacgccaacgataaatggaatgccatgtggggcgtcaaaattgagcagaccgaagacggcaggcattatgtcgcggggcttggcctcagcatggaggatacggaggaaggcaaactgagccagttcctggttgccgctaaccgtatcgcgtttattgatccgtctaatggcaacacaagaccaatgtttgttggtcagggcgatcagatattcatgaacgacgtgttcctgaaacgcctgacggctccgaccattaccagcggcggtaatcctccggcattttccctgacaccggacgggcggctgacggcgaaaaatgccgatatcagcggtagcgtgaatgcgaactccgggacgctcaacaacgtcacgattaacgagaactgtcgggttctgggaaaactgtccgcgaaccagattgaaggcgatctcgttaaaacagtgggcaaagctttcccccgggactcccgtgcaccggagcggtggccatcagggaccattaccgtcagggtttatgacgatcagtcgtttgaccggcaaattgttattccagcggtggctttctgcggtgccagacatgagcgggagaatagcgatacttattcgtcatgccgcctgatagtgaagaaaaacggggctgaaatttataaccgaacggctctggataatactctgatttacacgggtgttattgatatgcctgcaggcagtggcgtaatgacactggagttttctgtatcagcatggtgggtaaatggttggtatcccacagcaagtatcagcgatttgctggttgttgtgatgaagaaagccactgcaggcatcacgattagctgaattttataacccagatacgggcgccagaaatggcgccttttttattgcagaaaagcgagaggtaattatgcgtaaattatgtgctgttattctgtccgcagtagtctggctggttgccgctggtacgccagcgagcgcagcagagcatcagtccacactaagcgccgggtatcttcagacccatactgatatgccaggcagcgatgacctgaagggcattaacgtgaaataccgttatgaatttacggacacgctggggctggtgacgtcattcagctatgcaggagacaagaatcgccagcttacccgttacagcgatacccgctggcatgaagattccgttcgtaaccgctggttcagcgtgatggcggggccgtctgtgcgcgtgaatgaatggttcagcgcgtatgcgatcgcgggtgtggcttacagccgtgtgtcgactttttccggggattatcttcaggtgaccgacaacaagggggatacgcacgatgtgctgaccggaagtgatgacggtcgccacagcaacacgtctctggcgtggggggctggcgtgcagtttaacccgaccgaattcgtggccattgatattgcttatgaaggttccggcagtggcgactggcgcactgacggtttcatcgtgggtgtcggttataaattctgattagccaggtaacacagtgttatgacagcccgccggttcaggcgggcttttttgtggagtggatatggcagcagtaaaaatctcaggtgtgctgaaagatggtgcgggtaaaccaatacagaactgcactattcaactgaaggcaaagcgtaacagcaccacggtactggtgaacacggtggcctctgaaaatccggatgaagccgggcgttacagcatggatgttgagtatggccagtacagcgtcatcctgctggttgaaggttttccgccttcacatgccgggaccattaccgtctatgaaggctccagaccaggtacgctgaatgattttctcggtgccatgacggaagatgatgtcatgccggaggcattgcgtcgttttgaggcaatggtggaagaagcggcacgcaacgccgaagccgcctctcagagcgcagcggcggcaaagaaatccgaaactgcagcggcatcatcgaagaacgcggcgaaaacctcagaaacgaatgcagctaacagcgcacaggcggcagcgacctcacagactgcatcggcaaactccgcgacagcagccaaaaaatcagaaaccaacgcgaaaaacagtgagacagccgcaaagacgagcgaaaccaacgcaaagtccagccagacggcagcgaaaacaagcgaaacgaatgccaaagccagtgaaactgcggcgaaaagcagtcaggatgcagcagccgaaagcgagagtgctgcagctggttctgcgacttcagcagctggatcagcaactgctgcggctaacagccagaaagccgcgaagacgagcgaaactaacgcaaagtccagccagacggcagcgaagaccagcgaaacgaatgccaaagccagcgaaactgcggcgaaaaacagtcaggatgcagcagcccaaagcgagagtgccgcagctggttctgcaacagcggcagctaatagccaaaaagctgcaaaaaccagtgaaactaacgcaaagacgagtgaaacaaaagcagcagccagcgagacagaagcaacgtcagccgcaacaagagcagagaatgcagcccggattgcagaagatgccgctgatcctgcttctgtccctccgcttcctgatatctggctacctttgaatgattctctggaagcgataacagggtatgccccgggctataaaacaataaccatcggcagtgatgaaataacaatgcctgttaatggcatatgccaatttagccgggcttcatctgcaacgtatattgataagtccgggcatattaccgtggcaggcaataacgttcctcgttttgaaaaatatggtttgctgatagagaatcagcgaacaaacatgttcgtaaatagttttaatcctgatgcgtggaataaaagcggtggtatatctgtaacatcatcaacagatgaatttgagtttaaatatggacgtttcacagtaggaagtgagatagcaggaacgacaacagggagaaatatatgcacagttgctggtaataaaggcatagatgtgactggcgatgatcagtacagtaaaggtccgtatgttaccgcgtcgttcagggtaagaagtgatctcaatgttcgcgcacgtatccgttttgaacggtataactcggaaggatacactttcctttgtgacgcctatttgtcattacagactcatgaactacaaattacgggtggtaatgcccagctattaacagcaaactttgaaatcgaccctggtagtggatggatatattttcaggcaacactgaaatgtctgccagaatggggaatggttggtacgcagctgcaaattgcagccgacagagcagtgggggcttttgcaacaggtgactggatagaagtaaccaccccgcaattcgagtatggtgcttgtgcaacttccttcatcataacgacaacagagccagcgactcgtgcatcagatttatgtaaatttccgctgatgaaaaatatgtataccatgccttttacgttcatggcggaagtccataaaaactggtttatttctcataatgcagcaccgcgtgtcattgattcagaaaatcaccagtccggaggcccatttattatggggtttggttcttctggaactatcagtcaggacggttattcgtattgcgatataggcggggctaaccgacgtgtatatgaatcatgcggagtaagggatctcgttatgggattcagggttaaggctgacggcatgacatgctcatttgcaaataagcatataagcactgaaacaaaaacagtatggaaatatattcgtgaagcagccgtgattcgtatcggggggcaaacgacgacaggattacgacaccttaatggtcatataaaaaacctccgtttctggaacagagcattgtcagatacgcagcttaaggaatacgtataatgcgggatataacattacgattcgataacagagaacagtttaacgcaattgtatatgacagtggcctgttcagtcttgaagaagaaaatgggattcttgttgatgttattggttgcattatcgattacgaggagccagaaaacgaaagatgtacaggcattgatcgcggtggttttttcgtaaacatgaggattgttgatagcagtaaaaacatatcttctttaatgcctttcattacgacagatcagcatgtaaggacatgggcttaatggagtaagacaatggttacaaaaacagtaattcctgatgacatcaaaacgctaaaatcggatgttagtaaattaaaaaccgatcaaggaaactacgcaacaaaatcttatgtagacaataaaacaacatggaatggttattgcaatgtaatctatgatcaaaaaacattgccaacaactggaactatattcagcggtaagctgcatttgtcaaataagactggtgaaacggaaaacgcttatagtgacatatataccagaaaaaatattgatggtactaaagatacaatgacgaggatcgtcacacataacgggaaaaaaggtatcttttgggactttagtgatctttacggaggaactttaatttttccaggcagtgatggttaccttaagatggggaactgtctcatgtcgtatggtgtgcggggaagtaacgcgcttattaagtttgataatacagactcattgcagatcaaatatgctaatcacgggtcgaccatgacactaaacacgcaaggtacggcgtattctggtgtgtcgacgttattatggggaaattccagtcgtccagttgtttatgaaattagggatgatggcgggctttttttgttttatgcacaaaggaacccagataaaacctatcagcttgagataaacgggccatgcaaggctacatcattcgaccaggtgtcggacagagatcttaaagaaaacattcaggttattgataatgccactgagcgcatcagattaatgaatgggtatacttaccgtctcaagtctaatggtatgccttatgctggcgttattgcgcaagaggcacttaatgcaatccctgaatcagttggtagcacaataaagtacaagagcggggacaatgggtctgatggagaagagggagaaagatactataccgtcgattactcaggcgtaacgggtttgcttgttcaggtagccagagagtcagacgacaggataacagcactggaagaagaaaacgcagaattaagacaaagattatctgcaattgaggcggcgcttgcgtctaaataatattaaggggccgagcgccccgttttattgagtaggatgaaaatggatataacacctttccttcatgcgctttgtgctgtggctgcgcagctactgattggtctttttaccgggaactgggcttacggggcgatagccggttgtacgttcttcattgcgcgtgaacacacccaggcagaatatcgctggattgaaatgttcgggcatggcaagcgaatgaatatgccgtggtggggcggttttgatccgcgcgcgtgggatgtggcaagcctgatggattttgctgtgccggtggtggcgtgtctgctgatctggctgttgatccgttaaatataaaaagccgcagtaacttgccatggcaggatactgcggctggtttgtgagtttaaatagtgtgtttattgcggtatatttaaaggacttaatggattacatatctatgatattcctgagatatcctcttcaagctcttttactgatttcgcaattttaaatttaaacttcctctctatttcactattgctaagttttttttccttctctttacctatccacatagaaacaagttctcgtttctgagatatatgtaaattatcaaagttaggtatgtatttaaaagtctccgctctacctctgcggagttcatagaaagttttaattaaagactttggttttatttctgatgaaaggccgaatcggcggataagattattgatagtatgattaacagagcgaagttgagctgttgaggttatttgtgagaagtacgatacccatcccaatcgtttaccttcaaacacacatcccgtaattctgagatttagtttccactgacaatatgcaacagctcgttctttatcacgcttacttttagcttgtagtagagcgtgcctgtatgcagtaaaaatccttgctaaagatgactcaaatctaagaatgctctcatgttttatcaataattctcgattttctatgtggtatcccaaaaagttaaaactttcatccaagctgcctactttggattttgagttctcttcatttaatggatgtgggtttaaatttaatgattgaagcttatcaatgatatgagaagctatttttgttgcttgatattttggtgttaaaataagaatgtcatcaacgtatcgcatgtaccatatgtcatgcattttattgatttcatcatcaaaattagatagtgatatttcagctaaaatgtttgatatcgctaatccctgaggtactcctctggtattattcgggatacctttgcttcctgttgttccacttacagtaggcacgattaatgatgatgttattaactgtctaatttctttttttctaattttattttttattgcattaattatcaatttatgttcaattgaaggatagaaacttttaagatctatttttgcatattcagcataaagactgctgtttaatgcttctttcaatgagtcaattactgtatgtggtagttttaatctggagttaggatatatttccgtaaggcattcacagagagctctaagagtaattctgtccctagcagttggtatggaaatctgtctgggtgtagagttagcgcctttagatattaatttttctttatatgctgtaaatttgtaattgccagagttaaccttttcaaaaatgaaagcgatctcattttttattgtcaaatcaagttttgatgggcgaatccgatctatgccaatcgctcctgattctttgattttttcagtgtatacttttagaaggttttttttcgagaatgactttttaaaaattctgcttgcagtcatagtcaatccaaagatatattaatgggagtatataaagggcggcagtagtaaatattcgaagtaatatccataaaataacaattattttttctttttgtgtggggatcctcgtcgtaagtccaacttgagttacccttgaaattttatcatctatgtcacggtgattctcaacctcattgagcaaattaaaatatttttctttctgttcaagagttaactgttgactggtggtaatgtcaaaatagagtcgctgtagtgcaatataattccttctcatggctattgctcgaccacgaaaatctaggttagatacgatcagcgaaatacccagtagggccaccgaaagtattgccgcaacgatatctgtgttatctcctagaacttttggaaatcgcaacgttacaattgaaagtaccgcactcaatatagcataccaaacgaggataaattgagagtgcttttcaagccattctagtcgatggtgcgcttggatacgggctttatatgtaaaccaaatattgtcatgcataaaagatcctttttaaaagcggaaggggcaggatatattggaatcattgaacatcctgcccggcaggatcagtgagcataagctcaacagtaaaatattactgttcattatcagagccgcccttgcatgcacaagaggaaaaacctgccccatccttttgaattattacaatttaatgatcttaaagtcaatacaagtgaatggtgtccagagatgatgaacttaatgaacaaaccactcgtcagcagactcccaggtatctttcagagtttcctgaacaaaagttttagctgaatctttatcggcggtgcgcgtaacagaaaggccatcgttgctggtggcttttacgatcacctctacatcgtcataacgcttactgatgcgtcgagttaattcttcctttaacgcatccacagcaccgcttggcattttagtcattttctctttagctatgcagatctcaatacgcataaaaatccctctacactgtgtttgtatacagtgttatttttaactgtatgaataaacagtgtcaatagaacaaagattgctgcatgtacaaatgttctttggctacaaatacacctactgatcatgttctgctatgctctgatacctccaaaatgtacaatcagcggcatgaatttttctttgtacatatgattgtacataattaaagagacaacaattatgacaagccttttggccgcagaggtagcgaaaagaagaacctttgcaattatttctcacccggacgccggtaagactaccatcaccgagaaggtgctgctgttcggacaggccattcagaccgccggtacagtaaaaggccgtggctctaaccagcacgctaagtcggactggatggagatggaaaagcagcgtgggatctccatcactacgtctgtgatgcagtttccgtatcacgactgcctggttaacttgctcgataccccggggcacgaagacttctcggaagatacctatcgtaccctgacggcggtggactgctgcctgatggttatcgacgccgcaaaaggtgtagaagatcgtacccgtaagctgatggaagttacccgtctgcgcgatacgccgatcctcacctttatgaacaaacttgaccgtgatatccgcgacccgatggaactgctcgatgaagttgagaacgagctgaaaatcggctgcgcaccgatcacctggccgattggctgcggcaagctgtttaaaggcgtttaccacctttataaagatgaaacctatctctatcagagcggtaaaggccacaccattcaggaagtccgcattgttaaagggctgaataacccggatctcgacgctgcggttggtgaagatctggcacagcagctgcgtgacgaactggagctggtgaaaggcgcgtctaatgagttcgacaaagagctgttccttgcgggcgaaatcaccccggtattctttggtactgcgctgggtaacttcggcgtcgatcatatgctggatggcctggtggagtgggcgcctgcgccgatgccgcgtcagaccgatacccgtaccgtagaagcgagcgaagataaatttaccggcttcgtatttaaaattcaggccaacatggacccgaaacaccgcgaccgcgtggcgtttatgcgcgtggtatccggtaaatatgaaaaaggcatgaagctgcgccaggtgcgcaccgcgaaagatgtggtgatctccgacgcgctgacctttatggcgggtgaccgttcgcacgttgaagaagcgtatcctggcgatatccttggtctgcacaaccacggcaccattcagatcggcgacacctttacccagggtgagatgatgaagttcaccggtattccgaacttcgcgccagaactgttccgtcgtatccgcctgaaagatccgctgaagcaaaaacagctgctcaaagggctggtacagctttccgaagagggcgcggtgcaggtgttccgtccgatctccaacaacgatttgatcgttggcgcggttggtgtgctgcagtttgatgtggtggtagcgcgcctgaagagcgaatacaacgttgaagcagtgtatgagtcagtcaacgttgccactgcccgctgggtagaatgtgcggacgcgaagaaattcgaagagttcaagcgtaagaacgaaagccaactggcgcttgatggcggcgataacctcgcttacatcgctaccagcatggtcaacctgcgcctggcgcaggaacgttatccggacgttcagttccaccagacccgcgagcattaattcttgcctccagggcgcggtagccgctgcgccctgtcaatttcccttccttattagccgcttacggaatgttcttaaaacattcacttttgcttatgttttagctgatatcccgagcggtttcaaaattgtgatctatatttaacaaagtaatgacatttctgacggcgttaaataccgttcaatgcgtagatatcagtatctaaagccgtagattgtcattctaccgatattaataactgattcagaggctgtaatggtcgttattcatcacccatcgcttttgtgatggcgaccattgacttctgtagagggtgaagtctctccctattcagcaatgcaacctcgtgttgccaggctcaaattacgagcaaacatacaggaataaatcgatgactatgacaagactgaagatttcgaaaactctgctggctgtaatgttgacctctgccgtcgcgaccggctctgcctacgcagaaaacaacgcgcagactaccaatgaaagcgcagggcaaaaagtcgatagctctatgaataaagtcggtaatttcatggatgacagcgccatcaccgcgaaagtgaaggcggccctggtggatcatgacaacatcaagagcaccgatatctctgtcaaaaccgatcaaaaagtcgtgaccctgagcggtttcgttgaaagccaggctcaggccgaagaggcggtgaaagtggcgaaaggtgttgagggcgtgacctctgtcagcgacaaactgcacgttcgcgacgctaaagaaggctctgtgaaaggctacgcgggtgacaccgccactaccagtgaaatcaaagccaaactgctggcagatgacattgtcccttcccgtcatgtgaaagttgaaaccaccgatggcgtggtccagctctccggtaccgtagattctcaggcacagagcgaccgtgctgaaagtatcgccaaagcggtagatggtgtgaaaagcgttaaaaatgatctgaaaactaagtaattcgtcgtaattcgacctcccgaactttgtcgggaggcgcgatgtgcaccacactaaaaatatcgcattgagtgattttcacgctcatatcaagcggtgacattaactatggtaaaggagacgcttatgtttcgttggggcatcatatttctggttatcgcgttaatcgccgccgcacttgggtttggtggtctggccggtactgctgcaggcgcagctaaaattgtctttgtcgtcgggattattctgttcctggtgagtttgttcatgggccgaaaacgaccctagatttcagaccattaagaaaattttatccaaagccagtccagcggactggcttttgcggttttagcgaataataaattgcgttactttgtcattctttcacaacaaaaacaggaaggcagaggtggggcagcgaatacctgtaacgcttggtaatattgcgccgttgtcgctaaggccgttccagcctggacggattgctctggtgtgcgaaggcggcggacaacgtggaattttcacggctggcgtgctggatgagtttatgcgcgcgcagtttaatcctttcgatctttatctcggcacatctgccggggcgcagaacctctcggcgtatatctgcaatcagcccggttacgcgcgcaaagtcatcatgcgttacaccacaaaacgcgaatttttcgatccattgcgctttgtccgtggaggaaatcttatcgatctcgactggctggtggaggccaccgcaagccagatgccgttgcaaatggacaccgcagcgcggttatttgacagcggcaaatcgttttatatgtgcgcctgtcgtcaggatgactatgcgccgaattactttttgccaactaaacaaaactggctggatgtgattcgcgcctccagtgcgatacctggcttttatcgtagcggagtgtcgctggaaggtattaactacctggatggtgggatcagtgatgcgatcccggttaaagaggcggtaaggcagggagcaaaaacgttggtcgtcatccgcactgtgccgtcacaaatgtactacacgccacagtggttcaaacgcatggaacgctggctgggtgacagtagcctgcagccgctggtcaatctggtgcagcatcatgaaaccagctatcgtgagattcagcaatttattgagaaaccaccgggccagctgcggatattcgaaatttatccgccgaagccattgcatagtattgcgctcggcagtcggattccggcgctgcgtgaagactataaacttgggcgtttatgtgggcgttattttctggcaacggtcggtaaattattgactgaaaaagcgccgctgagccgccatctggtgccggtggtgacgccggagtcgatcgttattccgcctgcgccagtcgccaacgatacgctggttgctgaagtgagcgacgctccgcaggcgaacgacccgacatttaacaatgaggatctggcttgatttgccgttttatcgacacccactgccattttgatttcccgccgtttagtggcgatgaagaggccagcctgcaacgcgcggcacaagcgggcgtaggcaagatcattgttccggcgacagaggcggaaaattttgcccgcgtgcaggcgttagcggaaaaatatcaaccgctgtatgccgcattgggcttgcatcctggtatgttggaaaaacatagcgatgtgtctcttgatcagctacagcaggcgctggaaaggcatccggcgaaggtggtggcggtgggggagatcggtctggatctctttggcgacgatccgcaatttgagaggcagcagtggttactcgacgaacaactgaaactggcgaaacgctacgatctgccggtgatcctgcattcacgacgcacgcacgacaaactggcgatgcatcttaaacgccacgatttaccgtgcactggcgtggttcatggtttttccggcagcctgcaacaggccgaacggtttgtgcaactgggctacaaaattggcgtaggcgggactatcacctatccacgcgccagtaaaacccgcgatgtcatcgcaaaattaccgctggcatcgttgttgctggaaaccgacgcaccagatatgccgctcaatggttttcaggggcagcctaatcgccctgaacaggccgcccgtgtgtttgccgtgctttgcgagttacgaccggaaccggcggatgagattgccgaagtgttgcttaataacacctatacgttgtttaacgtgccgtaggccggacaaggcgtttacgccgcatccggccgttggcgcacaatgcctgatgcgacgctgacgcgtcttatcatgcctacaagtctgtgccgaaccgtaggccggataaggcgttcacgccgcatccggcagctggcgcacaatgcctgatgcgacgcttgacgcgtcttatcatgcctacaggtctgtgccgatccgtaggccacatccggcatgtcacaaatatagcgccggaaatattaaccggctcaccccgcgctcccgtaacgcatcagccagttgttccacatcctccggcgtggcgctcggccagctttgcgcctcgccatacacgccgtgggcatgaaacgcgttcaggcgtaccggaacatcgccaagtcccttgattaacgccgccagttcttcgatatgttgcaaataatccacctggccagggattaccagcaaacgcagttccgccagcttaccgcgctctgccagcaaacagatgctgcgcttgatctgctgattatcgcgtccggttaattgctgatgacattcgctcccccacgctttgagatcgagcattgcgccgtcacacaccgggagcaatttttcccagccggtttcgctcaacatgccgttactgtccacgaggcaggtgagatggcacagttgcggatcgtttttgatggcagtaaacagcgccaccacaaacggcaactgggtcgtggcttcgccgccgcttaccgttatcccttcaataaacagaaccgctttgcggacatggttaagcacctcgtccacgctcatggattgcgccattggcgtagcatgttgcggacacatcttcaggcaggtatcacattgctcgcagacagccgcgctccacgccactttgccgtcgacaatctgcaacgcctgatgcggacactgcggcacgcactctccgcaatcattacagcgccccatcgtccacggattgtgacagtttttgcagcgcagattgcagccctgcaaaaacagagccagacgactgcctggcccgtcaacgcaggagaaggggataatcttactgactaaagcgcatctgctgttcatggcttatcacgcgcggctggcgttccagaatacgagtgttgcgtgcggcttcttctcccagccaggtggtgttggtgcgtgaaccttcggcgcgatatttttctaaatccgacaaacgcaccatataaccggtaacgcgaaccagatcgttaccgctgacattggcggtaaattcacgcattccagctttaaaggcaccgaggcaaagctgtaccagcgcctgcggattacgtttgatggtttcgtcgagcgtcagaatgtcgctgatgccggaataataataagcatgatgcggggcgacagtttgcagatgggtaatcggatctggctcatcaccatacggcaaacgcgcgcccggcgtggtgccgatatcggaacttatccccgactgtgcgtgtaacatggcgcgtttttgccagccatatttcacgggggtattggcgacaaactccgccagttgcgcgctaatgcgataacccacttcatttgcggcggcctctttaccgtagcgtgcggcaatcccttctttttcacacagcaagttaaccgcttccgccagcccatacatgccaaacatcggcacaaaacgttcagggttaatcagcccttctttcaccaggaagctattctcaaagaagtgtgattgttgatagaggaattcacaccgcgcatcgatgatggcgatctgctgttggcagtagtgcggtagagtgcgcgtaaagaagtcctccagcgattcactgcgctcggcaatggctttcaggtttaggcgtaccagcgtgctgccaccacccgccagcggcagtgagttgtaacagctcacaatcccgtagcccccttttgtgaaaattttatcatgcaccggaccgttggcgatgtgcggtttgctacattcacagatgtttttcgccacttccagcagcaggtcatcaggggtgatatcaggatcgtagataaaggtcaggttcggtgaaacctgcttcagctctgcgtctgcacgtaatatcgcacgggtaatgggcgaatcagacgggccgatattggcatgcataaaggcgtctggcagggttctgtcgaggtaacgccagaaacgttttattcgaatatcgatctcgtcttgtgttagaattctaacatacggttgcaacaacgcatccagttgccccaggtagaccggcatcgatgtgaccgacggtacatggtggtaaagaatggtcagcagagagagtgcgtcatcaaggtctttcgcgccttccagctccagccattcggaaccgttggccaaaaaacgggcgtaatcgggtaagacatagcgcggtttgtacggcgcatgaccttcaaacatatcgcagattaccccctcatccagcgcgcggcgggcttcggcaggcagctgtgggtaaggcagattgttttctgcttccagtgccagaaaatggcgcttctgctccgggctaagtaccgggctggtgacaatttgctggcaacgttgttgcagtgcattttcatgagaagtgggcatcttcttttccttttatgccgaaggtgatgcgccattgtaagaagtttcgtgatgttcactttgatcctgatgcgtttgccaccactgacgcattcatttgaaagtgaattatttgaaccagatcgcattacagtgatgcaaacttgtaagtagatttccttaattgtgatgtacatcgaagtgtgttgcggagtagatgttagaatactaacaaactcgcaaggtgaattttattggcgacaagccaggagaatgaaatgactgatctgaaagcaagcagcctgcgtgcactgaaattgatggacctgaccaccctgaatgacgacgacaccgatgagaaagtgatcgccctgtgtcatcaggccaaaactccggtcggcaataccgccgctatctgtatctatcctcgctttatcccgattgctcgcaaaacgctgaaagagcagggcaccccggaaatccgtatcgctacggtaactaacttcccacacggtaacgacgacatcgaaatcgcgctggcagaaacccgtgcggcaatcgcctacggtgccgatgaagttgacgtggtgttcccgtaccgcgcgctgatggcgggtaacgagcaggttggttttgacctggtgaaagcctgtaaagaggcttgcgctgcggcgaacgtactgctgaaagtgattattgaaaccggcgaactgaaagacgaagcgctgatccgtaaagcgtctgaaatctccatcaaagcgggtgctgacttcatcaaaacctctaccggtaaagtggctgtgaatgcgacgccggaaagcgcgcgcatcatgatggaagtgatccgcgatatgggcgtagaaaaaatcgttggtttcaaaccggcgggcggcgtgcgtactgcggaagatgcgcagaaatatctcgccattgcagatgaactgttcggtgctgactgggctgatgcgcgtcactaccgctttggtgcttccagcttgctggcaagcctgctgaaagctctgggccacggcgacggtaagagcgccagcagctactaaggcttgatttgccggatgatgcagcgatgctcatccggttccccgattacctcgtctcttttccacgggaggttaccttgtttctcgcacaagaaattattcgtaaaaaacgtgatggtcatgcgctgagtgatgaagaaattcgtttctttatcaacggcattcgcgacaacactatctccgaagggcagattgccgccctcgcgatgaccattttcttccacgatatgacaatgcctgagcgtgtctcgctgaccatggcgatgcgagattcaggaaccgttctcgactggaaaagcctgcatctgaatggcccgattgttgataaacactcgaccggcggtgtcggcgatgtgacttcgctgatgttggggccgatggtcgctgcctgtggcggctatattccgatgatctccggtcgcggcctcggtcatactggcggtacgctcgacaaactggaatccatccctggcttcgacattttcccggatgacaaccgtttccgcgaaattattaaagacgtcggcgtggcgattatcggccagaccagctcactggctccggcggataaacgtttctacgcgacccgcgatattaccgcaaccgtggattcaatcccgctgatcaccgcctctattctggcgaagaaactggcggaaggtctggacgcgctggtgatggacgtgaaagtgggtagcggcgcgtttatgccgacctacgaactctctgaagcccttgccgaagcgattgttggcgtggctaacggcgctggcgtgcgcaccaccgcgctgctcaccgatatgaatcaggtactggcctccagtgcaggtaacgcggttgaagttcgtgaagcggtgcagttcctgacgggtgaatatcgtaacccgcgtctgtttgatgtcacgatggcactgtgcgtggagatgctgatctccggcaaactggcgaaaaatgacgccgaagcgcgcgcgaaattgcaggcggtgctggacaacggtaaagcggcagaagtctttggtcgtatggtcgcggcacaaaaaggcccgaccgacttcgttgagaactacgcgaagtatctgccgacagcgatgctgacgaaagcagtctatgctgataccgaagggtttgtcagtgaaatggatacccgcgcactggggatgacagtggttgcaatgggcggcggacgccgtcaggcatctgacaccatcgattacagcgtcggctttactgatatggcgcgtctgggcgaccaggtagacggtcagcgtccgctggcagttatccacgcgaaagacgaaaacagctggcaggaagcggcgaaagcggtgaaagcggcaattaaacttgccgataaagcaccggaaagcacaccaactgtctatcgccgtatcagcgaataacggtatactgatctgatcatttaaatttgaagcactgagtacggagaacatatgaaacgtgcatttattatggtgctggactcattcggcatcggcgctacagaagatgcagaacgctttggtgacgtcggggctgacaccctgggtcatatcgcagaagcttgtgccaaaggcgaagctgaccacggtcgtaaaggcccgctcaatctgccaaatctgacccgtcttgggctggcgaaagcacacgaaggttctaccggtttcattccggcgggaatggatggcaacgctgaagttatcggcgcgtacgcatgggcgcacgaaatgtcatccggtaaagacaccccgtctggtcactgggaaatcgccggtgtcccggttctgtttgagtggggatatttctccgatcacgaaaacagcttcccgcaagagctgctggataaactggttgaacgcgctaatctgccgggttacctcggtaactgccactcttccggtacggtcattctggatcaactgggcgaagagcacatgaaaaccggcaagccgattttctatacctccgctgactccgtgttccagattgcctgccatgaagaaactttcggtctggacaaactctacgaactgtgcgaaatcgctcgtgaagagctgaccaacggcggctacaacatcggtcgtgttatcgctcgtccgtttatcggcgacaaagctggtaacttccagcgtactggtaaccgtcacgacctggctgttgagccgccagcaccgaccgtgctgcagaaactggttgatgaaaaacacggccaggtggtttcggtcggtaaaattgcagacatctacgccaactgcggtatcaccaaaaaagtgaaagcgaccggcctggacgcgctgtttgacgccaccatcaaagagatgaaagaagcgggtgataacaccatcgtcttcaccaacttcgttgacttcgactcttcctggggccaccgtcgcgacgtcgccggttatgctgcgggtctggaactgttcgaccgccgtctgccggagctgatgtctttgctgcgcgatgacgatattctgattctcactgctgaccacggttgtgacccgacctggaccggtactgaccacacgcgtgaacacattccggtactggtttacggcccgaaagtgaaaccaggttcgctgggtcatcgtgaaaccttcgcggatatcggccagactctggcaaaatattttggtacttctgatatggaatatggcaaagccatgttctgatggatttgggcggagcagtgactccgcctttaatatgtcacaaaaaggataaaatgatggctactccacacattaatgcagaaatgggcgattttgctgacgtagttttgatgccaggtgacccgctgcgtgcgaagtatattgctgaaactttccttgaagatgcccgtgaagtgaacaacgttcgcggtatgctgggcttcactggtacttacaaaggccgcaaaatttccgtaatgggccacggtatgggtatcccgtcctgctccatctacaccaaagaactgatcactgatttcggcgtgaagaaaattatccgcgttggttcctgtggcgctgttctgccgcacgtaaaactgcgcgacgtcgttatcggtatgggtgcctgcaccgattccaaagttaaccgcatccgttttaaagaccatgactttgccgctatcgctgacttcgacatggtgcgtaacgcggtagacgcggcaaaagcactgggcgttgatgctcgtgttggtaacctgttctccgctgacctgttctactctccggacggcgaaatgttcgacgtgatggaaaaatacggcatcctcggcgtggaaatggaagcggctggtatctacggcgtcgctgcagaatttggcgcgaaagccctgaccatctgcaccgtgtctgaccacatccgcactcacgagcagaccactgccgctgagcgtcagaccaccttcaacgacatgatcaaaatcgcgctggaatccgttctgctgggcgataaagagtaattgtgttttgctgaaaggcgattgtcgtgtgaagccggagtgggagactgctccggctttttattatctattcatttctctctccagcttgaatattttcgctatacttttcagtgaaatgtgttaataaatctattcaagtatctattcacgaatctattcattaatgagcgaattgaccgatcttttattgcaagggccgcgttctgccccggaattgcgccagcgtctggcaatcagtcaggcgacgttctcacgccttgttgccagagaagatcgggtgattcgctttggtaaagcacgggcaacgcgatatgcactgctgcgtccttatcgcggaattgagcgtattcccgtatggcgagtggatgatgccggaaaggcgcataaattcgccgacatccggttgtgctggccgcagggaagttgtctggtaacaggcgcagatggcgacgaacggtggtttgatggtttgccctggtatttgaccgatctgcgaccgcaggggtttttggggcgcgcgtggggcaggaagttagccgcgcaactgaatcttactgaagatatccgtctctggcaggaagaagatgtgctctacgccctgaccgtatttagcggtgaatacaccggcggctggctggtcggggaggggaattatcagcgatggattactgcacaacgccctgcggcaattcctctggatcaaaaactcacccattacgaacaactggcaagcgatgcactggcaggagaaattgtgggttcttctgcgggcggtgagcagccaaaatttacctgctatgcacaaacgccgtcaggcaataaacatgtgctggttaaattcaccgtgccacagcaaaccgcggtcagccaacgttggggcgacttgcttattgcggaatctattgccgcgcaaatcctgcgcgacggcgggatccacgccatcgagtcaacggtgcttgtaacaagtaacaggcaggtattccttgaagcggaacgatttgactgcaaaggtaacgatggtcgcttgcccattgtgtcgctggaggcggtgcagagtgagtttatctcttctccgggatcgtggccggaggctatgcgccgtttgtgtgagcaacaacttgtcactcaccagagcgtggcgcaaacagaagtgatctgggcgtttgggcgacttatcgccaacagcgatatgcacgcaggcaatttatcattttatttatctgaaccaccatttgcgctgacgcccgtctacgacatgctgccgatggcctatgcaccaaacagcgccggaatgttgcgtgatgctgccattgaggtgaggtttgatcttaacgtcagtaaaagtgcatggttaacggcgatcccgctggcgcagcagttctggcaaacggtcgccggagatccgcgtatcagcgaggcatttcgccacattgcacaagaaatgccggaaaaaatccggcaaatcgaagggaaagttgcccgcatgggcgggtaactatcgcaccgcccccgctatccatgccgacaactcccgtagctctttttcctgttccgggaagtcaaccagcagcgcttcgcactcctgttgcagcatatccgcgcggtacagacagccttgcagtcgcccggcgagggcttccagcggcgcggggttgagactgtcggtaaacacctgggcgcgggtgatatggcctttttcaacgtcgaaatgcagttccacgccgccccaggtaaagcgttcatccagcagatgcgagaatgccggagcctgaccgaagttccattcccagctactctggcgggcaaaggtttcggcgaagtttggcaagtctggcgttttgtccggggagatgatttccgcttccacgcgctcgccataatgggcgaaaaaggcctcggttatggcctcgcaaacctgctcatgggtgatccccggtagcaattcggtcagattggtcacgcgggaacgcactgaggtaatgcctttcgccgccagtttctttttatccggattgagatagtttgccaggcggctaaggtcggaattgagcagcaaagtgccgtggtggaagccacgatctttggtttcgcgataggccgagcctgagactttgcgatcgccttcggcggttttcaccaccagatcgttacgcccggaagcttcggcgctgacgccgagcgcgttcagcgcattgagcacaatcgacgtggagatagttttatcgtactccggcttgccagccataaaggtaaaacaggtattgccgagatcgtggaacactgcgccgccaccgctactgcgccgcgccaggcggacgttatcttcttccatccgccgggtattacactctttccacgggttctgcgcgcgaccaatcactaccgtgtcggcattgcgccagagaaacagaacgcgctgcgtagccggcatctggcgaaaaatacactcctctaccgccaggttaaaccacgggtcgtaagagtcagagatgagcaggcgtaatgtggacataacgatttcctttcttgtagtaatgggtcactcttttttctcgctttcttcctcttccggcaccggtttactggcggttaacaggaagggcgattgctgccagcgggtgcgtttaccctgtagcagcgtgcgggtcagcactacgccgattgccagcgagagcagcaacatcaggcgtaaaatgttagtggtgttatccacctgttgggcttcggtggcgagcgtatgggtgtcgagcgtcaggcgcagatagccgagcggtccgtttttacccgcaatgggttcgacaatctgctggttaaaatagccgcccgcttttttgccgtcgagcgccagtcggtcgcgcacgtcgacgctttcgccagaacgggcgataagatcgccttgctcatcatatacgcctgcgtcgagaatgcggctttcatccgttaactgatcgaggatcgcctgaatgcgtttttcatccggtgagtcggtacgcatccgcggtgcaacgtttagcgtcacctgccgcgccagggtgcgggccagttcttccagctgtggattacgctgtcgctggtggttttgactaaaccatgacgctccctgcatcagcgccactaacaaggcaagacagaacaggacaatcactgcccgatgcagccggaatttcagttttgtgcgagccatcttccaccctttgaaaatttgagacttaatgttgccagaagcaatggatacaaggtagcctcatgcgttattttccctgcttcgaacgattttacaggagccttaatgcctaacattacctggtgcgacctgcctgaagatgtctctttatggccgggtctgcctctttcattaagtggtgatgaagtgatgccactggattaccacgcaggtcgtagcggctggctgctgtatggtcgtggactggataaacaacgtctgacccaataccagagcaaactgggcgcggcgatggtgattgttgccgcctggtgcgtggaagattatcaggtgattcgtctggcaggttcactcaccgcgcgggctacgcgcctggcccacgaagcgcagctggatgtcgcgccgctggggaaaatcccgcacctgcgcacgccgggtttgctggtgatggacatggattccaccgccatccagattgaatgtattgatgaaattgccaaactggccggaacgggcgagagggtggcggaggtaaccgaacgggcgatgcgcggcgaactcgattttaccgccagcctgcgcagccgcgtggcgacgctgaaaggcgctgacgcgaacattctgcaacaggtgcgtgaaaatctgccgctgatgccaggcttaacgcagctggtactcaagctggaaacgctgggctggaaagtggcgattgcctccggcggctttactttctttgctgaatacctgcgcgacaagctgcgcctgacagccgtggtagccaatgaactggagatcatggacggtaaatttaccggcaatgtgatcggcgacatcgttgacgcgcagtacaaagcgaaaactctgactcgcctcgcgcaggagtatgaaatcccgctggcgcagaccgtggcgattggcgatggagccaatgacctgccgatgatcaaagcggcagggctggggattgcctaccatgccaagccaaaagtgaatgaaaaaacggaagtcaccatccgtcacgctgacctgatgggtgtattctgcatcctctctggcagcctgaatcagaagtaattgcctgcccgtcatcctgcgggcggcacagcattaacgaggtacaccgtggcaaaagctccaaaacgcgcctttgtttgtaatgaatgcggggccgattatccgcgctggcaggggcagtgcagcgcctgtcatgcctggaacaccatcaccgaggtgcgtcttgctgcgtcgccaacggtggcgcgtaacgagcgtctcagtggctatgccggtagcgccggagtggcaaaagtccagaaactttccgacatcagccttgaagagctgccgcgtttttccaccggatttaaagagttcgaccgcgtactaggcggcggcgtggtgccgggaagtgccattctgattggcggtaacccaggtgccgggaaatccacgctgctgttgcaaacgctgtgcaaactggcgcagcagatgaaaacgctgtatgtcaccggcgaagagtcgctgcaacaggtggcaatgcgcgctcatcgccttggcctgccgactgacaatcttaatatgctgtcggaaaccagcatcgagcagatctgcctgattgccgaagaagagcaaccgaagctgatggtaattgactccatccaggtgatgcatatggcggatgtacaatcatcgcctggcagcgtggcacaggtgcgtgaaacggcggcttatctgacgcgcttcgccaaaacgcgcggtgtggcgattgtcatggtcgggcacgtaaccaaagatggctcgctggctggccctaaagtgctggaacactgtatcgactgttcggtgcttttggatggtgatgccgactcacgttttcgcaccttacgcagccataaaaaccgcttcggcgcggtgaatgagctgggtgtcttcgcaatgaccgagcaggggctgcgtgaagtcagcaacccttcggcaattttcttaagtcgcggcgatgaagtgacctccggtagctcagtgatggtagtgtgggaaggaacgcgtccgctgctggtggagattcaggcgctcgtcgatcactcgatgatggcgaatccacgccgcgtggcagtcgggctggagcaaaaccgtctggcaatcctgctggcggtgcttcaccgtcacggtggtctacaaatggccgatcaggatgtgtttgttaacgtggtcggtggcgtgaaggtgacggaaaccagtgccgatttagcgttactgctggcgatggtttccagcctgcgtgacagaccgctaccgcaggatctggtggtgtttggtgaagtcgggctggcaggggagatccgcccggtgcccagcggccaggaacgaatctcagaagcggcgaaacacggttttcgccgggcaattgttccggcagctaacgtgccgaaaaaagcgccggaagggatgcagatttttggcgttaaaaaactctccgacgcgcttagcgtgttcgacgacttataatgagagatacggagggagatatgtcgtcatttgattacctgaaaactgccatcaagcaacagggctgcactctacagcaggtagctgatgccagcggtatgaccaaagggtatttaagccagttactgaatgccaaaattaaaagccccagcgcacaaaagctggaggcattgcaccgttatttgggacttgaatttccccggcagaagaaaacgatcggtgtcgtattcggtaagttttacccgctgcatactggacatatctaccttatccagcgcgcctgtagccaggttgacgagctgcatatcattatgggttttgacgatacccgcgaccgcgcattgttcgaagacagcgccatgtcgcagcagccaaccgtgccggatcgtctgcgctggttattgcagacctttaagtatcaaaaaaatatccgcattcatgcttttaacgaagagggcatggaaccgtatccacacggctgggatgtgtggagcaacggcatcaaaaagtttatggccgaaaaaggcattcagccggacctgatctacacctcggaagaagccgatgcgccgcagtatatggaacatctggggatcgagacggtgctggtcgatccgaagcgtacctttatgagtatcagcggtgcgcagatccgcgaaaacccgttccgctactgggaatatattcctacggaagtgaagccattctttgtgcgtaccgtggcgatcctcggtggtgaatcgagcggtaaatccaccctggtaaacaaacttgccaatatcttcaacactaccagtgcgtgggaatatggtcgtgattatgtcttttcgcacctcggtggcgatgagatcgcgttgcagtattccgactacgataaaatcgcgctgggacatgcgcaatatattgattttgcagtgaaatatgccaataaagtggcgtttatcgacaccgattttgtcactacccaggcgttctgcaaaaagtacgaagggcgtgagcatccgttcgtgcaggcgttgattgatgagtaccgtttcgatctggtgatcctgctggagaacaacacgccgtgggtggcggatggtttacgcagcctcggcagttcggtggatcgcaaagagttccagaacttgctggtggagatgctggaagagaacaatatcgaattcgtgcgggttgaagaggacgattacgacagccgtttcctgcgctgcgtggagctggtgcgggagatgatgggggagcaaagataatcatctttataagatgttgagtgggattactgattcaaaagtgtacttagtactccatttcggtgtacaatgtacctgccagggagggggaatgggtaaggcgataatatttatagagacgccaatgtttacgcgtcagatcaagcagattgcaaccgatgatgaattaaaggaattacaaaaagaactcatcggaactcccgataaaggtgatctcattcagcagactggtggattgcgtaaagtccgaatggctgcgggttcacagggaaaaagtggcagtgtcagaataatttactttctggcgacggaagagattatttatttgattatggcctatccgaaaaatgccaaagatagtctgacagatacggaaaaagctcaactaaagaagttgacgaaactgctcaaaggcgagatataaaatgagtttttttgatgagttgaaaacctctctggaagaggctgtcgagattaaacaaggtttaaaagaacctgcacgggtgacccgctacgaaattgcggatgttaaagctattcgtgagcaactcaacgtttctcaaagtgagatggcaaaagctctgggaaccagtgtggataccattaaaagctgggaatcgaagcgaagaaatcctacgggattggctgcaaaagtacttgccacaattaaagaaaatcctgcctttttccgggaacttgcttcccattaatcatttaactaataccggatgcgatgctggtgcgccgcatccggcattttacgcattacttcgcaatacgcttgtacttgatacgcttcggctccagcgcgtctgcgcccagcgtgcgtttcttgtactcttcgtactcggtaaagttaccttcgaagaactcaactttaccttcatcctggtaatccagaatgtgggtggcgatacggtcgaggaaccaacggtcgtgcgagataaccatcgcgcagcccgggaactccagcagggcgttttccagtgcgcgcagggtttcgatatccaggtcgttggttggttcgtcgagcagcagcatgttgccgccaacctgcagcagcttcgccagatgcagacgaccgcgctcaccgccggagagttcgccaacgcgtttaccctgatcaacccctttaaagttaaagcggccaacgtaggcgcggcttggcatctcggtgttgccgatcttcatgatatccagcccgccggaaacttcttcccaaacggttttgctgttatccattgagtcacggaactgatcaaccgacgccagtttcaccgtttcacccaaagtgatggtgccgctgtccggctgttcctgaccagagatcatacggaacagcgtcgatttacccgcaccgttcggaccgatgatcccgacgatcgctcctttcgggatcgagaagctcagggagtcaatcagcagacgatcaccataggatttacgcaggttgctgacttccagcactttatcgcccagacgcggtccaggtggaataaacagttcgttggtttcgttacgtttctgatattcggtgctgttgagttcttcaaagcgcgccagacgtgctttaccttttgactgacggcctttagttccctgacgtacccactccagctctttctcgatcgacttacgacgcgccgcttcttgtgaagcttcctgcgccagacgctgatctttctgctccagccaggaggagtagttaccttcccacggaataccttcaccgcggtcaagttcgaggatccagcccgcaacgttatcgaggaagtaacggtcgtgggtaatcgccaccacggtgccttcgaagtcgtgcaggaagcgttccagccacgctacggattccgcatccaggtggttggtcggttcgtcgagcagcagcatgtctggtttttccagcagcaggcggcacaacgccacgcgacgacgctcaccaccggaaaggttagcgattttcgcgtcccagtccggcagacgcagcgcatccgccgcacgctccagctgaacgttcaggttgtgaccgtcgtgagcctgaatgatctcttccagacggccttgttcagcggccagcttgtcaaaatcggcatccggatcggcatacagcgcatacacttcatccaggcgtttcagggcgttaaccacttcagaaaccgcttcttcaatggactcacgaacggtgtgttccgggttcagctgcggttcctgcggcagataaccaatcttgatgtctggctgcggacgtgcttcaccttcgatgtctttatcaatgcccgccataatgcgcagcagggtggacttacccgcgccgttcagacccaggacaccaatttttgccccagggaagaaactcagagagatgtttttcaaaatatgacgtttcggcggaacaactttgccgacacgatgcatggtataaacgaattgagccacgttggacttcgcctctatgtttatcgtgatgatgagttttcaaaggcgaagtgtagcctgtttccctgtctaatcccagccagtcgatcaccccgtaaaagtaaaaaagtgtccgtaacgtggcgtaaacggcaatgactggttagcataaatctattacgcggcatgacgctgcattgatgtattgacacttagaggatgcgcttgtggaaaaagccaaacacgttacctggcggctgttggctgtcggtgtctgtctgctgacggtcagcagcgtggcgcgagccgactcactggatgagcagcgtagtcgttacgcgcaaatcaagcaggcctgggataatcgacaaatggatgtggtcgaacaaatgatgcctggactgaaagattacccactttatccctacctggaataccgccagatcactgatgacctgatgaatcaaccggcggtgacggtcactaactttgttcgcgctaaccccacgcttcctcccgctcgcacgctgcaatctcgtttcgtcaatgaactggcgcggcgtgaagactggcgtggcttgttagcctttagcccggaaaagcccggaactaccgaagcgcaatgtaattactactatgcgaaatggaacaccgggcagagtgaagaagcctggcaaggggcgaaagagctgtggctaaccggcaagagccagcctaacgcctgtgacaagttatttagcgtctggcgtgcgtcaggtaaacaagatccgctggcgtatttagagcgtatccgtctggcgatgaaagcgggtaacaccggcctggtaacagtgctggcagggcagatgcctgccgattaccagactatcgcttcggcaatcatttcactggcgaacaaccctaatacggtactgaccttcgcgcgtacaaccggcgcgaccgattttacccgtcaaatggcggcggtggcgtttgccagtgtggcgcggcaggatgctgaaaatgcacggctgatgatcccgtcgcttgctcaggcacagcagcttaatgaagatcagattcaggagctgcgcgatattgtcgcatggcgtttgatgggcaacgatgtcaccgacgagcaggcgaaatggcgcgatgacgcgattatgcgttcgcaatctacttcgcttattgaacgccgtgtgcgaatggcgcttggcaccggcgatcgtcgcggcctgaatacctggctggcgcgtctgcctatggaagcgaaagagaaagatgaatggcgttactggcaggcggatttattgctggaacgcggacgtgaagctgaagcaaaagagattttgcatcaactcatgcaacagcgtggtttctacccgatggttgctgcacaacgcatcggcgaagagtatgagctgaagattgataaagcgccgcagaatgttgacagcgccctgactcaggggccggagatggcgcgcgtgcgcgagttgatgtactggaatctcgataacaccgcgcgtagcgagtgggccaatctggtgaagagcaagtcaaaaacagagcaggctcaactggctcggtatgctttcaataaccaatggtgggatcttagcgttcaggcaacgatcgccgggaagctgtgggatcatctggaagagcgattcccgctggcttacaacgatcttttcaaacgctacaccagtggtaaggagatcccgcaaagctatgcgatggcgattgcccgtcaggagagtgcctggaatccgaaagtgaaatcaccggtaggggccagcggcctgatgcagattatgcctggtaccgcgacccatacggtgaagatgttctctattcccggttatagcagccctgggcaattgctggatccggaaacaaacatcaacattggcaccagttacctgcaatatgtttatcagcagtttggcaataaccgtattttctcctcagcagcttataacgccgggccagggcgggtgcgaacctggcttggcaacagcgcagggcgtatcgacgcagtggcatttgtcgagagtattccattctccgagacgcgcggttatgtgaaaaacgtgctggcttatgacgcttactaccgctatttcatgggggataaaccgacgttgatgagcgccacggaatggggacgtcgttactgatccacacgtttatgatatgctatcgtactctttagcgagtacaaccgggggaggcattttgcttcccccgctaacaatggcgacatactatggcccaacaatcaccctattcagcagcgatggcagaacagcgtcaccaggagtggttacgttttgtcgacctgcttaagaatgcctaccaaaacgatctccatttaccgttgttaaacctgatgctgacgccagatgagcgcgaagcgttggggactcgcgtgcgtattgtcgaagagctgttgcgcggcgaaatgagccagcgtgagttaaaaaatgaactcggcgcgggcatcgcgacgattacgcgtggatctaatagtctgaaagccgcgcccgtcgagctgcgccagtggctggaagacgtgttgctgaaaagcgattgattttgtaggcctgataggacatggcgcatcaggcatcgtgcaccgaatgccggatgcggcgtgaacgcctaatcaggcctgcaatggctgatacacggcattatgaaacggactcagcgccaggatcaccgcctggtgatagacgctggtgcgagtgagtttcccggcggtaaacacgccgatcgccccttccttacgaccaatctcatcaataccggtataacgcgacatcacgggaccaagcgcctcaccttcacgcactttttccagaatcaccgcaggcaacggcaaagtagccgaacgcgcctcgccgcgctggctggtgttttcaatcaccacccaactgaaagtgctgtcaccatcgatgccagcttcaatcgccacccaaaaatcagcctcaggaagtaaacggcgggcattggctaccctatttcgtgcgccagcgcgcgtttcctcactgccaaagggctgttccggtacaccgctctcgacggcaacggatgcaatatggcaggatccttcgccgaagatctcgtgaaatgcctgcagaatggcctgaattttagcgggattggtggtcgcacagacaacttggtgcataatcagcattactcagaaaattaacgttacagcagtatacggaaaaaaagcatgttacaggtatacctagtccgccacggtgaaacgcagtggaacgccgagcgacgtattcagggccagtctgacagcccgctgaccgccaaaggtgagcaacaggcgatgcaggtggcaacccgtgccaaagagcttggcattacgcatatcatcagtagcgatttaggacggacccggcgcacggcggaaatcatcgcccaggcctgcggctgtgacatcatctttgattctcgcctgcgtgaattaaatatgggtgtactggaaacaagaaatatcgattcactcaccgaagaagaagagaactggcgtcggcagctggtcaatggcaccgttgacgggcgtattcctgaaggcgagtcaatgcaggagctcagcgatcgcgttaatgcggcactggaatcttgccgggacttaccgcagggaagccgaccgctactggtgagccatggtattgcactgggatgcctggtgagtacgattctcggattaccagcatgggcagagcgccgcttacgtctgcgtaactgttctatttcgcgcgtggattatcaggaaagcttgtggctggcgtctggctgggtggttgaaaccgcaggggacatctcgcatctggacgcccctgcattagatgagctgcagcgttaacgacggatcggaatcagcagttcacagcgcagattaattgggcgatctcccgctttggcatcttctgccgggtagtatcgctcaatatcctgacctttacggcgcgtcaagttaagcattggcatgcacgttccgtataccgtcaggataaactcctgcacgccggttcccagaccttcataggtaaacatcacatattcgccgccctgcaacatcaccggatgcccagtcagtacatagccatctgcctgatcctgagctaacgcggtggtgtagaacacctcttgttcgtcgtctttatcctggctcggacgtgtttcgttcaaaccgtaaagcactggtggaatggttggcgagttgccgagaaaatcgtgccagaactggtagcgcatttcatggcggaaatcagagatttgctccagcgaacaggagtagctctgggtaacaccaatcagcggcgtatcttccagggtgacaaatttgtgctctggcatagtgaattcacccagacgcagcggcgggcgaataccaaaggcgctccattcaggagaacggcggtaaagtgcaggagtctgggcaaactgcttcttgaaagcgcgggtaaatgtctgttgagagtcgaagcggtattgcagcgcgatgtccagaatcggacgcgcagtcaggcgtagtgcgaccgccgatttcgacaaacgacgagcacgaatatacgcgccaatagcatggccagtgacatctttaaacattctctgtaagtgccacttggaataacctgctttcgccgctacattgtcgagcgacaggggatgatccagatgaccttccagccagattaaaaggtcgcgaataatgccggcctgatccataaaatatcctcatcctttcaacaacgagcacctgacatcaggtaattggataatagcattttttgctgttttagcattcagtgtttttttcttagtcgagtatgttttaggtcttgacggaaataaaagtattgagattttgttcttaatcaatatgttatttaccgtgacgaactaattgctcgtgtaatagataaaaatggtaacgatatgaaatacaagcatttaatcctgtctttaagcctgataatgctggggccattggctcatgcagaagagattggttcggtcgacaccgtatttaaaatgatcggcccggatcacaaaattgttgttgaagcctttgacgatcccgatgtgaaaaatgtcacctgttatgtgagccgggcgaaaaccggtggtattaaagggggattgggcctggcagaagatacctccgatgcggccatttcttgtcaacaagtcgggccgattgaattgtcggatcgtattaaaaacggcaaagctcagggcgaggtagtattcaaaaaacgcacgtccctggtctttaagtcgttacaggtcgtgcgcttttatgacgctaaacgcaacgcgctcgcttatctggcttactccgacaaagttgtagaaggttcgccgaaaaacgcgattagcgcggttcctgtcatgccgtggcggcaataacagaggcgatttatgcaacgggaaacggtctggttagtcgaagacgagcaagggatagccgatacgctggtctacatgttgcaacaggaaggttttgacgtcgaggtctttgagcgaggcttgccagtgctggataaagctcgccagcaggttcccgatgtcatgattctcgatgttggtttgcctgatatcagcggctttgaattgtgccgccagttactggcgctccatccggcgttacctgtactgttcctgacggcccgaagtgaagaggtcgatcgcctgcttgggctggaaattggcgctgacgactacgtggctaaaccgttttcacctcgcgaagtgtgcgccagagtgcgcaccttactgcgtcgggtgaagaagttctcgactccgtctcccgttatccgtattggtcattttgaattgaatgaacctgcggcgcagatcagctggtttgacacgccattaacgctgacgcggtatgagtttttattgctgaagacgttactcaagtcgccgggccgcgtctggtcccgccagcaactgatggatagcgtgtgggaagatgcgcaggacacctacgatcgcaccgtcgatacccacattaaaacgctgcgtgccaagctgcgcgccatcaaccccgatctttcaccgattaatactcatcgcggcatgggatatagcctgaggggcctgtaatgcgtatcggcatgcggttgttgctgggctattttttactggtggcggtggcggcctggttcgtactggctatttttgtcaaagaagttaaaccgggcgtgcgaagagcaaccgaggggacgttaatcgacaccgcaacgttgctggcggagctggcgcgtcccgatttgctctctggggacccaacgcatgggcaactggcgcaggcgtttaatcagctacaacatcgcccgtttcgcgccaatatcggtggcattaacaaagtgcgcaacgaatatcatgtctatatgaccgatgcgcagggcaaagtattgttcgattcggcaaataaagccgttggacaggattattcgcgctggaatgacgtctggctaacgttgcgtggtcagtatggtgcgcgcagcacgttgcaaaatcctgccgatcccgaaagttctgtgatgtatgttgccgcgccgattatggacggctcgcggcttattggcgttttgagcgtaggcaaaccgaacgcggcgatggctccggtcattaagcgtagcgagcggcgaattttatgggccagcgccattttgttggggattgcactggtgattggcgcaggcatggtttggtggatcaaccgctctattgccaggctcactcgctatgctgattccgtcactgacaataagcccgttcctctccccgatctcggtagtagcgagttgcgtaaactcgcgcaggcgctggaaagtatgcgcgtgaagctggaagggaaaaactatattgagcagtatgtttatgcgttaactcatgagctaaaaagcccactggcggcgattcgtggcgcggcggaaattttacgcgaaggtccgccgccggaagtggtggctcgttttaccgacaacattctgacgcaaaatgcgcgaatgcaggcactggtggaaacgttactacgccaggcaagactggagaatcgtcaggaagtcgttctgactgctgttgatgtggcggcattatttcgccgcgtcagcgaagcgcgcaccgtgcagttggcagaaaaaaacatcactttgcatgttatgcctactgaggttaacgttgcttctgaaccggcgttactggagcaggcgctggggaatttactggataacgccatcgattttactcccgagagcggttgcataacgctaagcgccgaagtggatcaggaatacgtcacccttaaggtgctggataccggtagtgggattcctgactacgcgctgtcacgtatttttgaacgcttttactctttgccgcgtgcaaatgggcaaaaaagcagcggtctggggttggcgtttgtcagtgaggtcgcccgtttgtttaacggcgaagtcacgctgcgcaacgtgcaggaaggtggcgtgctggcctcgcttcgacttcaccgtcacttcacatagcttcaaattcttcccacatagccttcgtatcctgctgtcattgcaaaggagaagactatgttgaaatcccccctgttctggaaaatgaccaccttgtttggtgcagtattgctgttgttgattccgataatgctgattcggcaggtgattgtcgaacgtgccgattaccgtagcgatgtggaagatgtgattcgccaaagtaccagcgggccgcaaaaactcgttgggccgctcatcgctattcctgtgaccgagctttatacggtgcaggaagacgataaaaccgtggagcggaaacgaagttttattcatttttggttacctgagtcattgatggttgatggcaatcagaatgtggaagaacgcaagataggcatctataccggtcaggtctggcacagtgatttaacgctaaaagccgatttcgatgtttcgcgtcttagcgaactcgacgcgccaaatatcaccttaggcaagccatttattgtgattagcgtcggggatgcgcgtggtattggtgtggtgaaagcgcctgaagttaacggtacggcgctgaccattgaacccggcaccgggttagagcaaggcgggcagggcgtgcatatccctttacccgaaggggactggcgcaagcagaacctgaagctgaatgtggcgctgaatttaagcggtaccggcgatctttctgtggtgcctggcgggcgttatagcgaaatgaccttaaccagcaactggccgcatcccagttttttaggtgattttctaccagccaaacgggaagttagcgagtcaggttttcaggcgcaatggcaaagtagctggtttgctaataatctcggtgagcgttttgcttcaggcaatgataccggctgggaaaacttccccgcgtttagcgtcgcagtgacgacgccagccgatcaataccaattaacggaccgggcgactaagtacgccattctgctgattgcgctgacttttatggcattctttgtttttgaaacgctcaccgcgcaacgtttacacccaatgcaatatttgctggtggggctttcattggtgatgttttatttgctcttgctggcgctttctgaacataccggttttaccgtggcatggataatcgccagtctgattggggcgttaatgaacggtatttatttgcaggcggtattgaaaggctggcgtaatagcatgttgtttaccctcgcgctgttgttgctggatggtgtgatgtggggactgctcaactctgccgatagcgcgctgttgttgggaaccagtgtgctggtggtggcgctggccggcatgatgtttgtgacccgtaatatcgactggtatgcgttttcactgccgaaaatgaaagccagtaaagaagttaccatggacgatgaattacgtatctggaaataaggtagaaaaataaaaacggcgctaaaaagcgccgtttttattgacggtggtaaagccgattaatcttccagatcaccgcagaagcgataaccttcaccgtgaatggtggcgatgatttccggcgtatccggcgtagattcgaaatgtttacgaatacggcggatcgtcacatctacagtacggtcgtgcggtttcagctcacggccggtcattttcttcagcagttcagcacgggactgaattttgcctgggttttcacagaagtgaagcatggcgcggaactcgctgcgcggcagcttgtactgctcgccatcagggccgatcaacgaacggctgttgatgtccagttcccaaccattgaacttgtagctttcaacgctacgacgttcttcgctgacagtacccagattcatggtacgggacagcaggttgcgtgcacgaatagtcagttcacgcgggttgaacggtttggtgatgtagtcatctgcaccgatttcgaggccgagaattttatcgacttcgttgtcacggccagtcaggaacatcaacgcaacattcgcctgctcgcgcagttcacgcgctaacagaagaccgttcttacccggcagattgatatccatgatcaccaggttgatgtcatattcagagaggatctgatgcatttccgcgccatctgtcgcttcgaaaacatcatagccttccgcttcgaaaatacttttcaacgtgttgcgtgttaccaactcgtcttcaacgataagaatgtgcggggtctgcatgtttgctacctaaattgccaactaaatcgaaacaggaagtacaaaagtccctgacctgcctgatgcatgctgcaaattaacatgatcggcgtaacatgactaaagtacgtaattgcgttcttgatgcactttccatcaacgtcaacaacatcattagcttggtcgtgggtactttccctcaggacccgacagtgtcaaaaacggctgtcatcctaaccattttaacagcaatataacaggctaagaggggcaggacacccaataaaactacgcttcgttgacatatatcaagttcaattgtagcacgttaacagtttgatgaaatgatcgtatctaaatgctagctttcgtcacattattttaataatccaactagttgcttcatacaactaataaacgtggtgaatccaattatcgagatttattttttataaaattatcctaagtaaacagaaggatatgtagcattttttaacaattcaatcgttagtacagtcaggaaatagtttagctttttttaagctaagcaaagggcttttcctgcgacttacgttaagaatttgtaaattcgcaacgcgtaataagttgacaatgatcaccctgttcgcggttatttggtcaagaagagtggcaatatgcgtataacgattattctggttgcacccgccagagcagaaaatattggggcagcggcgcgggcaatgaaaacgatgggttttagcgaactgcggattgttgatagtcaggcacacttggagccagtcgcccgttgggtcgcacatggatctggtgatattattgataatattaaagttttcaagacactagctgaatcgttacacgatgtcgatttcactgttgccaccactgcgcgcagtcgggcgaaatatcattactacgctacgccagtagaactggtgccgctgttagaggaaaaatcttcatggatgagccatgccgctctggtgtttggtcgcgaagattccgggctgactaacgaagagttagcgttggctgacgttcttactggtgtgccgatggtggcggattatccttcgctcaatctggggcaggcagtgatggtctattgctatcaattagcaacattaatacaacaaccggcgaaaagtgacacaacggcagaccaacatcaactgcaagctttacgcgaacgagccatgacattgctgacgactctggcagtggcagatgacataaaactggtcgactggttacaacaacgcctggggcttttagagcaacgagacacggcaatgttgcaccgtttgctgcatgatattgaaaaaaatatcaccaaataaaaaacgccttagtaagtgattttcagcttttcattctgactgcaacgggcaatatgtctctgtgtggattaaaaaaagagtgtctgatagcagcttctgaactggttacctgccgtgagtaaattaaaattttattgacttaggtcactaaatactttaaccaatataggcatagcgcacagacagataaaaattacagagtacacaacatccatgaaacgcattagcaccaccattaccaccaccatcaccattaccacaggtaacggtgcgggctgacgcgtacaggaaacacagaaaaaagcccgcacctgacagtgcgggcttttttttcgaccaaaggtaacgaggtaacaaccatgcgagtgttgaagttcggcggtacatcagtggcaaatgcagaacgttttctgcgggttgccgatattctggaaagcaatgccaggcaggggcaggtggcgaccgtcctctctgcccccgccaaaattaccaaccatctggtagcgatgattgaaaaaaccattagcggccaagatgctttacccaatatcagcgatgccgaacgtatttttgccgaacttctgacgggactcgccgccgcccagccgggatttccgctggcacaattgaaaactttcgtcgaccaggaatttgcccaaataaaacatgtcctgcatggcattagtttgttggggcagtgcccggatagcatcaacgctgcgctgatttgccgtggcgagaaaatgtcgatcgccattatggccggcgtgttagaagcgcgtggtcacaacgttaccgttatcgatccggtcgaaaaactgcttgcagtggggcattacctcgaatctaccgttgatattgctgagtccacccgccgtattgcggcaagccgcattccggctgaccacatggtgctgatggctggtttcactgccggtaatgaaaaaggcgagctggtggttctgggacgcaacggttccgactactccgctgcggtgctggcggcctgtttacgcgccgattgttgcgagatctggacggatgttgacggtgtttatacctgcgatccgcgtcaggtgcccgatgcgaggttgttgaagtcgatgtcctatcaggaagcgatggagctttcttacttcggcgctaaagttcttcacccccgcaccatcacccccatcgcccagtttcagatcccttgcctgattaaaaataccggaaatcctcaagctccaggtacgctcattggtgccagccgtgatgaagacgaattaccggtcaagggcatttccaatctgaataacatggcaatgttcagcgtttccggcccggggatgaaagggatggttggcatggcggcgcgcgtctttgcagcgatgtcacgcgcccgtatttccgtggtgctgattacgcaatcatcttccgaatacagtatcagtttctgcgttccgcaaagcgactgtgtgcgagctgaacgggcaatgcaggaagagttctacctggaactgaaagaaggcttactggagccgttggcggtgacggaacggctggccattatctcggtggtaggtgatggtatgcgcaccttacgtgggatctcggcgaaattctttgccgcgctggcccgcgccaatatcaacattgtcgccattgctcagggatcttctgaacgctcaatctctgtcgtggtcaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggttgaagaataaacatatcgacttacgtgtctgcggtgttgctaactcgaaggcactgctcaccaatgtacatggccttaatctggaaaactggcaggaagaactggcgcaagccaaagagccgtttaatctcgggcgcttaattcgcctcgtgaaagaatatcatctgctgaacccggtcattgttgactgtacttccagccaggcagtggcggatcaatatgccgacttcctgcgcgaaggtttccacgttgttacgccgaacaaaaaggccaacacctcgtcgatggattactaccatcagttgcgttatgcggcggaaaaatcgcggcgtaaattcctctatgacaccaacgttggggctggattaccggttatcgagaacctgcaaaatctgctcaatgctggtgatgaattgatgaagttctccggcattctttcaggttcgctttcttatatcttcggcaagttagacgaaggcatgagtttctccgaggcgaccacactggcgcgggaaatgggttataccgaaccggacccgcgagatgatctttctggtatggatgtggcgcgtaagctattgattctcgctcgtgaaacgggacgtgaactggagctggcggatattgaaattgaacctgtgctgcccgcagagtttaacgccgagggtgatgtcgccgcttttatggcgaatctgtcacagctcgacgatctctttgccgcgcgtgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctgacatggttaaagtttatgccccggcttccagtgccaatatgagcgtcgggtttgatgtgctcggggcggcggtgacacctgttgatggtgcattgctcggagatgtagtcacggttgaggcggcagagacattcagtctcaacaacctcggacgctttgccgataagctgccgtcagagccacgggaaaatatcgtttatcagtgctgggagcgtttttgccaggagcttggcaagcaaattccagtggcgatgactctggaaaagaatatgccgatcggttcgggcttaggctccagcgcctgttcagtggtcgcggcgctgatggcgatgaatgaacactgcggcaagccgcttaatgacactcgtttgctggctttgatgggcgagttggaagggcgtatctccggcagcattcattacgacaacgtggcaccgtgttttcttggtggtatgcagttgatgattgaagaaaacgacatcatcagtcagcaagtgccagggtttgatgagtggctgtgggtgctggcgtatccggggattaaagtctcgacggcagaagccagggctattttaccggcgcagtatcgccgccaggattgcattgcgcacgggcgacatctggcaggcttcattcacgcctgctattcccgtcagcctgagcttgccgcgaagctgatgaaagatgttatcgctgaaccctaccgtgaacggttactgccaggcttccggcaggcgcggcaggcggttgcggaaatcggcgcggtagcgagcggtatctccggctccggcccgactttgttcgctctgtgtgacaagccggataccgcccagcgcgttgccgactggttgggtaaaaactacctgcaaaatcaggaaggttttgttcatatttgccggctggatacggcgggcgcacgagtactggaaaactaaatgaaactctacaatctgaaagatcacaatgagcaggtcagctttgcgcaagccgtaacccaggggttgggcaaaaatcaggggctgtttttcccgcacgacctgccggaattcagcctgactgaaattgatgagatgctgaagctggattttgtcacccgcagtgcgaagatcctctcggcgtttattggtgatgaaatcccgcaggaaatcctggaagagcgcgtacgcgcggcgtttgccttcccggctccggtcgccaatgttgaaagcgatgtcggttgtctggaattgttccacgggccaacgctggcatttaaagatttcggcggtcgctttatggcacaaatactgacccatattgcgggcgataagccagtgaccattctgaccgcgacatccggtgatactggagcggcagtggctcatgctttctacggtttaccgaatgtgaaagtggttatcctctatccacgaggcaaaatcagtccactgcaagaaaaactgttctgtacattgggcggcaatatcgaaactgttgccatcgacggcgatttcgatgcctgtcaggcgctggtgaagcaggcgtttgatgatgaagaactgaaagtggcgctggggctaaactctgctaactccattaacatcagccgtttgctggcgcagatttgctactactttgaagctgttgcgcagctgccgcaggaagcgcgcaaccagctggttgtctcggtgccaagcggaaacttcggcgatttgacggcgggtctgctggcgaagtcactcggtctgccggtgaaacgttttattgctgcgaccaacgtgaacgataccgtgccacgtttcctgcacgacggtcagtggtcacccaaagcgactcaggcgacgttatccaatgcgatggatgttagccagccaaacaactggccgcgtgtggaagagttgttccgccgcaaaatctggcaactgaaagagctggggtatgcagccgtggatgatgaaaccacgcaacagacaatgcgtgagttaaaagaactgggctatacctcggagccgcacgctgccgtagcttatcgtgcgctgcgtgaccagttgaatccaggcgaatatggcttgttcctcggcaccgcgcatccggcgaaatttaaagagagcgtggaagcgattctcggtgaaacgttggatctgccaaaagagctggcagaacgtgctgatttacccttgctttcgcataacctgcccgccgattttgctgcgttgcgtaaattgatgatgaatcatcagtaacatctattcattatctcaatcaggccgggtttgcttttatgcagcccggcttttttatgaagaaaatatggagaaaaacgacagggaaaaaggagaaattctcaataaatgcggtaacttagagattaggattgcggagaataacaactgccgttctcatcgcgtaatctccggatatcgacccataacgggcaatgataaaaggagtaacctgtgaaaaagatgcaatctatcgtactcgcactttccctggttctggtcgctcccatggcagcgcaggctgcggaaattacgctagtcccgtcagtaaaattacagataggcgatcgtgataatcgtggctattactgggatggcggtcactggcgcgaccacggctggtggaaacaacattatgaatggcgaggcaatcgctggcacccatatggaccgccgccatcgccgcgccataacaagcacaatgatcatcgtggcgatcatcgtccggagccggacaaacatcatcgctaaatatcaatgccggattaccatccggcattgactacaaacttaacgctgctcgtagcgtttaaacaccagttcgccattgctggaggaagcttcatcaaagaagtaaccttcgctattaaaaccagtcagttgctctggtttggtcagccgattttcaataatgaaacgactcatcagaccgcgtgctttcttagcgtagaagctgattatcttaaatttgccgttcttctcatcgaggaacactggcttgataatctcggcattcaatttcttcggcttcaccgatttaaaatactcatctgacgccagatttatcaccacattatcgccttgtgctgcgagcgcctcgttcagcttgttggtgatgatatctccccagaattgatacagatctttccctcgggcattctcaagacgtatccccatttccagacgataaggctgcattaaatcgagcgggcgcagtacgccatacaagccggaaagcattcgcaaatgctgttgggcaaaatcgaaatcgtcttcgctgaaggtttcggcctgcaagccagtgtagacatcacctttaaacgccagaattgcctggcgggcattctccggtgtgaaatttggctgccagtcatgaaagcgagcggcgttgatacccgccagtttgtcgctgatgcgcatcagggagctaatctgcgggggcgtcagtttccgcgcttcatggatcagctgctgggcgttgtctaacagctccggcagcgtatagcgcgtggtggtcaacgggctttggtaatcaagcgttttcgcaggtgaaataagaatcagcatatccagtccttgcaggaaatttatgccgactttagcaaaaaaagagaatgagttgatcgatagttgtgattactcctgcgaaacatcatcccacgcgtctggagaaagctggcgaccgatctccggataacgcaacggatcaaacaccggacgcacgccgagtttacgctggcgtagataatcactggcaatggtatgaaccacaggcgagagcagtaatatggcggtcaaattggtaatagccatgcaggccataatgatatctgccagttgccacatcagcggaagacttagcaaggtgccgccgatgaccgttgcgaaggtgcagatccgcagacaccagatcgctttagggttgttcaggcgtaaaaagaagagattgttttcggcataaatgtagttggtaacgatggagctgaaggcaaacagaataaccacgagggtaacaaactccgcaccccaggaacccattagcacccgcatcgccttctggataagctgaataccttccagcggcatgtaggttgtgccgttacccgccagtaatatcagcatggcgcttgccgtgcagatgaccagggtgtcgataaaaatgccaatcatctggacaattccttgcgctgccggatgcggaggccaggacgcagctgccgctgccgcgtttggcgtcgaccccattcccgcctcattggaaaacatactgcgctgaaaaccgttagtaatcgcctggcttaaggtatatcccgccgcgccgcctgcagcttcctgccagccaaaagcactctcaaaaatagaccaaatgacgtggggaagttgcccgatattcattacgcaaatcaccaggcaggtcagtacccagattatcgccatcaacgggacaaacccctgcatgagccgggcgacgccatgaagaccgcgagtgatcgccagcagagcaaagacagcgagaataatacctgttaccagcgggggaaaatcaaaagaaaaactcagagctcgcgcaacggcgttcgcctgaactccgctgaaaattatggcgtaggcgatgagcaaaaagacggcgaacagaacgcccatccagcgcatccccagcccgcgcgccatataccatgccggtccgccacgaaactgcccattggcatcacgttctttataaagctgtgcgagggaacattcggcaaacgaggtcgccatgccgataaatgcggcaacccacatccagaagacggctccaggtccaccggcggtaattgccagcgcaacgccggccaggttgccgctacccacgcgcgctgcaagactggtacacaatgactgaaatgaggttaaaccgcctggctgtggatgaatgctatttttaagacttttgccaaactggcggatgtagcgaaactgcacaaatccggtgcgaaaagtgaaccaacaacctgcgccgaagagcaggtaaatcattaccgatccccaaaggacgctgttaataaaggagaaaaaatctggcatgcatatccctcttattgccggtcgcgatgactttcctgtgtaaacgttaccaattgtttaagaagtatatacgctacgaggtacttgataacttctgcgtagcatacatgaggttttgtataaaaatggcgggcgatatcaacgcagtgtcagaaatccgaaacagtctcgcctggcgataaccgtcttgtcggcggttgcgctgacgttgcgtcgtgatatcatcagggcagaccggttacatccccctaacaagctgtttaaagagaaatactatcatgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggccgtaaatattggtctggaaatcctgaaactggttccgggccgtatctcaactgaagttgatgcgcgtctttcctatgacaccgaagcgtcaattgcgaaagcaaaacgcctgatcaaactctacaacgatgcaggtattagcaacgatcgtattctgatcaaactggcttctacctggcagggtatccgtgctgcggaacagctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggtttctgtatctgaaatctaccagtactacaaagagcatggttatgaaaccgtggttatgggcgcaagcttccgtaacatcggcgaaattctggaactggcaggctgcgaccgtctgaccatcgcaccggcactgctgaaagagctggcggagagcgaaggggctatcgaacgtaaactgtcttacactggtgaagtgaaagcgcgtccggcgcgtatcactgagtccgagttcctgtggcagcacaaccaggatccaatggcagtagataaactggcggaaggtatccgtaagtttgctgttgaccaggaaaaactggaaaaaatgatcggcgatctgctgtaatcatacttagcgtgaccgggaagtcggtcacgctacctcttctgaaacctgtctgtcactcccttcgcagtgtatcattctgtttaacgagactgtttaaacggaaaaatcttgatgaatactttacgtattggcttagtttccatctctgatcgcgcatccagcggcgtttatcaggataaaggcatccctgcgctggaagaatggctgacatcggcgctaaccacgccgtttgaactggaaacccgcttaatccccgatgagcaggcgatcatcgagcaaacgttgtgtgagctggtggatgaaatgagttgccatctggtgctcaccacgggcggaactggcccggcgcgtcgtgacgtaacgcccgatgcgacgctggcagtagcggaccgcgagatgccaggctttggtgaacagatgcgccagatcagcctgcattttgtactaactgcgatcctttcgcgtcaggtgggggtgattcgcaaacaggcgctgatccttaacttacccggtcaaccgaagtctattaaagagacgctggaaggtgtgaaggacgctgagggtaacgttgtggtgcacggtatttttgccagcgtaccgtactgcattcagttgctggaagggccatacgttgaaacggcaccggaagtggttgcagcattcagaccgaagagtgcaagacgcgaagttagcgaataaaaaaatccccccaagcggggggatcagactgatgacaaacgcaaaactgcctgatgcgctacgcttatcaggcctacgatcttcttgcaatatattgaatttgcacgattttgtaggccggataaggcgttcacgccgcatccggcataaacaaagcgcacgttgttaacaatcttatcccttcgagcggggggagcttaacaattagtgagactcaccaatcggcagaacggtgcgaccaaactgctcgttcagcacttcacccatcgccagatagattgcactggcaccgcagataagaccaatccagccggcaaagtggatgatcgcggcgttaccggcaatgttaccgatcgccagcagggcaaacagcacggtcaggctaaagaaaacgaattgcagaacgcgtgcgcctttcagcgtgccgaagaacataaacagcgtaaatatgccccacagacccaggtagacaccaaggaactgtgcatttggcgcatcggtcagccccagtttcggcatcagcagaattgcaaccagcgtcagccagaaagaaccgtaagaggtgaatgcggttaaaccgaaagtgttgccttttttgtactccagcagaccggcaaaaatttgcgcgatgccgccgtagaaaatgcccatggcaagaataataccgtccagagcaaaataacccacgttgtgcaggttaagcagaatggtggtcatgccgaagcccatcaggcccagcggtgccggattagccaacttagtgttgcccataattcctcaaaaatcatcatcgaatgaatggtgaaataatttccctgaataactgtagtgttttcagggcgcggcataataatcagccagtggggcagtgtctacgatcttttgaggggaaaatgaaaattttccccggtttccggtatcagacctgagtggcgctaaccatccggcgcaggcaggcgatttgcagtacggctggaattgtcacgcgataggcactgccgctgaccgctttaaccccatttaatgctgcgcccacagggcctcccagacccgcgccgcgcagcaaaccatgcccaagcacgctcattgctgcgtgggtgcgtaaaatgcgggtcaattggctggaaagcaaatgcgacacaccttttgccaataatttgtctttcatcagcagcggcagcagctcttccagctcattcaccctggcatcgaccgcgtgcagaaactcctgcttatgttcctcgtccattttcttccaggtattacgcagaaattgttccagtaactgttgctcaatttcaaacgtagacatctctttgtcggctttcagcttcaatcgctttgaaacatcgagcaaaatggcgcgatacaatttaccgtgtccgcgcagtttgttggcgatactatcgccaccaaaatgctgtaattctccggcaatcagctgccagttgcggcggtgtcgctcgggatgtccttccatcgatttaaacagttcgttgcgcatcagtacgctggagaggcgagttttgcctttttcattatgggtgagcagccgggcgaaatttgccaactgttcctcactacaatgctggagaaaatccagatctgaatcattcaggtaattaacattcattttttgtggtttctatattctggcgttagtcgtcgccgataattttcagcgtggccatatccgatgagttcactgtatgaccggaaaaggtgatttttgagacgcagcgtttgttgtcgttatcgctgttaatgttgatccagtcagtggtttgctcttcttttatttctgaaggaatattcagggtctgactggcgcttcgggtggctttgaaataaatcgatgcaccgcttaactgcaaatcgccatggtcggctgagagttgtatgcgtttaacaatgcgacaaacaggaagtttcagcgccagatcgttggtttcgtttcgcggcattgcaatgacgccgaggattttatggtcgtttgcctgcgccgtgcagcacagcatcaggctaatcgccaggctggcggaaatcgtaataacggatttcataaggattctcttggtggggaggggtaaggggatgaaactagtttactgctgataaagagaagtttcaggtacgtaatattttctttttattacaattttttgatgaatgccttggctgcgattcattctttatatgaataaaattgttgtcagtttcacgtcttgtcctgccatatcgcgaaatttctgcgcaaaagcacaaaaaatttttgcatctcccccttgatgacgtgggttacgaccccatttagtagtcaaccgcagtgagtgagtctgcaaaaaaatgaaattgggcagttgaaaccagacgtttcgcccctattacagactcacaaccacatgatgaccgaatatatagtggagacgtttagatgggtaaaataattggtatcgacctgggtactaccaactcttgtgtagcgattatggatggcaccactcctcgtgtactggagaacgccgaaggcgatcgcaccacgccttctatcattgcctatacccaggatggtgaaactctggttggtcagccggctaaacgtcaggcagtgacgaacccgcaaaacaccctgtttgcgattaaacgcctgattggccgccgcttccaggacgaagaagtacagcgtgatgtttccatcatgccgttcaaaattattgctgctgataacggcgacgcatgggtcgaagttaaaggccagaaaatggcaccgccgcagatctctgctgaagtgctgaaaaaaatgaagaaaaccgctgaagattacctgggtgaaccggtaactgaagctgttattaccgtaccggcatactttaacgatgctcagcgtcaggcaaccaaagacgcaggccgtatcgctggtctggaagtaaaacgtatcatcaacgaaccgaccgcagctgcgctggcttacggtctggacaaaggtactggcaaccgtactatcgcggtttatgacctgggtggtggtactttcgatatttccattatcgaaatcgacgaagttgacggcgaaaaaaccttcgaagttctggcaaccaacggtgatacccacctgggtggtgaagacttcgacagtcgtctgatcaactatctggttgaagaattcaagaaagatcagggcattgacctgcgcaacgatccgctggcaatgcagcgcctgaaagaagcggcagaaaaagcgaaaatcgaactgtcttccgctcagcagaccgacgttaacctgccgtacatcactgcagacgcgaccggtccgaaacacatgaacatcaaagtgactcgtgcgaaactggaaagcctggttgaagatctggtaaaccgttccattgagccgctgaaagttgcactgcaggacgctggcctgtccgtatctgatatcgacgacgttatcctcgttggtggtcagactcgtatgccaatggttcagaagaaagttgctgaattctttggtaaagagccgcgtaaagatgttaacccggacgaagctgtagccatcggtgctgctgttcagggtggtgttctgactggtgacgtaaaagacgtactgctgctggacgttaccccgctgtctctgggtatcgaaaccatgggcggtgtgatgaccacgctgatcgcgaaaaacaccactatcccgaccaagcacagccaggtgttctctaccgctgaagacaaccagtctgcggtaaccatccatgtgctgcagggtgaacgtaaacgtgcggctgataacaaatctctgggtcagttcaacctggatggtatcaacccggcaccgcgcggcatgccgcagatcgaagttaccttcgatatcgatgctgacggtatcctgcacgtttccgcgaaagacaaaaacagcggtaaagagcagaagatcactatcaaggcttcttctggtctgaacgaagatgaaatccagaaaatggtacgcgacgcagaagctaacgccgaagctgaccgtaagtttgaagagctggtacagactcgcaaccagggcgaccatctgctgcacagcacccgtaagcaggttgaagaagcaggcgacaaactgccggctgacgacaaaactgctatcgagtctgcgctgactgcactggaaactgctctgaaaggtgaagacaaagccgctatcgaagcgaaaatgcaggaactggcacaggtttcccagaaactgatggaaatcgcccagcagcaacatgcccagcagcagactgccggtgctgatgcttctgcaaacaacgcgaaagatgacgatgttgtcgacgctgaatttgaagaagtcaaagacaaaaaataatcgccctataaacgggtaattatactgacacgggcgaaggggaatttcctctccgcccgtgcattcatctaggggcaaatcaaaaaagatggctaagcaagattattacgagattttaggcgtttccaaaacagcggaagagcgtgaaatcaaaaaggcctacaaacgcctggccatgaaataccacccggaccgtaaccagggtgacaaagaggccgaggcgaaatttaaagagatcaaggaagcttatgaagttctgaccgactcgcaaaaacgtgcggcatacgatcagtatggtcatgctgcgtttgagcaaggcggcatgggcggcggcggttttggcggcggcgcagacttcagcgatatttttggtgacgttttcggcgatatttttggcggcggacgtggtcgtcaacgtgcggcgcgcggtgctgatttacgctataacatggagctcaccctcgaagaagctgtacgtggcgtgaccaaagagatccgcattccgactctggaagagtgtgacgtttgccacggtagcggtgcaaaaccaggtacacagccgcagacctgtccgacctgtcatggttctggccaggtgcagatgcgccagggtttctttgccgtgcagcagacctgtccacactgtcagggccgcggtacgctgatcaaagatccgtgcaacaaatgtcatggtcatggtcgtgttgagcgcagcaaaacgctgtccgttaaaatcccggcaggggtggacactggagaccgcatccgtcttgcgggcgaaggtgaagcgggtgaacacggcgcaccggcaggcgatctgtacgttcaggttcaggttaaacagcacccgattttcgagcgtgaaggcaacaacctgtattgcgaagtcccgatcaacttcgctatggcggcgctgggtggtgaaatcgaagtaccgacccttgatggtcgcgtcaaactgaaagtgcctggcgaaacccagaccggtaagctgttccgtatgcgcggtaaaggcgtcaagtctgtccgcggtggcgcacagggtgatttgctatgccgcgttgttgtcgaaacaccggtaggtttgaacgagaagcagaaacagctgctgcaagagctgcaagaaagctttggtggcccaaccggcgagcacaacagcccgcgttcaaagagcttctttgatggcgtgaagaagttttttgacgacctgactcgctaacctccccaaaagcctgcccgtgggcaggccagggtaaaaaccagggtgcgttgaagatatgcgagcacctgtaaagtggcggggatcactccccgccgttgctcttactcggattcgtaagccgtgaaaacagcaacctccgtctggccagttcggatgtgaacctcacagaggtcttttctcgttaccagcgccgccactacggcggtgatacagatgacgatcagggcgacaatcatcgccttatgctgcttcattgctctcttctccttgaccttacggtcagtaagaggcactctacatgtgttctgcatatagggggcctcgggttgatggtaaaatatcactcggggcttttctctatctgccgttcagctaatgcctgagacagacagcctcaagcacccgccgctattatatcgctctctttaacccattctgttttatcgattctaatcctgaagacgcctcgcatttttgcgtaatcaatctttagtacattgtttattttaactcttatgtgcgttttcatttacaaaagttgagattatgaacaagaggtttaagttatgcctgaatggtgagttattactggagaaagtaatagaagatacaaaatattcttgtacagaattgaattttctttttgtgaggaaaaatgtttataaatcaatgagtgatatttaaaatcgacacactttttgaaacacgatacctccacacccgggggtaaaagtaatctgcgatctccatcacgctttgccattcacctttaaatatactttctgagtcgttcttaatcaaaatgaattatctgatgtattgatttctatggaaccataaaaaaaatgaatggagagcatattatatgtctgccaaaagacggcttcttattgcgtgtgccctgacaacgattttctatcaccttcctgcatattcttcattagaatataaaggttcctttggctcaataaatgcaggttatgctgactggaatagtggcttcattaacactcatcgtggtgaagtatggaaagtgactgcagactttggtgtgaattttaaagaagccgagttttactcattttatgaaagcaatgtgcttaaccatgccgtagcggggcgtaatcataccgtttctgctatgacacatgtcagactctttgactccaatatgactttctttggcaagatctatggtcaatgggataactcatggggtgacgatcttgatatgttttatggtttgggctacctcggctggaatggttcatgggggttttttaaaccgtatattggattacataatcaatctggagactacgtctcagccaaatatggacaaacaaatggctggaatggttatgttgttggctggacagcagtattaccttttacgttatttgacgaaaaatttgttttatctaactggaatgaaatagaactggacagaaatgatgcctatgcggaacaacaatttggtcggaatgggctaaatggcggtttaacagtagcctggaagttctatcctcgctggaaagccagtgtgacgtggcgttatttcgataataagttgggctacgatggttttggcgatcaaatgatttatatgcttggttatgatttctaattttcatcagggaataattatgcagaaaacattaatggccagtttgatcggccttgcagtttgcacagggaatgcttttaatccagtcgtagctgccgagactaaacaacccaatttagtcatcattatggcggatgatttaggctatggtgatttagcaacatatggacatcagatcgttaaaacacccaatattgacaggcttgcccaggagggcgtcaaatttactgactactatgcaccagctcccttaagttctccttcgcgggcggggttattaacggggcggatgccatttcgtaccggcatacgttcatggatcccaacgggaaaagatgtggcattagggcgtaatgaactcacgattgctaatctactcaaagcgcaagggtatgacacggccatgatgggtaagctgcatctgaatgcaggcggcgatcgcaccgatcagccgcaggcaaaagatatgggctttgattactcactggttaatacggcgggttttgttaccgacgccacgctggataacgctaaagaacgcccgcgttatggcatggtttacccgacaggctggctacgtaacgggcaacccactccacgagccgataaaatgagcggtgagtatgtcagttcggaagtcgtcaactggctggataacaaaaaggacagcaagcctttcttcctctatgttgcttttaccgaagtgcatagccccctggcttcgcccaaaaaatacctcgacatgtactcacaatatatgagcgcgtatcagaagcagcatcctgatttattttatggcgactgggcagacaaaccctggcgtggtgtgggggaatattatgccaatatcagctatctggatgcacaggttggaaaagtgctggataaaatcaaagcgatgggtgaagaagataacacaatcgttatttttaccagtgataacggtccggtaacgcgtgaagcgcgcaaagtgtatgagctgaatttggcaggggaaacggatggattacgcggtcgcaaggataacctttgggaaggcggaattcgtgttccagccattattaaatatggtaaacatctaccacagggaatggtttcagatacacccgtttatggtctggactggatgcctactttagcgaaaatgatgaacttcaaattacctacagaccgtactttcgatggtgaatcgctggttcctgttcttgagcaaaaagcattgaaacgcgaaaagccattaattttcgggattgatatgccattccaggatgatccaaccgatgaatgggcgatccgtgatggtgactggaagatgattatcgatcgcaataataaaccgaaatatctctacaatctgaaatctgatcgttatgaaacacttaatctgatcggtaaaaaaccagatattgaaaaacagatgtatggtaagtttttaaaatataaaactgatattgataatgattctctaatgaaagccagaggtgataaaccagaagcggtgacctggggctaacctgataatcataataaatgtaatgtatgccatttagggctatgcccgcctgattcagtgctacgcattgaatcaggttcttttcgcgttgaacaatatcaagatacggctattcgcagggagtggatatgtttaccaacgtaaatgttgattgttgcaaaacaccaggatgtaaaaacctggggttgctgaatagccaggattatgtcgcacagggtaaaaatattttatgccgtgaatgtggttacttgtttccagtgatatctgaacagtcgcttaatatttatcgtaatattgtgaatcactcctggagaggtttgatttgccaatgttcaacttgcggaggcacgtccctcaaaaaatatggatattctgcacaaggccagagaagaatgtattgccatcattgtgagaaaacatttatcactctggaacatgtaattaccacaccacgaggagccctgttagcattgatgattgagcaaggggaggcacttgcggatatcagaaagtcattacttcttaacagcactggacttagccgtgaactgttaaaattagcgcgtgaagcaaactataaagaaagtcgacagtgtttcccagcttctgatattaccctgagtacccgcgcttttcgcgtcaagtataatggtagcaataactctctttatgctcttgttaccgcagaagaacaaagcggcagggtggttgccatctcaaccaattactccccatctgccgtagagcaacattatcaatacacatcgaactatgaagagcgtatgtctccagggacgctggcacatcatgtccagcgcaaagagttacttactatgcggcgggataccttgtttgatattgattacggcccggcagttttacatcaaaacgatccgggaatgttggtaaaaccggttcttccggcatatcgtcattttgaactggtcagaatactgaccgatgagcattccaacaacgttcagcattaccttgatcacgaatgctttatattgggcggctgcctgatggctaatttgcagcatattcctcaaggtcgctgccatatttcctttgtcaaagagcgcggtgtggcacccgccaccattgattttccaccgcgattattccttagtggtggggtacgaaataatgtctggcgtgcattttctaaccgcaattattcaatggctgtatgcaatctcactggcagtaagaaagtccgcgagatgcggcatgcaacattgaacagtgcgacgcgttttatccactttgtggagaaccatcctttccttatatcattgaaccgaatgtctcctgcgaatgtcgtttctacattagatatcctcaaacatctgtggaataaaaaactagagcatggaacaatttaattattacttttccgaataatttcttcagaaatcttgacattagactatgattaatggggtttaaggtcatcagccgccgctttcgggcatcaaaaactcatctctcgctgatggcgcaattcttttaatagatcgtaaaaagcgagctattcctacactataatctgattttaacgatgattcgtgcggggtaaaatcgtgaaaacgatctattcacctgaagagaaataaaaagtgaaacatctgcatcgattctttagcagtgatgcctcgggaggcattattctcattattgccgctgtattagcgatgattatggccaacagcggtgcaaccagtggatggtatcacgactttcttgagacgccggttcagctccgggttgggacacttgagatcaacaagaacatgctgctatggatcaatgacgctctgatggcggtatttttcctgttggttggtctggaagttaaacgcgagctgatgcaaggttcgctggccagtctgcgccaggcggcatttcctgttattgccgcaatcggcgggatgattgtcccggcattgctctatctggcttttaactatgccgatccgattacccgcgaaggctgggcaatcccggcggcgactgacattgcctttgcacttggtgtgttggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgtggtattgaatctgtgtggtgtacgccgcacgggcgtttatattctggttggcgtggtgctgtggacagcggtgttgaaatcgggggttcacgcaaccctggctggcgtcattgtcggcttctttattcctttgaaagagaagcatgggcgctctccggctaaacgtctggagcatgttttgcatccatgggtggcgtatctgattttgccgctgtttgcatttgctaatgctggcgtttcactgcaaggtgtcacgctggaaggtttgacctccatcctgccattagggatcatcgctggtttgctgattggcaagccactgggtattagtctgttctgctggttggcgctgcgtttgaaattggcacatctgccagagggaacgacttaccagcaaattatggcggttggtatcctgtgcggtatcggttttactatgtctatctttattgccagcctggcatttggtagcgtagatccagaactgattaactgggcaaaattaggtatccttgtcggttcaatttcttcggcggtaattggatatagctggttacgcgttcgtttacgtccatcagtttgacaggacgatgtactggggagccataaacggctcccttttcattgttatcagggagagaaatgagcatgtctcatatcaattacaaccacttgtattacttctggcatgtctacaaagaaggttctgtggttggcgcagcggaggcgctttatttaacaccacaaaccattaccgggcagatccgggcgctggaagagcgcctgcaagggaaactatttaagcgtaaaggacgtggtctggaacccagcgaactgggggaactggtctatcgctatgccgataaaatgttcaccttaagccaggaaatgctggatatcgtcaactatcgcaaagagtccaacttattgtttgatgttggtgtggcagatgcactttccaaacgtctggtcagcagtgttctggatgccgcagttgtggaagacgagcagatccatctacgctgtttcgaatcgacgcacgagatgcttttagagcagttgagtcagcataaactggatatgatcatctctgactgtccgatcgattccactcagcaggaagggctgttttccatgaaaattggcgaatgtggtgtcagtttctggtgcactaacccactaccagaaaagccgtttcctgcctgtcttgaagagcgtcgtttacttattccggggcgtcgctcaatgttggggcgtaagctattaaactggtttaactcccagggcttgaacgtcgaaattttgggtgagtttgatgatgctgcgttgatgaaagcctttggggcgacgcataacgctattttcgttgcaccttcgctttacgctaatgatttctataacgatgactcggttgtggagataggccgtgttgagaacgtgatggaagagtaccacgcgatttttgccgaaaggatgattcagcaccctgcagtacagcgtatctgcaatacagactattctgcgctgtttactccagcttcaaaataaacatttgtactttgcaggccgaattttggcctgcagatggatataaaaaannnnncattccattcattaattaattaatgaatgaatgnnnnncgcttcttagctgatttgatattagccaaggtccaactcccaaatgtgttctatatggacaattcaaaggccgaggaatatgcccttttagccttcttttgtcaatggatttgtgcaaataagcgccgttaatgtgccggcactcgttacgtagtgatggcgcaggattctaccagcttgcggggtgtgaatacagcttttccgcgagaaaaattgcagcaggcggtcagtttcttcccatgatttgcgccatagcaatgaaaagccacttctttctgatttcggtactcaatcgccggttaaccttgaccgctgtacaaggtatactcggacgattttcactgttttgagccagacatgaagctgatacgcggcatacataatctcagccaggccccgcaagaagggtgtgtgctgactattggtaatttcgacggcgtgcatcgcggtcatcgcgcgctgttacagggcttgcaggaagaagggcgcaagcgcaacttaccggtgatggtgatgctttttgaacctcaaccactggaactgtttgctactgataaagccccggcacggctcacccggctgcgggaaaaactgcgttatcttgcagagtgtggcgttgattacgtgctgtgcgtgcgttttgacaggcgttttgcggcgttaaccgcgcaaaacttcatcagtgatcttctggtgaagcacttgcgggtaaaatttcttgccgtaggtgacgatttccgctttggcgctggtcgtgaaggcgatttcttgttattacagaaagcgggcatggaatacggcttcgatatcaccagcacgcaaactttttgcgaaggtggcgtgcgtatcagcagcaccgccgtgcgtcaggcgcttgcggatgacaatctggctctggcagaaagtttactggggcacccgtttgccatctccgggcgtgtagtccacggtgatgaattagggcgcactataggtttcccgacggcgaatgtaccgctacgccgtcaggtttccccggtgaaaggggtttatgcggtagaagtgttgggccttggcgaaaagccgttacccggcgttgcaaacatcggaacacgcccaacggttgccggtattcgccagcaactggaagtgcatttgttagatgttgcaatggacctttatggtcgccatatacaagtagtgctgcgtaaaaaaatacgcaatgagcagcgatttgcatcgctggacgaactgaaagcgcagattgcgcgtgatgaattaaccgcccgcgaattttttgggctaacaaaaccggcttaagcctgttatgtaatcaaaccgaaatacggaaccgagaatctgatgagtgactataaatcaaccctgaatttgccggaaacagggttcccgatgcgtggcgatctcgccaagcgcgaaccgggaatgctggcgcgttggactgatgatgatctgtacggcatcattcgtgcagctaaaaaaggcaaaaaaaccttcattctgcatgatggccctccttatgcgaatggcagtattcatattggtcactcggttaacaagattctgaaagacattatcattaagtccaaagggctttctggatatgactcgccgtatgtgcctggctgggactgtcatggtctgccaatcgagctgaaagtagagcaagaatacggtaagccgggggagaaattcaccgccgctgagttccgcgccaagtgccgcgaatacgctgcgacccaggttgacggtcagcgcaaagactttatccgtctgggcgtgctgggcgactggtcgcacccgtacctgaccatggacttcaaaactgaagccaacatcatccgcgcgctgggcaaaatcatcggcaacggtcacctgcacaaaggcgcgaagccggtgcactggtgcgttgactgccgttctgcactggcagaagcggaagttgagtattacgacaaaacttctccgtccatcgacgtcgctttcctggcggtcgatcaggatgcgcttaaaacgaaatttggcgtaagcaatgttaacggcccaatttcgctggttatatggaccaccacgccgtggacgctgcctgctaaccgcgcaatctccattgcacctgattttgattatgcgctggtgcaaatcgacggtcaggccgtgatcctcgcgaaagatctggttgaaagcgtaatgcagcgtatcggcgttagcgattacaccattcttggcacggtgaaaggtgccgagctggaactgttgcgctttacccatccgtttatggacttcgatgttccggcaattctcggcgaccacgttacgctggatgccggtaccggtgccgttcataccgcgccaggccacggtccggacgactatgtgatcggtcaaaaatatggtctggaaaccgctaacccggttggcccggacggcacttatctgccgggtacttacccgactctggatggcgttaacgtcttcaaagcgaacgatattgtcattgcgttgttgcaggaaaaaggcgcactgttgcacgttgagaaaatgcaacacagctatccgtgctgctggcgtcataaaacgccgatcatcttccgcgcgacgccgcagtggttcgtcagcatggatcagaaaggtctgcgtgcgcagtcactgaaagagatcaaaggcgtgcagtggatccctgactggggccaggcgcgtatcgagtcgatggttgctaaccgtcctgactggtgtatctctcgtcagcgtacctggggcgtgccgatgtcactgttcgtgcacaaagacacagaagaactgcatccgcgtactctcgaactgatggaagaagtggcaaaacgcgttgaagttgacggcattcaggcgtggtgggatctcgatgcgaaagagatcctcggcgacgaagctgaccagtatgtgaaagtaccggatacgctggatgtatggtttgactccggatctacccactcttccgttgttgatgtgcgtccggaatttgccggtcacgcagcggacatgtatctggaaggttctgaccaacaccgtggctggttcatgtcttccctgatgatctctaccgcgatgaagggcaaagcgccatatcgtcaggtactgactcacggctttaccgtggatggtcagggtcgcaagatgtctaaatccatcggtaacaccgtttcgccgcaggatgtgatgaacaaactgggtgcggatattctgcgtctgtgggtggcatcaaccgactacactggcgaaatggccgtttctgacgagatcctgaaacgtgctgccgacagctatcgtcgtatccgtaacaccgcgcgcttcctgctggcaaacctgaacggttttgatccggcaaaagatatggtgaaaccggaagagatggtggtactggatcgctgggccgtaggttgtgcgaaagcggcacaggaagacatcctcaaagcgtacgaagcatacgatttccacgaagtggtacagcgtctgatgcgcttctgctccgttgagatggggtccttctacctcgacatcatcaaagaccgtcagtataccgccaaagcggacagcgtggcgcgtcgtagctgccagactgcgctgtatcacatcgcagaagcgctggttcgctggatggcaccaatcctctccttcaccgctgatgaagtgtggggttacctgccgggcgaacgtgaaaaatacgtcttcaccggcgagtggtacgaaggcctgtttggtctggcagacagtgaagcaatgaacgatgcgttctgggacgagctgttgaaagtgcgtggcgaagtgaacaaagtcattgagcaagcgcgtgccgataagaaagtgggcggctcgctggaagcggcagtaaccttgtatgcagaaccggaactggcggcgaaactgaccgcgctgggcgatgaattacgatttgtcctgttgacctccggcgctaccgttgcagactataacgacgcacctgctgatgcccagcagagcgaagtcctcaaagggctgaaagtcgcgttgagtaaagccgaaggtgagaagtgccctcgctgctggcactacacccaggatgtcggcaaggtggcggaacacgcagaaatctgcggccgctgtgtcagcaacgtcgccggtgacggtgaaaaacgtaagtttgcctgatgagtcaatcgatctgttcaacagggctacgctggctgtggctggtggtagtcgtgctgattatcgatctgggcagcaaatacctgatcctccagaactttgctctgggggatacggtcccgctgttcccgtcgcttaatctgcattatgcgcgtaactatggcgcagcgtttagtttccttgccgatagcggcggctggcagcgttggttctttgccggtattgcgattggtattagcgtgatcctggcagtgatgatgtatcgctcgaaggccacgcagaagctaaacaatatcgcttacgcgctgattattggcggcgcactgggcaacctgttcgaccgcctgtggcacggcttcgttgtcgatatgatcgacttctatgtcggcgactggcacttcgccaccttcaaccttgccgatactgccatttgtgtcggtgcggcactgattgtgctggaaggttttttaccttctaaagcgaaaaaacaataataaaccctgccggatgcgatgctgacgcatcttatccggcctacagattgctgcgaaatcgtaggccgcatccggcaaaaatcctcaaaatataagagcaaacctgcatgtctgaatctgtacagagcaatagcgccgtcctggtgcacttcacgctgaaactcgatgatggcaccaccgctgagtctacccgcaacaacggtaaaccggcgctgttccgcctgggtgatgcttctctttctgaagggctggagcaacacctgctggggctgaaagtgggcgataaaaccaccttctcgctggagccagatgcggcgtttggcgtgccgtcaccggacctgattcagtacttctcccgccgtgaatttatggatgcaggcgagccagaaattggcgcaatcatgctttttaccgcaatggatggcagtgagatgcctggcgtgatccgcgaaattaacggcgactccattaccgttgatttcaaccatccgctggccgggcagaccgttcattttgatattgaagtgctggaaatcgatccggcactggaggcgtaacatgcagatcctgttggccaacccgcgtggtttttgtgccggggtagaccgcgctatcagcattgttgaaaacgcgctggccatttacggcgcaccgatatatgtccgtcacgaagtggtgcataaccgctacgtggtcgatagcctgcgcgagcgtggggctatctttattgagcagattagcgaagtaccggacggcgcgatcctgattttctccgcacacggtgtttctcaggcagtacgtaacgaagcgaaaagccgcgatttgacggtgtttgatgccacctgtccgctggtgaccaaagtgcatatggaagtcgcccgcgccagccgtcgtggtgaagaatctattctcatcggtcacgccgggcacccggaagtggaagggacgatgggccagtacagcaacccggaagggggaatgtatctggtcgaatcgccagacgatgtgtggaaactgacggtcaaaaacgaagagaagctctcctttatgacccaaaccacgctgtcggtggatgacacgtctgatgtgatcgacgcgctgcgtaaacgcttcccgaaaattgtcggtccgcgcaaagatgacatctgctacgccacgactaaccgtcaggaagcggtacgcgccctggcagagcaggcggaagtagtactggtggttggttcgaaaaactcctccaactccaaccgtctggcggaactggcccagcgtatgggcaagcgcgcgtttttgattgacgatgcgacagatatccaggaagagtgggtgaaagaggcgaaatgcgtcggcgtgactgctggcgcatcagctccggatattctggtacagaacgtagtcgcacgtttacagcagcttggcggtggcgaagccattccgctggaaggtcgtgaagaaaacattgttttcgaagtgccgaaagagctgcgtgtcgatattcgtgaagtcgattaagtcattagcagcctaagttatgcgaaaatgccggtcttgttaccggcattttttatggagaaaacatgcgtttacctatcttcctcgatacagaccccggcattgacgatgccgttgccattgccgccgcgatttttgcccccgaactcgatctgcaactgatgaccactgtcgcgggtaatgtttcggtagagaaaaccacccgcaacgccctgcaactgctgcatttctggaatgtggatattccgcttgcccagggcgctgccgtaccactggttcgtgcgccgcgcgatgcggcatctgtacacggtgaatcgggaatggctggctatgactttgttgaacacaaccgtcagccactgggtataccggcgtttctggcaattcgtgatgccctgatgcgtgcgccagagcccgttaccctggtggccatcggcccgttaaccaatattgcgctgttactttcacaatgcccggaatgtaagccgtatattcgccgtctggtgatcatgggcggttctgctggtcgcggcaactgcacaccaaacgccgagtttaatatcgctgccgatccagaagcggcagcctgtgtcttccgtagcggcatcgaaatcgtcatgtgcggtctggatgtcaccaatcaggcaatattaacccctgactatctcgctactttgccggaattgaatcgcaccggaaaaatgctacacgccctgtttagccactaccgtagcggcagtatgcaaagtggactacgtatgcacgatctttgcgctatcgcctggctggtgcgcccggaattgttcactctcaaaccgtgttttgtcgcggtagaaactcagggtgaatttacctcaggcacgacggttgttgatatcgacggttgcctgggcaaaccagccaatgtacaggtggcgctggatctggatgtgaaaggcttccagcaatgggtggctgaggtgctggccctggcgctctaataataaaacaaggaagtgttctatgacgtatggagaagcgtatctggaagggtggaaaaacatctttaattatgaaggtgtttccaatcgcttcgagttctggtcgtttatgattggtagtggcgttatctgtctgcttccgcttttatgttggtggttagcggtaacaattaacaatgactatggtgttttcattttttttgcgctgcccgcgtcatttattttaacgttgatttttgccataccggcgatagcgttagccgtcagaaggatgcacgatatcggatattcagggtggtgggttaccattgtcgtgttgatccctgttacgggcgtaattctgcttatactgtgctgcctgccgtcaaagtcacaagaccaggcataatgacagagggtatgacgcatcactttctgcgtcatgcctttcactgatatccctccctgtttatcattaatttctaattatcagcgtttttggctggcggcgtagcgatgcgctggttactctgaaaacggtctatgcaaattaacaaaagagaatagctatgcatgatgcaaacatccgcgttgccatcgcgggagccgggggccgtatgggccgccagttgattcaggcggcgctggcattagaaggcgtgcagctgggcgcggcgctggagcgcgaaggatcttctttactgggcagcgatgcgggcgaactggccggagccgggaaaacaggcgttactgtgcaaagtagtcttgatgcgataaaagatgattttgatgtgtttatcgattttacccgtccggaaggtacgctgaaccatctcgctttttgtcgccagcatggcaaagggatggtgatcggcactacggggtttgacgaagccggtaaacaggcgattcgtgacgccgccgccgatattgcgattgtctttgccgccaattttagcgttggcgttaacgtcatgcttaaactgctggagaaagcagccaaagtgatgggggactacaccgatatcgaaattattgaagcacatcatagacataaagttgatgcgccgtcaggcaccgcactggcaatgggagaggcgatcgcccacgctcttgataaagatctgaaagattgcgcggtctacagtcgtgaaggccataccggtgaacgtgtgcctggcaccattggttttgccaccgtgcgtgcaggtgacatcgttggcgaacataccgcgatgtttgccgatattggcgagcgtctggagatcacccataaggcatccagccgcatgacatttgctaacggtgcggtaagatcggctttgtggttgagtggtaaggaaagtggtctttttgatatgcgagatgtgcttgatctcaataatctgtaaccacaagatatttatggtgatgcaaaaacaacacatttaattcgttgaatataaagggctttaatttttggcccttttatttttagtgttatgcttttaaatctaatgcaaatgctgaaaattacatgttttgtattctgtttttgttgttttaatgtaaattttgaccatttggtccacttttttctgctcattttgatttcatgcaatcttcttgctgcgcaagcgttttccagaacatgttatatgatctttttgtcgcttaatgcctgtaaaacatgcatgagccacaaaataatataaaaaatcccgccattaagttgacttttagctcccatatctccagaatgccgccgtttgccagaaattcgtcggtaagcagatttgcattgatttacgtcatcattgtgaattaatatgcaaataaagtgagtgaatattctctggagggtgttttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcactaatgacgccgatgaagaatcttctcaggttcatgcccaaggtctggtgattcgcgacctgccgctgattgccagcaacttccgtaataccgaagacctctcttcttacctgaagcgccataacatcgtggcgattgccgatatcgatacccgtaagctgacgcgtttactgcgtgagaaaggtgctcagaatggctgcattatcgcaggcgataacccggatgcggcgctggcattagaaaaagcccgcgcgttcccaggtctgaacggcatggatctggcaaaagaagtaaccaccgcagaaccctatagctggacacaagggagctggacactgaccggcggcctgccagaagcgaaaaaagaagacgagctgccgtaccacgtcgtggcctacgatttcggtgccaagcgcaacatcctgcgtatgctggtggatagaggctgtcgcctgaccatcgttccggcgcaaacttctgcggaagatgtgctgaaaatgaatccggacggcatcttcctctccaacggtcctggcgacccggccccgtgcgattacgccattaccgctatccagaaattcctcgaaactgatattccggtattcggcatctgcctcggtcatcagctgctggcgctggcgagcggtgcgaagactgtcaaaatgaaatttggtcaccacggcggcaaccatccggttaaagatgttgagaaaaatgtggtgatgatcaccgcccagaaccacggttttgcggtggatgaagcaacattacctgcaaacctgcgtgtcacacataaatccctgttcgacggtacgttacagggcattcatcgtaccgataaaccggcgttcagcttccagggacacccggaagccagccctggtccacacgacgccgcgccgttgtttgaccactttatcgcgttaattgagcagtaccgtaaaaccgctaagtaatcaggagtaaaagagccatgccaaaacgtacagatataaaaagtatcctgattctgggtgcgggcccgattgttatcggtcaggcgtgtgagtttgactactctggcgcgcaagcgtgtaaagccctgcgtgaagagggttaccgcgtcattctcgtgaactccaacccggcgactatcatgaccgacccggaaatggctgatgcaacctacatcgagccgattcactgggaagtggtacgcaagattattgaaaaagagcgcccggacgcggtgctgccaaccatgggggggcagacggcgctgaactgtgcgctggagcttgagcgtcagggcgtgctggaagagttcggcgtcaccatgattggtgccactgccgatgcgattgataaagccgaagaccgccgccgtttcgacgtagcgatgaagaaaatcggtctggaaactgcgcgttccggtatcgctcattcaatggaagaagcgctggcggttgccgctgaagttggcttcccgtgcattattcgcccatcctttaccatgggcggtagcggtggcggtatcgcttataaccgtgaagaatttgaagaaatttgcgcccgcggtctggatctttctccgactaaagagctgctgattgatgagtcgctgatcggctggaaagagtacgagatggaagtggtgcgtgataaaaacgacaactgcatcatcgtctgctctatcgaaaactttgatgcgatgggcatccacaccggtgactccatcactgtcgcgccagcccaaacgctgaccgataaagaatatcaaatcatgcgtaacgcctcgatggcggtactgcgtgaaatcggcgttgaaaccggtggttccaacgtccagtttgcggtgaacccgaaaaacggtcgcctgattgttatcgaaatgaacccacgcgtgtctcgctcctctgcgctggcgtcgaaagccactggtttcccgattgccaaagtggcggcgaaactggcggtgggttacaccctcgacgagctgatgaacgacatcaccggtgggcgtactccggcctccttcgagccgtccatcgactatgtggttactaaaattcctcgcttcaacttcgagaaattcgccggtgctaacgaccgtctgaccactcagatgaaatcggttggcgaagtgatggcgattggtcgcacgcagcaggaatccctacaaaaagcgctgcgcggcctggaagtgggcgcaactggcttcgatccgaaagtgagtctcgacgacccggaagcgctgactaaaatccgccgcgaactgaaagatgctggcgcagagcgtatctggtatatcgctgatgccttccgcgcgggcctgtctgtagacggtgtatttaatttgaccaacattgaccgctggttcctggtacagattgaagagctggtgcgtctggaagagaaagtcgcagaagtgggcatcactggcctgcacgctgaattcctgcgccagctgaaacgcaaaggctttgccgatgcgcgtctggcaaaactcgcgggcgtgcgtgaagcagaaatccgcaagctgcgcgaccagtatgacctgcacccggtttacaagcgcgtggatacttgtgcggcagagttcgccaccgacaccgcttacatgtactccacttatgaagaagagtgcgaagcgaatccgtccaccgatcgtgaaaaaatcatggtgctcggcggcggcccgaaccgtatcggtcagggtatcgaattcgactactgctgtgtacacgcctcgctggcgctgcgcgaagacggttatgaaaccattatggttaactgtaacccggaaaccgtctccaccgactacgacacctctgaccgtctctacttcgagccggtaactctggaagacgtgctggaaattgtgcgtattgagaagccgaaaggcgttatcgtccagtacggcggtcagaccccgctgaaactggcgcgcgcgctggaagctgctggcgtaccggttatcggtaccagcccggatgccatcgaccgtgcggaagaccgtgaacgcttccagcatgcggttgagcgtctgaaactgaaacaaccggcgaacgccaccgttaccaccatcgaaatggcggttgagaaagcgaaagagattggctacccgctggtggtgcgtccgtcttacgttctcggcggtcgggcgatggaaatcgtctatgacgaagctgacctgcgtcgctacttccagacagcggtcagcgtatctaacgatgcgccagtgttgctggaccacttccttgatgacgcagtagaagttgacgtggatgccatctgcgacggcgaaatggtgctgattggcggcatcatggagcatattgagcaggcgggtgtgcactccggtgactccgcatgttcactgccagcttacaccttaagtcaggaaattcaggatgtgatgcgccagcaggtgcagaaactggccttcgaactgcaggtgcgcggcctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgtgtgatggctggcaaatcgctggctgagcagggcgtaaccaaagaagttatcccgccgtactactcggtgaaagaagtggtgctgccgttcaataaattcccgggcgttgacccgctgttagggccagaaatgcgctctaccggggaagtaatgggcgtgggccgcaccttcgctgaagcgtttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgactcacggcacggcgattgtgctgggcgaagcgggtatcaatccgcgtctggtgaacaaggtgcatgaaggccgtccgcacattcaggaccgtattaagaatggcgaatatacctacatcatcaacaccacctcaggtcgtcgtgcgattgaagactcccgcgtgatccgtcgcagtgcgctgcaatataaagtgcattacgacaccaccctgaacggcggctttgccaccgcgatggcgctgaatgccgatgcgaccgaaaaagtaatttcggtgcaggaaatgcacgcgcagatcaaataatagcgtgtcatggcggatatttttcatccgctaatttgatcgaataactaatacggttctctgatgaggaccgtttttttgtgcacagaaaacccccagctaggctgggggttccggaaagctttcagctttgagccagttattaaaaccccttttgatttgttaaaacaccttgcggtctggcaactgcaagtgtcaaacaagaaatcaaaagggggtcccaatggggaacgaaaagagcttagcgcacacccgatggaactgtaaatatcacatagtatttgcgccaaaataccgaagacaggtgttctacagagagaagcgtagagcaataggctgtattttgagaaagctgtgtgagtggaaaagtgtacggattctggaagctgaatgctgtgcagatcatatccatatgcttgtggagatcccgcccaaaatgagcgtatcaggctttatgggatatctgaaagggaaaagcagtctgatgccttacgagcagtttggtgatttgaaattcaaatacaggaacagggagttctggtgcagagggtattacgtcgatacggtgggtaagaacacggcgaagatacaggattacataaagcaccagcttgaagaggataaaatgggagagcagttatcgattccctatccgggcagcccgtttacgggccgtaagtaacgaagttggatgcaaatgtcagatcgtgtgcgcctgttagggcgcggctggtaagagagccttataggcgcatttgaaaaacctccggctatgccggaggatatttatttgcccattaagtaaatcttttggggaatcgatatttttgatgacataagcaggatttagctcacacttatcgacggtgaagttgcatactatcgatatatccacaattttaatatggccttgtttaattgctgcaaaacgagtcatagccagtcttttaatttgtgaaactggagttcgtatgtgtgaaggatgtgttgaaaaaccactctatttgttaatcgccgaatggatgatggctgaaaaccggtgggtgatagcaagagagatctctattcatttcgatattgaacacagcaaggcggttaataccctgacttatattctgtcggaagtcacagaaataagctgcgaagttaagatgatccctaataagctggaagggcggggatgccagtgccagcgactggtaaaagtggttgatatcgatgagcaaatttacgcgcgcctgcgcaataacagccgggataaattagtcggcgtaagaaagacgccgcgtattcctgccgttccgctcacggaacttaaccgcgagcagaagtggcagatgatgttgtcaaagagtatgcgtcgttaatgtcatttcgttgataccgtgcgacctggtcgctggatgcgatgctggcgcatcttatccggcctacggttgctttacagccaggtcggataaggcgtttatgccgcatccgacgatgttaccgtttcggcgtcacatccgtcgtcccctgcaaacgggggcgattttcctccatttgcctcagtggctgcgtttcatgtaacgctgcatgacagcgcccgacaagatcctgatactctttggtattcaaccgtttccagtgtaactcgtcgtcactcacgctgcgtacagcgcgggctggcgtacccatcaacaactggcgtttctcgccgcgaaagcccgctttgacaaagctcatagcggcaacaatgctctcttcgccaatgaccgcgccatccataatcacgctgttcatcccgaccagtgcatcgcgaccaatcacacaaccatgcaggatcgctccgtgcccgatatgaccgttttccccaacgatggtgtcagtgtcgcagtagccatgcataatgcagccatcctgaatattggctcccgcttgcacgatcaaccgcccgtagtcaccacgcagtgaggcgagtgggccgatgtagacaccggctcccacaatcacatcgccaatcaatactgcactgggatggacaaacgccgtcgggtgaacaaccggaattaacccctcaaaggcgtaatagctcacggttgttaacgtcctttccacactggatcgcgcttctcggcaaacgccagcggcccttcaatggcatcctccgaatgcagaaccgatggatagtgtttcaacacgccgctgcgaatatagcgatacgcttcttctaccggcatttcactggtggtgcggtagatctctttcagcgccgcaatcgccagcggagcgctgttaaccagctgctgcgccagttcgcgggcgttatccatcagttccgcctggctaaccacgcggttgactaccccccaacgcagcgcctcttctgcgcccattcgtctgccggtcatcaccatttcattgacgatggcaggcggcaggatcttcggcagacgcagcacgccgccgctgtcaggaacgatgcccagtttggcttccggtagggcgaagctggcgttatcggcacaaacaataaaatctgccgccagcgccagttcaaagccgccgccaaaggcatagccgttcacagcggcgatgaccggtttgtcgagattgaaaatttcggttaatcccgcaaaacctcccgggccaaagtcagcatccggtgcttcgccttctgctgccgcttttaaatcccagcccgcggaaaagaatttctctccggcaccggtaataatggcgacacgtaattgcggatcgtcacggaaatttagaaatacttcgcccatttcaaagctggtttttgcatcaatagcattcgcttttggacgatcaagggtaatttccagaattgatccattgcgggtcagatgtaatgattcactcattccttttctccatttttgctttttcagggacgacaacatccctgcaaaaaatgcatattgttttagagcgtgattattagctgacagggtagttccctgccgtttcatttatttcagattctttctaattattttccccgagcaattacgtggcagatcttttctgatctccagataagagggcactttaaatttcgccatattctgttcacagaagcagaagaattcctcttcgctcaatgtttcaccttcattcagcaccacaaatgctttgatggcttcatcgcgaatcgaatctttaatacccacaaccacgatatcctgaatttttggatgggtggcgatgatattttcgagctccacgcaggagacattctcgccaccgcgtttgatcatattgcagcggcgatcgacgaaataaaaaaagccctcttcgtcgcggtatccggtatcgccggtatgtagccagccatcggcttccagcactttcgcagtggctttcgggttgagaaaatactctttgaagatggttttccctggtacgcctttaatacagatttcaccgagctcaccagccgggaggggacgattgtgatcgtcgcggatctccgcttcgtagcaaaagcccgcccgaccaatcgacggccagcgccgtttatcgccagggcgatcgccgataatgcccacaatggtttccgtcatcccataagacgtcagcaagcgaacgccgaagcgttcacaaaacgcgtctttttcctgttccgacaagttgagataaaacatcacttcccgcaggcggtgttgccgatcgttcgctgaaggcggctgcaccatcaacgtacgaatcatcatcggaatacattcggtaatggtggcgcggtacttctgcacctgtccccagaaggcgcgggcgctgtatttctcgaccagcacaaaggtggccccggcagaaaacgccgccatcgccgcagtacactggcaatcgatatgaaacgcaggcattaccgtcaggtagacgtcatcgtcacgcagtgcacactgccaggcggagtaatatccagcgaagcgcaggttgtaatgggtaatcaccacccctttcggtcgggaggtagtgccggaggtgaagagaatttccgccgtatcgtcagtcgatagcggcggtgcatagcacaaggtggcaggttgttgatttttcagttgagtaaacgaactcacgccatcatcagcgggaagtgccatatctatcaggcaaatgtgccgcaactgagaggcatcttcctgctgaatctgttgatacataggataaaattgcgcactggtcaccagcaggcacgcctggctattttgcaggatccacgtgctttcttcgcgcaacaggcgggcgttaattggcaccataatcgcgccaatttttgccagcccgaaccagcaaaagataaattccgggcagttgtcgagatgtagagcaaccttgtcgcctttgcgaatccccagcgtataaaacaggtttgccgtgcggttaatctcctgatttaactcaagataactataccggttaacgactccgccgctggattcacaaatcagcgccgttttatgaccgtaaacgtccgccagatcgtcccacatttgacgtagatgttgtccgccaatgatatccattgcacctctatccattttgttcgtttgttattgggcgggcgctagtcaggcaagttgactgacgccacgcgtttagtcctcaactttggccagacctttgctgaccaactcctgaatgtcgttttcgctgtagccgatatttttcaaaatggcagccgtgtccatgccatgtgagggcattccgcgccagatttgtccggggttatttttgaatttcggcatgatattcggccctttgcaggtgcgaccatccatcgtttgccactgagtgattgattcgcgagccacatactgtggattgctttccagttccggcacggtcagtactttggcacaggcgatattcagttcggcaaagcgttctttaacttctgcgatggtatgtgccgccagccaggcatcgagtttctcttctaccagtgggccgtaagggcattcgatacggtggataagctgagtgccttccgggatttccggcgtaccgagcagatgtgcgaggccaatatctttaaagcactctgcaatttgagtaatgcccaccagttccatcacgatgtagccgtcggcgcatttatacagaccgcaaccggcgtagtagggatctttacctttggtcatgcgcgggcacatttcgccgccgttgaagtaatccatcatgaagtactggcccatacgcagcatcacttcatacatggcgatgtcgatgctttcgcctttaccggtttcacgcactttatgcagtgctgccagcgccgccgtggtggcggtcaggccagaaaagtaatcggcggtatacgggaaggcaggcattggctggtcaacatcaccgttctgaatcaggtaaccactgaaggcctgggcgatagtgttataggccggaagattggtgtactcctcggtgccatactgaccaaaaccggaaaggtgagcgataaccagttttgggttgtgctgccacaggacttcatcggtaatgccacgacgggcaaaggccggacctttactggcttcgatgaagatatcggtggtttccattaatttcagaaacgcttcgcgcccttcatctttgaaaatatttaacgacagcgcatgcaaattgcggcgggagagctgcgggtagttcggttgaacgcgaatggtgtcggcccaggcgacgttctcgatccagataacttccgccccccattctgcgaacatttgtccggcgaacggcccggcgatttcgataccggagaagacaacgcgtaatccggccagcggcccgaatttcggcatgggtagatgatccattattagctcctgaaaaatttatgtagcgcatgactgccggatgcggcgtaaacgccttatccggccatcttcgtgctcccgtaggcctgataagacgcgtcagcgtcgcatcaggcagcgcacggacttaacggtattgcttcagcaccgcgcgacccagcgtcaggatctgcatttcgtcagatcctccggaaacgcggtctacacgcaggtcacgccagaagcggctgatgcggtggttgcccgcaatcccgacaccgcccagcacctgcattgcgctatccaccacttcaaatgccgcattggcgcagaagtatttgcacatcgctgcatcgccagaggtgatggtgccgttgtctgctttccacgctgcttcatacagcatgtttttcatggagtttaatttgatcgccatgtgggcgaatttttcctgaatcaactggaaacgaccaatagcctcgccaaactgcacacgctggttggcgtagcgcgccgcatcttcaaaggcgcacatcgccgtaccgtagttggtcagggctaccaggaaacgttcatggtcgaactcttctttgacgcggttaaagccgttaccttcccgaccgaacatgtctttctcgtccagttccacgtcgtcaaaggtgatttcacagcagctatccatacgcagaccgagcttttcaagtttggtcactttgatgcccggtttgctcatatcaacaaaccattcggtgtagacaggtttgtccggagaagccccgtcgcgcgccatcaccacgatgtacggggtgtaggcgctgctggtaataaaacacttactaccattaagataaatcttaccatttctacgggtataagtcgttttcaggctacccacgtcggagcctgcgcccggttcggtaattgctgagttccacatctgcttaccggtgccgcggaaagccataatcttgtcgatctgctcttgcgtaccttcacgcaggaaggtgttaaacccgcccggtaactgatacagcacgtaagttggcgctcccagacgacccagttccatccacacggcggcgagagtaacaaaccccgcgtccagaccaccgtgctcttcagggatcagcagactgtcgatacccatatccgccagggctttgacaaaacgttccgggtagacgctgtcacggtcgcactcggcaaaataggcctcccagttttcgctggccatcagttcgcggataccggcgacaaacagttcctgctcatcatttaaattaaaatccatctttcaacctcttgatattttgggggttaattaatctttccagttctgtttcgcgtctttaataaaggagagcgtcaccatgatgttgacgaagaacagcgggcatcctccggcgataatggcggtttgaatcggtttcaggccgccgagcgccagcagaacaataccgataatgccaaccagaattgaccagccgatacgcaccagcagcgggggttcttcaccatcgcgtacttcgcggcaagtggacatcgccagggtataagagcaggcgttaaccagcgtaacggtggcaataaagcagaggatgaagaagccccacatggtggcggtgctgagtggcagagcggcccaggtttcgatgatggcgcgcgccacaccgtactgttcgatcagatttggaatgttgatgatgtttttatctatcaacagcagagtgttactaccgagtacagtccacaggatccaggttgacgctgtcagccccagcaccatgccgaagcacagttcacgcacggtacgaccacgggagatgcgggcgaggaagatgctcatctggatagcgtaaatcacccaccatgcccagtagaacacggtccagccctgcgggaagccgcctttagcgatgggatcggtatagaacaacatgcgcggcagatacatcagtaacatccccaccgaatcggtgaagtagttcatgatgaagctggcaccgctgacgatgaacacccaacccagcatcaggaagctcaggtaactacgcacgtcactggcgatacgtacccctttttgcagaccgcaagcgacgcaaatggcgttgaggataatccagcaggtaatgatgatagcgtccagttgcagggtatgcggaatgccaaacaaccattgcatacactcggtcaccagcggcgtggcaaggcccagactggtacccatcgcgaagatcaaggcgacgagatagaagttgtcgacgatagtgccgaacaaccctttggcgtgtttttcacctaccagcggcaccagggtggagctggggcgaatcacttccattttgcggacaaagaagaagtaagcgaaggcgactgaaaggaagctgtaagtggcccacggcagaggtccccagtggaacaagctgtaagccagccccaactctttcgcgcctgttgagttcggttctaagccaaacggcggggtggagatgtagtagtagatctcaatcgatccccagaacagtacggcagcagacgtacaggaggcgaacatcataaagatccaactggcggtactaaattctggtggttcgttacctaaacgctttttggcatacgggccaaacaccagccagaaccagccgaaaagcatcaccaccatataccattcaaatgcccatccccatacattggtgacgtaactgaatacagcattaataacgacattcgccgcatccagatctctgactgtaagccaacaaagtatgccgacgattattaacggcggaaagaaaaccttcggttctattcccgtttttctcttttcattcttcatgagttaattccactgtgaaaacgaacatttattttgcgttcccgtttgttttatttttgttaacatttaatataattattattaacctcgtggacgcgttaatggctaactcataatgggtattcaataagctgcattctgtgattgttatcacatttttgtttcgggtgaatagagggcattttttcgttaattttgattattaatcagtttgttatgttctgttgtgagtaaaaaaatagcatctgactttcaatattggtgatccataaaacaatattgaaaatttctttttgctacgccatgttttcaatattggtgaggagcttaacaatattgaaagttggatttatctgcgtgtgacattttcaatattggtgattaaagttttatttccaaattaaagggcgtgatatctgtaattaacaccaccgatatgaacgacgtttccttcatgatttctggagatgcaatgaagattattacttgctataagtgcgtgcctgatgaacaggatattgcggtcaataatgctgatggttcgttagacttcagcaaagccgatgccaaaataagccaatacgatctcaacgctattgaagcggcttgccagctaaagcaacaggcagcagaggcgcaggtgacggccttaagtgtgggcggtaaagccctgaccaacgccaaagggcgtaaagatgtgctatcgcgcggtccggatgaactgattgtggtgattgatgaccagttcgagcaggcactgccgcaacaaacggcgagcgtactggctgcagccgctcagaaagcaggctttgatttgatcctctgtggcgatggttcttccgacctttatgcccagcaggttggtttgctggtaggcgaaatccttaatattccggcagttaacggcgtcagcaaaattatctccctgactgcagataccctcaccgttgagcgcgaactggaagatgaaacagaaaccttaagcattccgctgcctgcggttgttgctgtttccactgatatcaactccccacaaattccttcgatgaaagccattctcggcgcggcgaaaaagccagtccaggtatggtcggcggcggatatcggttttaacgcagaggcagcctggtcagaacaacaggttgccgcgccgaaacagcgcgagcgtcagcgcatcgtgattgaaggcgacggcgaagaacagatcgccgcatttgctgaaaatcttcgcaaagtcatttaattacaggggatgctatgaacacgttttctcaagtctgggtattcagcgataccccttctcgtctgccggaactgatgaacggtgcgcaggctttagctaatcaaatcaacacgttcgtcctcaatgatgccgacggcacacaggcaatccagctcggcgctaatcatgtctggaaattaagcggcaaaccggacgagcggatgatcgaagattacgccggtgtcatggctgacactattcgccagcacggcgcagacggtctggtgctgttgccaaacacccgtcgcggcaaattactggcggcgaaactgggttaccgccttaacgcggcggtgtctaacgatgccagcgctgttagcgtgcaggacggtaaagcgacagtgaaacacatggtttacggcggtctggcgattggcgaagaacgcattgccacgccgtatgcggtactgaccatcagcagcggcacgttcgatgcggctcagccagacgcgtcacgcactggcgaaacgcacaccgtggagtggcaggctccggctgtggcgattacccgcacggcaacccaggcgcgtcagagcaacagcgtcgatctcgacaaagcccgcctggtggtcagcgttggtcgcggtattggcagcaaagagaacattgcgctggcagaacagctttgcaaggcgataggtgcggagttggcctgttctcgtccggtggcggaaaacgaaaaatggatggagcacgaacgctatgtcggtatctccaacctgatgctgaaacctgaactgtacctggcggtggggatctccgggcagatccagcacatggttggcgctaatgcgtcgcaaaccattttcgccatcaacaaagataaaaatgcgccgatcttccagtacgcggattacggcattgttggcgacgccgtgaagatccttccggcactgaccgtagctttagcgcgttgatccactctggcagggctgcattttggccctgccgctgacagggagctcttatgtccgaagatatctttgacgccatcatcgtcggtgcagggcttgccggttcggttgccgcactggtgctcgcccgcgaaggtgcgcaagtgttagttatcgagcgaggcaattccgcaggtgccaagaacgtcaccggcgggcgtctctatgcccacagtctggaacacattattcctggtttcgcagactccgcccccgtagaacgcctgatcacccatgaaaaacttgcgtttatgacggaaaagtcagcgatgactatggactactgcaatggcgacgaaacctcgccatcccagcgttcttactccgttttacgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggggtgaattccatccttgccgaaaagctggggatggcaaaacgcgttaaaccgacggatgtggcggttggcgtgaaggaactgatcgagttaccgaagtcggttattgaagaccgttttcagttgcagggtaatcagggcgcggcttgcctgtttgcgggatcacccaccgatggcctgatgggcggtggcttcctttataccaatgaaaataccctgtcgctggggctggtttgtggtttgcatcatctgcatgacgcaaaaaaatcggtgccgcaaatgctggaagatttcaaacaacatccggccgttgcaccgctgatcgcgggcggcaagctggtggaatattccgctcacgtagtgccggaagcgggcatcaacatgctgccggagctggtcggtgacggcgtattgattgctggtgatgccgccggaatgtgtatgaacctcggttttaccattcgcggtatggatctggcgattgccgccggggaagcagcagcaaaaactgtgctttcagcgatgaaaagcgacgatttcagtaagcaaaaactcgcggaatatcgtcagcatcttgagagtggcccgctgcgcgatatgcgcatgtaccagaaactaccggcgtttcttgataacccacgcatgtttagcggctacccggaactggcggtgggcgtggcgcgtgacctgttcaccattgacggcagtgcgccggaactgatgcgcaagaaaatcctccgccacggcaagaaagtgggcttcatcaatctgatcaaggatggcatgaaaggagtgaccgttttatgacttctcccgtcaatgtggacgtcaaactgggcgtcaataaattcaatgtcgatgaagagcatccgcacattgttgtgaaggccgatgcagataaacaggccctggagctgctggtgaaagcgtgccccgcaggtctgtacaagaagcaggatgacggcagtgtgcgcttcgattacgccggatgtctggagtgcggcacctgtcgcattctggggctggggtcggcgctggaacagtgggaatacccgcgcggcacctttggtgtggagttccgttacggctgatgttggtttgatacgtaatgccgtactgactctcattgcaaaaaaacaggaataacccatgcaaccgtccagaaactttgatgatcttaaattctcctctattcaccgccgcattttgctgtggggaagcggtggtccgtttctggatggttatgtactggtaatgattggcgtggcgctggagcaactgactccggcgctgaaactggacgctgactggattggcttgctgggcgcgggaacgctcgccgggctgttcgttggcacatcgctgtttggctatatctccgataaagtcggacggcgcaaaatgttcctcattgatatcatcgccatcggcgtgatatcggtggcgacgatgtttgtctcatcccccgtcgaactgttggtgatgcgggtacttatcggcattgttatcggtgcggattatcccatcgccacctcaatgatcaccgagttctccagtacccgtcagcgggcgttttccatcagctttatcgccgcgatgtggtatgtcggcgcgacctgcgccgatttggtcggctattggctttatgatgtggaaggcggctggcgctggatgctgggtagcgcagcgattccctgtttattgattttgattggtcgattcgaactgcctgaatctccccgctggttgttacgcaaagggcgagtaaaagagtgcgaagagatgatgataaaactgtttggcgaaccggtggctttcgaggaagagcagccgcagcaaacccgttttcgcgatctgtttaatcgccgccattttccttttgttctgtttgttgccgccatctggacctgccaggtgatcccaatgttcgccatttacacctttggcccgcaaatcgttggtttgttaggattgggggttggcaaaaacgcggcgctggggaacgtggtgattagtctgttctttatgctcggctgtattccgccgatgctgtggctaaacactgccggacggcgtccattgttgattggcagctttgccatgatgacgctggcgctggcggttttggggctgatcccggatatggggatctggctggtagtgatggcctttgcggtgtatgcctttttctctggcgggccgggtaatttgcagtggctctatcctaatgaactcttcccgacggatatccgcgcctctgccgtgggcgtgattatgtccttaagccgtattggcactattgtatcgacctgggcactgccgatctttatcaataattacggtatcagtaacacgatgctaatgggggcgggtatctcgctatttggcttgttgatttccgtagcgtttgccccggagactcgagggatgtcactggcgcagaccagcaatatgacgatccgcgggcagagaatggggtaatttgttcagatttctctcttttctgaatcaatattattgactataagctgcgtgaatatatgactacactttgtgggaaaacaaaggcgtaatcacgcgggctacctatgattcttataatttatgcgcatccgtatccgcattattcccatgcgaataaacggatgcttgaacaggcaaggacgctggaaggcgtcgaaattcgctctctttatcaactctatcctgacttcaatatcgacattgccgccgaacaggaggcgctgtctcgtgccgatctgatcgtctggcagcacccaatgcagtggtacagcattccaccgcttcttaaactttggatcgataaagttttctcgcacggctgggcttacggtcacggcggcacggcgctgcacggcaaacatttgctgtgggcggtgacgaccggcggtggggaaagccattttgagattggtgcgcatccgggctttgatgtgctgtcgcagccgctacaggcgacggcaatctactgcgggctgaactggctgccaccgtttgccatgcactgcacctttatttgtgacgacgaaaccctcgaagggcaggcgcggcactataagcaacgtctgctggaatggcaggaggcacatcatggatagccatacgcttattcaggcgctgatttatctcggttcggcggcgctgattgtacccattgcggtacgcctcggtctgggatcggtacttggctatctgatcgccggctgcatcattggcccgtgggggctgcgactggtgaccgatgccgaatctattctgcactttgcagagattggcgtggtgctgatgctgtttattatcggcctcgaactcgatccacaaaggctgtggaagctgcgtgcggcagtgttcggcggtggcgcattgcagatggtgatttgcggcggcctgctggggctgttttgtatgttacttgggctgcgctggcaggtcgcagaattgatcggcatgacgctggcgctctcatcaacggcgattgccatgcaggcgatgaatgaacgcaatctgatggtgacgcaaatgggccgcagtgcctttgcggtgctgctgttccaggatatcgcggcgatcccactggtggcgatgatcccgctactggcagcgagcagtgcttcgacgacgatgggcgcatttgttctctcggcgttaaaagtggcgggcgcgctggcgctggtggtattgctggggcgctatgtcacgcgtccggcactgcgttttgttgcccgctctggcttgcgggaagtgtttagtgccgtggcgttattcctcgtgtttggctttggtttgctgctggaagaggtcggcttgtcgatggcgatgggcgcgtttctggcgggcgtactgctggcaagctcggaataccgtcatgcgctggaaagcgatatcgaaccatttaaaggtttgctgctggggctgtttttcatcggcgttggcatgtcgatagactttggcacgctgattgaaaacccattgcgcattgtcattttgctgctcggtttcctcatcatcaaaatcgccatgctgtggctgattgcccgaccgttgcaggtgccaaataaacagcgtcgctggtttgcggtgctgttaggacagggcagtgagtttgcctttgtagtatttggtgcggcgcagatggcgaatgtgctggagccagagtgggcgaaatcgctgactctggcggtggcactgtcgatggcggcaacgccgattctgctggtaatcctcaatcgccttgagcaatcttctactgaagaggcgcgtgaagccgatgagatcgacgaagaacagccgcgggtaatcattgccggattcggtcgttttgggcagataaccggacgtttactgctctccagcggggtgaaaatggtggtgctcgatcacgacccggaccatatcgaaacgctgcgtaaattcggtatgaaagtgttttatggcgatgccacgcggatggatttactggaatctgccggagcggcgaaagcggaagtgctgattaacgccatcgacgatccgcaaaccaacctgcaactgacggagatggtgaaagaacatttcccacatttgcagattattgcccgcgcccgcgatgtcgaccactacattcgtttgcgtcaggcaggcgttgaaaagccggagcgtgaaaccttcgaaggtgcgctgaaaaccgggcgtctggcactggaaagtttaggtctggggccgtatgaagcgcgagaacgcgccgatgtgttccgccgctttaatattcagatggtggaagagatggcaatggttgagaacgacaccaaagcccgtgcggcggtctataaacgcaccagcgcgatgttaagtgagatcattaccgaagaccgtgaacatctgtcattaattcaacgacatggctggcagggaaccgaagaagggaaacatactggcaatatggcggatgaaccggaaacgaagccctcatcttaataaagagtgacgtaaatcacgctttacagctaactgtttgtttttgtttcattgtaatgcggcgagtccagggagagagcgtggactcgccagcagaatataaaattttcctcaacatcatcctcgcaccagtcgacgacggtttacgctttacgtatagtggcgacaattttttttatcgggaaatctcaatgatcagtctgattgcggcgttagcggtagatcgcgttatcggcatggaaaacgccatgccgtggaacctgcctgccgatctcgcctggtttaaacgcaacactttaaataaacccgtgattatgggccgccatacctgggaatccatcggtcgtccgttgccaggacgcaaaaatattatcctcagcagtcaaccgggtacggacgatcgcgtaacgtgggtgaagtcggtggatgaagccattgcggcgtgtggtgacgtaccagaaatcatggtgattggcggcggtcgcgtttatgagcagttcctgccgaaagcgcaaaaactgtatctgacgcatatcgacgcggaagtggaaggcgacacccatttcccggattacgagccggatgactgggaatcggtattcagtgaattccacgacgccgatgcgcagaactctcatagctattgctttgagattctggagcggcggtaattttgtatattagaattccggcatcactgatacgtgcagatatccgtgtataccagacgtataaattgtacaggagcacgagatcatgactgcaaaacgtaccacacaaagtgtgaccgtcaccgtcgaccgtgagttagtcaatcgcgctcgtgatgcaggcttaaatatgagcgccacccttacggttgcgctcaatgctgaacttaaaaaacatgcagcaacacgttggcgtgaagagaacgcagaagctatcgctgcgttaaatcaattggctgatgaaaccggatgtttctctgatgagtaccggagcttctagcgatgcaatttacggtataccgcagtcgcggcaggaacgccgcgtttccctttgttattgatgttaccagcgacattgttggtgagattaatcgccgtatcgttattccattaacacctatttgaacgatttagccgtattcgcccaccagaacggcttaacccaatccttttaccggtagacggcaaagaatatgtgctcatgacgcatgagactgcaactgttccagttaacgcgctgggaacgaaattttgcgatgccagcgcgcaccgaacgttgattaaaggagcattagattttatgctcgacgggatttaagacgctaccgcctctccctcactcaaatccttatgccggttcgacggctggacaaaatactgtttatcttcccagcgcaggcaggttaatgtaccaccccagcagcagccggtatccagcgcgtaaataccttccggcgtacctttgccttccagcgatgcccagtgaccaaaggcgatgttgtactcttcagcgacggggccaggaatcgcaaaccacggtttcagtggggcaggggcctcttccggcgattctttgctgtacatatccagttgaccgttcgggaagcaaaaacgcatacgggtaaaggcgttggtgataaaacgcagtcttcccagcccccgcaattccggcgaccagttatttggcatatcgccgtacatggcatcaaggaagaagggataggagtcactcgacagcaccgcttctacatcgcgcgcgcactctttggctgtctgcagatcccactgcggcgtgatcccggcgtgggccatcactaactttttctctttgtcgatttgcagcaaaggctggcgacgcagccagttaagcagctcgtcggcatccggcgcttccagcagcggtgtcaggcgatctttcggtttattgcggctgatcccggcaaataccgccagcagatgcagatcgtgattacccagcaccagacgtacgctgtcgcctaaggatttcacatagcgcagaacatccagcgaacccgggccgcgcgcgaccagatcgcccgtcagccagagggtatctttcccaggggtaaattctactttatgcagcaatgcgatcagttcatcgtaacaaccatgaacgtcgccaataaggtatgtcgccatattcttttaatgaatgagtgtgggaacggcgagtcggaatacgggaatgtcgatgctgaaagggacgccattttcatcgatcatttcgtagtgaccctgcatggtgcccagcggggtttcaatgattgcaccgctggtgtactggtactcttcgccaggcgcgataagtggctggacgccaaccactccttcgccctggacttcggtttcacggccattgccattggtgatcagccagtaacgccccaacaactgcactggcgctcgccccagattgcgtatggttacggtataagcaaaaacgtaacgttcattatcaggtgaagattgggcctcaatgtagacgctttgaacctgaatacacactcggggcgaattgatcatcgttaactctcctgcaaaggcgcgttctccgccagatagttcgccatctggcaatattgcgcgacagagatattttccgctcgcatcgccgggtcgatccccattcccgttaacacctcgacgctaaacaggttgccgaggctgttacgaatggttttacgacgctggttaaaggcttcagtggtgatgcggctcaacacgcgaacatctttaaccgggtgaggcatcgttgcatgaggaaccaggcgcacgacggcggaatccactttgggtggtggtgtaaaggctgacggcggtacttccagcaccgggatcacgttgcaatagtattgcgccatgacgcttaatcgaccatacgccttgctgttcggtcctgcaaccagacgattcaccacttctttttgcaacataaagtgcatgtcggcaatggcatcagtatagctaaacagatggaacatcaacggcgtggagatgttataaggcaggttgccgaaaacacgcagcggctggcccattttcgcggccagttcgccaaagttaaaggtcatcgcatcctgctgataaatcgtcagtttcgggcctaagaatggatgcgtttgcagacgtgccgccagatcgcggtcaagttcgatgaccgtcagctggtccagacgttcgccgaccggttcggtcaatgccgccagaccggggccgatttcgaccatcgcctggcccttctgcgggttaatggcagaaacaatgctgtcgatcacgaactgatcgttgagaaagttttgcccgaagcgtttacgggctaagtggccctggtggactcgattattcattgggtgttaacaatcattttgatggcgagattaagcgccgtaataaaactgccgacatcggctttaccacgtcccgccagttcaagcgcggtgccgtggtccactgatgtgcgaataaagggcaggcccagcgtaatgttcacaccgcgcccgaagccctggtattttagcacgggaagaccctgatcgtggtacatcgccagcacggcgtcggcgttatcgagatatttcggctgaaacagggtatcggcaggcagcggcccgttgagtttcatcccctgttcccgcagctcgttgagtaccggaataatagtgtctatctcttccgtacccatatgaccgccttcgcccgcgtgcggattcagcccgcagaccagaatgcgcggttcggcaataccaaatttggtccgcaaatcgtgatgcaaaatagcaatcacttcgtgcaaaagggcaggggtgatagcatctgcaatatcgcgcagcggtaaatgcgtcgttgccagcgccacgcgaagttcttcggtcgccagcatcatcaccacttttttcgcctgcgaacgctcttcgaaaaactcggtatgcccggtaaacggaatgcctgcgtcgttaatgacgcctttatgcacggggcctgtgatcagcgcagcaaattcaccgttcagacagccatcacacgctcgcgccagcgtttccaccacatagtgcccattttcaactgctaactgccccacagtgacagattcacgtagcgcgacaggaagtagcgttaatgtgcccgcagtttgcggttgtgcaggggagttgggggaataagggcggagggtgagcggcaaaccgagcatcgctgcccggtcggtaaggagagtggcatcggcacaaacaaccagttcgactggccactcacgctgtgcaagctggacaattaagtccgggccaatcccggcgggctcgccgggagtgatcacaacacgttgggttttaaccattagttgctcaggattttaacgtaggcgctggcacgttgttcctgcatccagcttgctgcttcttccgagaacttacggttcatcagcatgcggtatgcacgatctttctgtgccgcgtcggttttatcgacattacgggtatccagcagttcgattaaatgccagccgaatgaagagtgaaccggtgcactcatttgacctttgttcaggcgggtcagggcgtcacggaaggccggatcgaaaatatctggtgtagcccagccgagatcaccgccctggttagcagagcctggatcctgagagaactctttcgctgcggcagcaaaagtcgttttaccactcttgatatcggcagcaatctgttccagtttcacgcgggcctgttcgtcagtcatgatcggcgacggtttcagcagaatatggcgagcatggacttcggtcaccgagatatttttgctttcgccgcgcaggtcgttaactttcagaatatggaagccaacgccggaacgaatcgggccaacaatgtcgcctttcttcgcggtgcttaatgcctgggcgaagatccccggcaactcctgaatacggccccagcccatctggccgccgttcagcgcctgctggtcggcagaatgagcaatcgccagcttaccgaaatcagcgccgttacgcgcctgatcgacaatggcgcgtgcctggctttccgcttcgttcacctgatcagaggtcgggttttccggcagcgggatcaggatgtggctcaggttcagctcagtgctggcgtcgttttggttacccacttgctgcgccagggattcgacttcctgcggcaggatggtgatgcgacgacgcacctcgttgttacgcacttcagagataatcatctctttgcggatctggttacgataggtgttgtagttcagaccatcgtaagccagacggctgcgcatctgatccagcgtcatgttgttctgtttcgcgatgttagcaatcgcctgatccagctgctcatcggagattttcactcccattttctgccccatctgcaggatgatttgatccatgatcaaacgttccatgatttggtggcgcagcgtcgcgtcatcaggaagttgctgccttgcctgagcagcgttcagttttaccgactgcattaatccatcaacgtcgctttccagcacgacgccgttattgacgacggctgcgactttatcgactacctggggggcagcgaaactggtattcgcgatcatggcgataccgagaagcagcgttttccagttcttcatactttttccatttcaattaaccgcactgcggattacgtggtaaatcaacaaatcacaaagtgttttgatacggcagaatgttcgaacgcagcatctcttgcgtacccagaccgtagttggagctcaggccgcgaagttcgatgttaaagccgattgcgttgtcatataccgcatgttgtttatcgttatcccaaccgttcagcttccgctcgtaaccgacgcgaatcgcatagcagcaggagctgtattgcacacctaacatagagtcggcttgcttgttcgcattggtgtcgtagtagtaggccccaacaatggaccaacgatcggcaattggccagctggcgacggcacctacctgcgaaataccattcttatattgctcagcagtggaatagtacttaggcagcgttgcctgaatatattccgggctggcgtaacggtaattcagctgtaccagacggtcttcatcccgacggtattcaatgctggagttactggtcgctacgttatccagacgtgtatcgtactgaatcccgccacgcaatccccaacgatcagagatgcgccagtaagtatcgcctgcccataccagtgagcccgttttgtcgtcattctcccatgttatgttgtcatcgccagtgcgagactccgtgaaatagtagatttgaccaacggaaatattaaaacgttcaacggcagcatcatcatatatgcgagatgtgacaccggtcgtcacctggttagcggaggcaatacggtcaagaccgccgtaagtccggtcccggaacaggccggagtagtcagattgcagcagcgacgagtcgtagttatagattttgctctgatcgcgatatggcacatacagatactgcgcgcgtggttccagtgtctgggtatagcccggcgccagcatttccatatcacgctcgaagaccattctaccgtctaccttgaactgcggcattacacggttagcggactctgccagcttggtcgtgtttctggagttataccagtcaagattggtttgctgataatgggttgccagcaacttcgcttcagtattgatgctgccccagttattagagagcggcagattgatggtcggttccaggtgaacacgagtcgcctctggcatgtcatctctggtgttaacaaagtgcaccgnnnnncattccattcattaattaattaatgaatgaatgnnnnnttgaaacggtggcattgaagttttgcaccgcatagccaacgctgaatttttgcgttgcgtagccgtcggtactggaaccgtacttgttatcgaaatcattgaagtagctaggatcgctgaccttggtgtagtcgacgttgaaacgccacacctgatccatgaccccggagtggttccagtagaataaccaacgacgtgaactgtcatcgttcgggtgttcatctttatagactttatctgaaggcagatagtccagttccatcaagccagcgcccgcctgggagaggtagcggaattcgttctcccacatgatattgccacgacgatgcatataatgcggcgtgatggtggcatccatatttggcgcgatgttccagtaatatggcaggtagaactcaaagtagttggtggtggtgtacttggcgttcgggatcaagaaaccagagcgacgtttgtcacccaccggcaactgcaaataggggctataaaagatcggtaccggacccaccttaaagcgggcgttccagatctccgcaacttgttcttcgcggtcatgaataatttcgctacctaccacgctccaggtgtcagaacccggcagacaggaggtaaagctaccgttatccagaatggtatagcggttttcgccacgttgtttcatcaggtccgctttaccgcggccctggcgacccaccatctggtaatcaccctcccagacgttggtatctttggtgttcagattcgcccagcctttcggccctttgaggatcacctggttatcgtcgtaatggacattaccgagcgcatcaacggtacgtaccggctccggttgtcctggtgcctctttttgatggagctgcacttcgtcggcctgcagacggctgttaccctgcatgatatccacgctgccagtaaacacggcgtcatccgggtagtcccctttcgcgtggtcagcattgatagtcacgggtaagtcattggtatcgccctgtaccagaggacggtcatagcttggcacgcccaacatgcactgtgaggcgaggtcggctgccagtccctgttgactataaagggcggtggcaatcatggtggccaggagagtggggatacgttttttcatacgttgattttattgttccatcatcggtaacgttgcgcgtgacaaacggtcagagactaacgtactcgtcatctctacgctagtgttaatcctgtccgaatagcgtctgtggtgttaggcacggcattgaatgacaggtatgataatgcaaattataggcgatgtctcacaatagaccgcagccagaaatgggtaaaagcgcctttatattgtgggagatagccctgatatccgtgtgtcgatttggggaatatatgcagtattggggaaaaatcattggtgtggccgtggccttaataatgggcggcggcttttggggcgtagtattgggcctgttaattggccatatgtttgataaagcccgtagccgtaaaatggcgtggttcgccaaccagcgtgagcgtcaggcgctgttttttgccaccacttttgaagtgatggggcatttaaccaaatccaaaggtcgcgtcacggaggctgatattcatatcgccagtcagttgatggaccgaatgaatctgcatggcgcttcccgtactgcggcgcaaaatgcattccgggtgggaaaatcagacaattacccgctgcgcgaaaagatgcgccagtttcgcagtgtctgctttggtcgttttgacttaattcgtatgtttctggagatccagattcaggcggcgtttgctgatggttcactgcacccgaatgaacgggcggtgctgtatgtcattgccgaagagttaggcatctcccgcgcccagtttgaccagtttttgcgcatgatgcagggcggtgcacagtttggtggcggttatcagcagcaatctggcggtggtaactggcagcaagcgcagcgtggcccgacgctggaagatgcctgtaatgtgctgggcgtgaagccgacggatgatgcgaccaccatcaaacgtgcctaccgtaagctgatgagtgaacaccatcccgataagttggtggcgaaaggtttgccgccagagatgatggagatggcgaagcagaaagcgcaggaaattcagcaggcctatgagctgataaagcagcagaaagggtttaaataagtttcaacgtgtaggcctgataagacgcggtaggccggataagacgcgccagcgtcgcatccggcgagcagcatcagacaatcggcgcaaaattgccggatgcggcgtgaacgccttctccggcctaccgaacttcgccagcgtgactattaaaaatccgctggtgctttaaacgtcatactattgccatacgccggatgggtaatcgtcagcatctctgcatgtagcaacaaacgcggtgccattgctctcgcttctggtgatgcataaaaacgatcgccgagaatcggatgacccagcgccagcatatgcacacgcagctgatgcgaacgcccggtaatcggttttaacaccactcttgccgtgttatccgctgcatattccaccacttcatattccgtctgcgcaggtttacctgtttcgtaacagactttctgtttcgggcggtttggccagtcgcaaatcagcggcagatccaccagaccttccgcaggggatggatgcccccagacgcgggccacatactgctttttcggctcgcgctcgcggaactggcgttttaactcccgctccgcggctttggtcagcgccactacaatcacgccgctggtagccatatccagacgatgcaccgattctgcctgcggataatcacgctgaatgcgcgtcatcacgctgtctttgtgctcttccagacgacccggcacagacaacaaaccgctcggcttgttgaccaccataatatggtcatcctgatacaggacaaccagccaggggtcctgcggcggattgtagttttccatccccatcttcggctccgttactgatgcgtcacaacgatcaaacgcagggcatccagacgccagcctgcctgatccaggctttccattacctgctgacggttgctctcaatggcggtcagttcgtcgtcacgaatgttcgggttaactgcacgcagcgcttccagacgagacagctcggcagacagtttttcgtcggcttcgttacgcgctgcatcaatcaatgcacgggcagatttctcgatctgcgcttcccccagctgaaggatagcgtgaacatcctgctgcacggcgttaaccagcttgctgccggtgtgacggttaaccgcgttaagctggcggttaaaggtttcaaactctacctgcgccgccaggttgttgccgtttttatccagcagcatacgtaccggcgtcggtggcaggaagcggttgagctgcaactgcttcggagcctgggcttcaaccacataaatcagttccaccaacagcgtacctaccggcaacgctttgtttttcaacagtgaaatcgtgctgctaccggtatcgccagaaaggatcagatccagaccgttgcggatcagcggatgctcccaggtaataaactgtgcatcttcacgcgccagcgccacttcacggtcgaaggtgatggtgatgccatcttccgacaggccagggaagtccggcaccagcatatgatcggacggcgtcagcacgatcatgttgtcgccgcgatcgtcctgattgataccgataatatcgaacaggttcatggcgaaggcgatcaggttggtatcgtcatcctgctcttcaatgctttctgccagtgcctgggctttttcgccaccgttggaatggatttccagcaggcggtcacgaccttgttccagctgtgctttcagcgcttcatgttgctcgcggcagtttttgatcagatcgtcaaagccttcggtttgatccggtgaagccagatagttaatcagatcgttgtatacgctatcgtaaatagtgcgtccggtcgggcaggtgtgctcgaatgcatccagaccttcgtgataccagcgcaccagcaccgactgagcagttttttccagataaggcacatggatctgaatatcgtgcgcctgaccgatacgatccagacgcccaatacgctgctccagcagatccgggttgaatggcaggtcaaacattaccatgtggctggcgaactggaagttacgtccttcagaaccgatttccgagcacagcagtacctgcgcgccggtgtcttcttcggcaaaccaggcggcagcgcggtcacgttcgataatcgacataccttcgtggaataccgcggcgcgaataccttcacgttcgcgcagtacctgctccagttgcagcgcagtggcagctttggcgcagatcaccagcactttctgagagcgatggctggtcaggtagcccatcagccactcaacgcgcggatcgaagttccaccaggtggcgttatcaccttcaaattcctgataaatacgctccgggtagagcatatcgcgagcgcgatcttccgcacttttgcgtgcgcccataatgccggagactttaatagccgtctgatactgcgtcggcagcggcagcttaatggtgtgcagctcgcgtttcgggaagcctttcacaccgttacgggtgttacggaacagcacgcggctggtgccgtggcgatccatcagcatcgaaaccagctcctgacgggcgctctgggcatcttcgctgtcgctgtttgctgcttgcaacagcggctcgatatcctgctcgccgatcatctcaccgagcatgttcagttcgtcattgctgagtttgttaccagccagcagcatggcaacggcgtccgcaaccggacgataatttttctgctcttcaacgaattgcgcaaaatcgtggaaacggttcgggtccagcagacgcagacgggcgaagtggctttccatccccagttgttccggggttgcggtcagcagcagaacgccgggcacgtgctctgccagttgttcaatggcctgatattcacggctcggcgcatcttcgctccacaccaggtgatgcgcttcatcgaccaccagcaggtcccactcggcttcacagagatgttccagacgctgtttgctacgacgggcaaaatccagcgagcaaatcaccagctgttcggtgtcgaacgggttgtaagcatcgtgctgagcttcggcataacgctcatcatcaaatagcgcaaagcgcaggttgaaacggcgcagcatttctaccagccactgatgctgtaaggtttccgggacgataatcagcacacgttcagcagcgccagagagcagttgctgatgcaggatcatcccggcttcaatggttttccctaaacccacttcgtcagccagcaggacgcgcggcgcgtggcggcgaccaacatcatgagcgatgttgagctggtgcgggatcaggctggtacgctgaccgcgcaggccgctgtacggcatacggaactgttcgctggaatacttacgcgcgcgataacgcagcgcaaagcggtccatacggtcaatctgcccggcaaacagacggtcctgcggtttgctgaacaccagtttgctatcaaggaaaacttcacgcagggccacgccggactcttcagtatcaaggcgagtaccgatataggtcagcaagccattttcttcttttacttcttcgacttgcatctgccagccgtcatggctggtaatggtatcaccagggttgaacatcacgcgggtcacgggggaatcactgcgtgcgtacagacggttttcaccagtagatgggaaaagtaaagtgacagttcgcgcatccaccgcgacaacggttccaagtcccaattcgctttctgtatcgctgatccagcgttgaccaagtgtaaaaggcatatgtgttcggctctatatctttaattgcaggcaataaccacccgctaccgtgcttatgaggtagtggtgttattcaggtccaggaatggaaagggcgctatggtactggatggcaaagcattcgtcacgcatcaaaatggtatctggcgaactctttttttgctcaaaatagcccaagttgcccggtcataagtgtagcaaaattatcctcaataaaagggagtattccctccgccacgggttgtaactggcgggtcagatagtgttcgtaatccagcggtgaacgttggtagtccagcggctccgggccgttggtggtccatacgtacttaatggtgccgcggttctgatattgcaaggggcgaccgcgcttatggttttcttcatcggcaaggcgagcggcgcgtacatgaggcggaacattacgctgatattcgctcagcggacggcgaaggcgtttacggtaaaccagccgcgtgtccagttcgcccgccatcagcttgtcgatggtttcgcgcacgtattcctgatatggctcgttgcggaagatgcgcaggtaaagctcctgctgaaactgctgggccagcggcgtccagtcggtgcgcacggtttccagccctttaaacaccatccgctgtttgtcgccctcctgaatcagtccggcgtagcgctttttgctgccggtatcggccccgcgaatggttggcatcagaaaacggcagaaatgggtttcatactccagttccagtgcgctggtcagccgttgtttttgcagcgtttccgcccaccaggcgttaacgtgctgcaccagtgcacgaccgattttcgctgcttcttcttccgaatgtgcacctttcagccagacaaacgttgagtcggtatcgccgtagataacatcatagccctgcgcttcaatcaaggttttggtttgccgcatgatctgatgaccacgcatggtgatcgacgatgccaggcgtggatcgaagaaacggcaggcggtggtgccgagcacaccataaaaggcattcataatgatcttcagcgcctgcgaaagcggcttattaccctgacgtttggcttcatcgcgcccgtgccagatgttagtcacaatctccggcaggcaatgtttctcccgtgagaaccaggcatcgagaaaaccttcggtactgtgctctggatcaggctgcgccatgccttccaccagcccgacgggatcaatcagaaaggtgcggatgatcgacgggtacaggcttttgtagtccagcaccagcaccgaatcataaagcccaggtcgcgaatccatcacgtagccgccagggctggcgtgcggcggcacttcgccgagattaggcgcgacataaccagcgcgatgcatacggggaaaatagagatgaccaaacgctgccaccgaaccgccgtgtcgatctaccggcaggccgttcaccgtcgcccgttcgagcaaaaacggcatgatttcagttttgtggaagatctgcgtcaccagctcgcaatctttcaggttataagttgccagcgcaggcttatcttcggcgaaacggcggtcaatttcgtccattcgatcccacgggttatcgatagattttccttcgcctaataactcctgagcgacggtttccagcgagaatgaagagaaattccagaacgcggatttcagcgcctcgataccgtcgataatcagtcgccctttggcctgagcaaaaaagacgtcgtttttaaagccgtgctcgcgccactccagctcgctgttatcacgccccagacgcagcggaatacggtaacgctcggcatgtttttgcagcattcgcagatcgaactgcaccacgttccaaccgatgatcacatcaggatcatgagtcgcaaaccaggcgttaagtttttccagtagcagcgggcggctggcgacgtattccagttcaaaatcgagcgcggaggcgtcgccattctctggccccagcatataaacgatacgctgcccgcaaccttccaggccgatgcagtacagctcaccgtggcgggtggtttcaatatcaatagaaacccacttgagcggcggacgatagtcgggatgcggtttcagacgggcattaacgatagcgccgttgcgcatatcaccctcgacccacactggcgaggtgataaaccgctccatcagatagcgttctggcgggcgcacatcggcctcgtagacggtaacgccaccttcacgcaggcgcttttcgtaattcatcaactggcgatgggcgcgacagtaaaggccatacaccggctggcggtgaaaatcttttaacgccagcggcgtcaggcgaaagccttgttcaccctgcaaaatatgctgagcgcggggaacatgatcggcgggaataaatgccacggactcttgcggcgcaagcgtaacctgcaacggcccgttgtccgttgccagcaagaaggaaacttcggtcccttgcggggtgtcccgccagtgtcgggttaagataaaacctgcctgcgccacgctgaaaatccaataaaaaaccaggcttgattatagcctggtttcgtttgattggctgtggttttatacagtcattactgcccgtaatatgccttcgcgccatgcttacgcagatagtgtttatccagtagcgtttgctgcatatccggtaactgcggcgctaactgacggcagaatatacccatataagcgacttcttccagcacgatggcgttatgcaccgcatcttcggcatttttgccccatgcaaacgggccgtgagaatggaccagcacgccgggcatttgcgctgcatcgataccctgtttttcgaaggtttctacgatgacgttaccggtttcccactcatattcaccgttgatttctgcgtcggtcattttgcgggtgcagggaatggtgccgtagaaatagtcggcgtgggtggtaccggttgctggaatcgactgacccgcctgcgcccagatggtggcgtggcgcgagtgtgtgtgcacaatgccgccaatagacgggaatgcctgatagagcagccggtgagttggcgtgtcggaggagggctttttcgtaccttcaaccacttcaccggtttcgatgctgaccacgaccatatcgtcagcggtcatggtgctgtagtcgacgccggaaggtttgatcaccaggacgccgcgcccgcgatcaacggcgctgacattgccccaggtgagcgtgaccaggttgtgttttggcagcgccaggttggcttctaagacctggcgtttgagatcttctaacatgttgactccttcgtgccggatgcgctttgcttatccggcctacaaaatcgcagcgtgtaggcctgataagacgcgtcggcgtcgcatcaggcggtgaatgccggatgcgctttgcttatccggcctacaaatccggaacgcgtaggcctgataagacgcgtcagcgtcgcatcaggcgttacatacctgatgcggctacttagcgacgaaatccgtaatacacttcgttccagcgcagcgcgtctttaaacgctggaaggcgggtatcgttatcaatcactgtgatttcaatgtcgtgcatctcggcgaactggcgcatatcgttgaggttcagcgcatggctgaagacggtatggtgcgcgccaccggcaaggatccacgcttcggaagcggtcggcagatccggttgcgctttccacagcgcattcgccaccggcagtttcggcagggagtgcggtgttttcaccgtgtcgatgcagttaaccagcagacggtaacgatcgccgagatcaatcaggctggcgacaatggctggaccggtttgagtgttgaagatcaggcgggcaggatcgtctttaccgccaataccgagatgctgaacgtcgaggatcggtttctcttccacagcgatcgacggacagacttccagcatatgggagccgagtaccaggtcattacctttctcgaagtgataggtgtagtcctccataaaggaggtgccgccctgcagaccggttgacatcaccttcatgatgcgaagcagggcggcagttttccagtcgccttcgcccgcaaagccgtagccctgctgcatcagacgctgtacggccagacccggaagctgtttcaggccgtgcaaatcttcaaaggtagtagtgaaagcgtggaagccaccttgttccaggaaacgcttcatccccagctcaatacgcgccgcttccagcacgttctgtcgtttttcgccgtggatttgtgtggcaggtgtcatggtgtagcagctttcgtactcatcgaccagcgcgttaacatcgccgtcgcttatggagttcaccacctgcaccagatcgccaaccgcccaggtattgacggagaaaccaaacttgatctgtgcggcaactttatcgccatcggtgaccgctacttcacgcatgttatcgccaaaacggcagactttcagatgacgggtatcctgtttagagaccgcctgacgcatccaggagccaatacgctcatgtgcttgtttatcctgccagtgaccggtaacaacggcatgttgctgacgcatacgcgcgccgatgaagccgaactcgcgaccgccatgcgcggtctggttcaggttcataaagtccatgtcgatgctgtcccacggcagcgccgcgttgaactgggtgtggaattgcagcaacggtttgttgagcatggtcaggccgttgatccacattttggccggggagaaggtgtgcagccacaccaccagaccagcgcaacgatcgtcgtaattcgcgtcgcggcaaatagcggtgatttcatccggcgtggtgcccagcggtttcagcaccagtttgcagggcaacttcgcttctgtattcagtgcattaacaacgtgttccgcatgttgcgtcacctggcgcagagtctccgggccgtaaagatgttggctgccaattacaaaccacacttcataattatcaaaaatcgtcattgtcgtgtccttatagagtcggaacggcctgggcagcctgtgccggggcggaagttggaggatagtgttgttcggcgctcatcgcccattgctgatagcggcgataaagctgttcaaagcgttgtgcctgttcgctgcgcggttgcagggttttctctaccgcactggccattttttgctgggctgatgggatgtctgcgtgcactttcgcggcgacagcagcaaaaatcgccgcaccgagcgcacagcactggtcagaggcaacaatttgcagcgggcgattcagcacgtcgcagcaggcctgcataatgacctggtttttccgcgcgatgccgcccagcgccatcacgttattgacggcgatcccctgatcggtaaagcactccatgattgcgcgtgcgccaaaggtggtggcggcaattaaaccgccgaacagcagcggagcgtcggtggcgaggttcagatcggtaatcactcctttcaggcgttggttagcgtttggcgtgcggcgaccgttaaaccagtcgagcaccaccggcaggtgatccagagacggatttttggcccatgcttcggtcagcgccggaagcagttgtttctggctggcgttgatttgctctttcagttccggatgctgggcggcaagctgttccagcggccagctgagtacgcgtccaaaccaggcgtagatatcaccaaacgccgattggcctgcttccagaccgataaatccaggcaccacgctgccatcaacctgaccgcaaatacctttcactgcccgctcgccaacgctctgtttgtcggcaatcagaatgtcgcaggtggaagtaccgataacttttaccagagcgttaggctgtgcgcctgcgccaactgcgcccatatggcagtcaaacgcgccgccggaaatcaccacgctttcaggcaggccgagacgctgcgcccattccgggcataaggtgcccaccggaatatcggcagtccaggtgtcagtgaatagtggggaaggcaaatggcgattgaggattgggtccagctcatcaaagaaactggctggcggcaggccaccccagctttcgtgccacagagatttatgcccggcgctgcaacgtccgcgacgaatatcctgcgggcgggtggtaccggaaagcagagctggtacccagtcgcacagctcaatccacgatgcggcagattgcgccacggcgctgtcctggcgagtcacatgcaggatttttgcccagaaccattcgctggaataaataccgccaatatagcgggagtagtcaacgttgcccggcgcgtggcacaaacgggtaatctcttccgcttcttcaaccgcggtgtggtctttccacaatacgaacatcgcgttcgggttttcggcaaactccgggcgcagcgccaggacgttaccgtcggcgtcaatcggtgcgggcgtcgagccggttgtgtcaacgccaatcccgaccacagctgcgcgctgctcggcgctaagctctgcaagcacggttttcagcgccgcttccattgactcaatgtagtcacgcggatgatgacggaactggttatttggggcatcacaaaattgccctttctgccaacggggataccactctacgctggtggcgatctcttcaccggtggcgcaatccaccgccaaagctcgcacagaatcactgccaaaatcgaggccaattgcaatcgccatcgtttcactccatccaaaaaaacgggtatggagaaacagtagagagttgcgaaaaaaagcgtcaggtaggatccgctaatcttatggataaaaatgctatggcatagcaaagtgtgacgccgtgcaaataatcaatgtggacttttctgccgtgattatagacacttttgttacgcgtttttgtcatggctttggtcccgctttgttacagaatgcttttaataagcggggttaccggttggattagtgagaagagccagtaaaagacgcagtgacggcaatgtctgatgcaatatggacaattggtttcttctctgaatggcgggagtatgaaaagtatggctgaagcgcaaaatgatcccctgctgccgggatactcgtttaacgcccatctggtggcgggtttaacgccgattgaggccaacggttatctcgatttttttatcgaccgaccgctgggaatgaaaggttatattctcaatctcaccattcgcggtcagggggtggtgaaaaatcagggacgagaatttgtctgccgaccgggtgatattttgctgttcccgcctggagagattcatcactacggtcgtcatccggaggctcacgaatggtatcaccagtgggtttactttcgtccgcgcgcctactggcatgaatggcttaactggccgtcgatatttgccaataccggtttctttcgcccggatgaagcgcaccagccgcatttcagcgacctgtttgggcaaatcattaatgccggacaaggggaagggcgctattcggaattgctggcgataaatctgcttgagcaattgttactgcggcgcatggaagcgattaacgagtcgctccatccaccgatggataatcgggtacgcgaggcttgtcagtacatcagcgatcacctggcagacagtaattttgatatcgccagcgtcgcacagcatgtctgcctgtcgccgtcgcgtctgtcgcatttgttccgccagcagttagggattagcgtattaagctggcgcgaggaccagcgcatcagtcaggcgaagctgcttttgagcaccacccggatgcctatcgccaccgtcggtcgcaatgtcggttttgatgatcaactctatttctcgcgagtatttaaaaaatgcaccggggcgagtccgagcgagtttagggcaggttgtgaataataagaaagaagggggggaacccccttgctttcttcatctgacgttatttatatatttcacgggggattaattttagttatttttagttgaatcgttttacctgaattattttttttcttgataaaatatcgacaacgatttctttttgtaaaaataaaacgaaggcttatgtatcgggatacccatcatgaacatattgtccggttgcatcaggagaatatatcaagcggtttgttcatcgtaggaacaccacattgagcggttatggcaggcacttcacgccaccataaatgccgttcgatgtggcagttgttgaaaaaagtacggcattctatgaaaaacgccagttactccctcagaggagaacatggtctggcaaaagtgtagcggcatcaggcgcagctatctttgtaaattcattcataaaatgaattgtatacaaaaaaatattgaaaaataatatttttccttattgatattatttgctatacgttttttttgaggggagattgtgatgagcaaacgtaacgatattactgatggaatatttgcaacaacgaaaaagtatggattagtttataccgaagagttaggttggatcgatttggggcatgctcagggacaagatgccagaatattaaaaagaaaattggagcaagaacatttttcaacatattacgatgaatttcatgattggtattttcctgttgattatcatcaggaaatgggaattcggaaaaaaatattaggagtagatcttacatttcataccggtgtttatacgaaggttatggttcgttcatgtctttcacccactcttaaagcaagagttgccttaacgttaatgtatggaactgcgaagaggtttgaagcatggcaaaactcatttatttttaactggtatactgatagcggatttagtgcagaagatttagtctcagacttgattggtttttatcgtgtatttggaacaggccccgatccacttttattggcaaaacctttatcttacacaaaagccttacaaatatgggatacatatggagcgccagggaattttaaaaatactgagtttacgccattcttatttacaacccatcctccttttaaaaaaaatcaactaataaaaaagaagcttccagaatggttaaattatataaagccattagatgagtctttttcaatattgttatataatcaatataataatagacctgttactaattattataaagataaaaacagaataaatcatgagttgtatagttcattatcaagttcgggagctataaagttttcagaatctccctttgaaagaccgctttttcttttcttaaaccctcattatccgcacaggtcgtgagtagagatgtcaaaatatatttatattttattatcatttttagttttattctttatatttttctatgcttatatctcattgatgtcaaaggaacatcactatacacagcatgaactttccccatttttcctttatacgccagagagtttgcgaaatttgccaaacatatcaaacgtagccgagtatagctattactataatgttgatgatatgcaaacaagagtgattgttacatggcgaaatatagataacatttttcttcagaaagcaaagctaatagattttttgaaaagaatgggaccgagtctacaaaacgattgtatatggttttttcatgataaaagtgattatgcaaataatttccagcgttattgcatcattgagcaccgtgattctctgcaggtggaatattttgagactatcgaatgataggcagagggtgtcttttgtgccggttgtgaagaaaaagtgaatgatgtagccgtcaagttgtcataattggtaacgaatcagataattgacggcttgacggagtagcatagggtttgcagaatccctgcttcgtccatttgacaggcacattatgcaagcattgctggaacactttattacccaatccaccgtgtattcattgatggcggtggtgttggtggcctttctggagtcgctggcgctggtcggtttgattctacccggtacggtgctgatggcggggctgggagcgctgattggtagcggtgagttaagtttctggtacgcctggctggcggggattattggctgcctgatgggcgactggatctccttctggctgggctggcgttttaaaaagccgttgcatcgctggtcatttctgaagaagaacaaagcattactcgataaaaccgaacatgcgctgcatcagcacagcatgttcaccattctggtcggtcgttttgtcggtccgacgcgtccgctggtgccaatggtggcgggaatgctggatctcccggtggcaaaatttattacgccgaatattatcggctgcttgctgtggccacagttttacttcctgccggggattctggcgggtgcggcgatcgatattcctgccgggatgcagagcggtgagtttaaatggttgctgctggcaacagcggtgtttttgtgggttggaggctggctgtgctggcggttatggcgcagcggtaaagcgactgaccgtttgagtcattatttgtcccgcggtcgtttgttgtggctgacgccgttgatttctgccatcggcgtggtggcgctggtggtgttaattcgccacccgttgatgccggtgtatatcgatattttgcgtaaagtggttggggtttaggggatagccttgtgcgggttgcctgatgcgacgcttgccgcgtcttatcaggcctgcaaaacgcactacccgtaggtcggataaggcgttcacgccgcatccgacagtgcatattaacctttaattcccaacagcgccgaagcactcgccttaccgctcaacaactcatcggtcttaccctgccaggcgatacgcccgtcggcgaccaccaccgagcgcgtggcgatccgcgccgcatcttccacactgtgcgacaccatcaagagcgtcattttttgctgttggcagctcgaactcaccagcgtcagcatctcctgacgtagcgccggatcgagtgcggaaaacggttcatcgagcaataaaatgggctgttcgcgtaccagacaacgcgctaacgccacgcgctgtcgctgaccgccggaaagctcgccaggtaaccgcgccattaaattatcaatccccatctggtgggcaatcgcgtgcattttcttctgctgcgccgcatttagtttcaaccccggatttagccccagcccgatgttttgcgcgaccgtcagatggctgaacaggttgttctcctgaaacagcatcgacaccggacggcgtgacggcggcgtcgtggtgtgatctacgtcgtcgatagtcagcaaaccgctggctggcgtcagaaaaccggcgatcaaattaagcagggtacttttacctgcgccgcttggcccgaggatcgccacctgctcgccgcgttccaccgttaagctaaaacgcatcggcaaatggtggtaaagccaggtgatatcagtcagttttaacatttcgccccggtattttttcaatcacggtaaacagcagaaaacagagcagcagcagaattaacgcggtgaccgcgccgtcctggctgcgataggagccaatttgctggtagagataaaacggcagggtacggaaatcatcgttaccgaacaatgccaccacgccaaaatcaccaatcgacagcacacaagcaaaggccagcgcctgcgccagtggacgtttcagggcgcgcagctccaccacttttaagcgtgaccagccttcaatgcccagcgactgacacaacatgctgtagcgggcggtgatatcgcgcatcgggttttccagcactttcagcgcataagggattgccattaacgcattggtgaaaatcacaatgccgtcagcagattgtggcaggccgatagtgttgttgagcagtaaaaagaagcccgtagccagcacaatccccggcatggcgaggatcaacatgccgctcatctccagcgcctgacccgccagcattttctgccgcgcccgaagttcgcgactgctccatagcagcatcatggtcagcactacgcacaatacgcctgccgccagcgcaatacgcaacgaggtccacagcgcctgccacagcaccggttgtgccagcacttccggcaactggcgatttaccccatcgacgatcaccgccagtaacggtggcagcaacagcagcagcgccagcacaattaacgccgtgtcgcaaatgcgactatgcagacgatcgtccgggtcgcgccagccttgcagcagtgtggtaccaggcgcaatggccttactcaatcgctgactcaacagcaccagcccgaggcagcacaccatctggatcagcgccagcattgccgcgcgggcaggatcgtagtcgtaactcagcgcctgatagattgccagctcgatagtggtcgcctgcggaccgccgcccagcgatagcacggtggcgaagctggcgaaacagagcataaagattagtgcggcaaccggcgggatttgtcgccgtaaccacggccattcgacgaaacggaaaaaatgccagccgtgcatcccaagttgggcggcaagctgacgttgttcgccgggaatgttttccagtgcctggagtaataaacggctagccatcggcagattaaaaaacacatgggccagcaaaatgccttgcaggccgtagggcgaaaaggtccactccagaccaagtgattgccagagcgaggccagccagccctggcgaccatagacgctaagaatgccgaaaacagcaaccagcaccgggaggatcaaggtcattgcgcacagacgcaacagcatctgtcgcccaggaaagcgcctgcgatagagggcgcgggcgaggaatattgcgggtacgacagagagcagcgccgagagaaacgcctgccagaaggagaagcgcaccacatgccacaggtagctgtcctgccagactgccacccagtcaccctgcggcgcgttccaccacagggcgagaaacgccgccagtgcaaccgccaccaccagcgtggcggcgcttacgcctggaattaaccagccgggaattaacggctgacggcgcgttgccattcgctaatccatgcctgacgttgtgccgccacttcggcgggtgtgaactctagcgtggtggctggtttggtcaattgttcaaatcctgcaggcagagtgacgtttgctaccggatacatccagttgccggttgggatcgcattctgaaaagccggagaaaccataaactggaggaatttttgcgccagctctggctgcttgctggcagcggtgcgggcggcaacttccacctgcagatagtgaccttcgataaagtttgtggcggcgtagttatctttcttctcttcgagaatgtgataagccggagaggtggtgtaactcagtaccagatcgctttcgccttttaaaaacaggccgtaggcttcgctccagcctttggtgaccgtgacagttttcttcgccagtttctgccaggcttgcggggcgttatcgccatagactttttgcatccatagcaacagacccagccccggtgtactggtacgtggatcttcataaatcacccgccagttttgatcgctctcaaccagttctttcaggctttgcggcggatttttcagtttgttcttgtcatagacgaaggcgaaatagccgtaatcatacggtacgaaagtgtcattattccagccgccaggaacgttaacggcttccgctgccacaccgcttttagcaaacagctctgttttgctggcggcgtctaacagattgttatccagccccagcaccacatcggctttactgtttttgccttccatccgcagacggttgagaagcgaaacgccatcttccagcgccaccagtttcagttcgcaattacagtctgcttcaaaggcttttttgactaccggaccaggtccccagtcagcggcaaaggaatcgtaggtataaacagtcagaacaggtttagcgaaaacaggcgctgtgcacagcaacagcaggggaagacatttttttaacactttgcacctcacaaaagagtggcaaaggacttgagaaggagcctcaaatcccttcgccggcgttatccggatcaggttcgacgggtattttctcagcgcacgcggctgcgtggcaccccgttgagaacggcgttagtgtagtgattttgttatcaaccagcaatcatggatccggtggtgcaaaccacgctgatttaaaatcgaaccagccgagggtgttcatgcgcaggccgcgcatactacgttgcccctgaatgatcagccagtggtggataagtggcaccattgctttgctggcgaccagttgttggcaccagttcgccagattcatttcgccattgcgccagcgggcggcgtcggcttgccagtcgatcggaatacagtgttggagcagcggcacctcgcacaagtgcgcgaacagcgaaaaatccagcggcagcgtaaagttggcgctgttaagccagatatcgctctcgatctctccttcatgccactgatcgtagctgatctctttgatttccagcgtgacctggtgacttgccagaatctgctgcatgatcccggcaatcacccgatgctcgctgtgatcctgataaaaggtcagggtgaggctttccagaccagccggtttttcgctctttatggtgcgggcatggtgccaacgggggagcagtccataagccgggaaccacagttgctggtactgttcctcagcgaaatagaccagattcgtcggagaaagcacatagcttacccagtctctgacttgctgattcgcccctcgatgggtgcggctgtcgaacagtaaatagtagcaaccttcctccaggcggctttcaatctctttttcctcgccctgtggaccttttagcatcagccctccggctggctcgtcggcaatttccggcagaacccagacgttaacttcgtcgattaatgcccggtaaccgaagaagtcatcgaatgcctgaattttcagttgattggtgctgttgcggatcaccgcatacggaccggtgccgatgggatggctggcaaagttactgagggtttcccattcgcgcggcaggatcattgccggaacttgccccagcagtaacggcaaccagcggtccggttgcgtgagatggatatccagcgtccagggcgtcggcgacacaatgttagcaatatgcgaatagagcggaagcgtattgattcgttttaaagaggcgatcacatcgtccatttccagttcacgaccatggtgaaaatggactcctggacgcaaaaagaaacgccagtgaagcggtgatatttgctgccagtggtgtgcgatgtctgcttccagttccccattttcctcatttatgcgcgttagcgaactgaagatttgccgggcgatatgggtttcagaacggcgcaatgcgctgccaggtagcagattacgcaacggacgatagtagagcacgcgcaggatgtgccgcccctggcggaagctgcggcccagatgagaaaccagcatttgccgcacagtcgctttgtcgccaaccaactgcactagttggtcgatacgatcctgctccagcaggtcttccgcccgctgttgctgaagcgccagcccggtatagaggaatgtcaggcgtgaacgtttaccgcgcccgacttccgcttcccacgtcagccagccgcgatcctgcatggtgttgagcagggtgcgcatatgacgacgcgagcaactcagtaacgctgccagttcgttgagcgtggtctcctgagatttaccctcgcagcattgccacaggcggatgaactgttgttgcagacgagcagatggcataaaaggggaactcctgcgcaaaagacagcaattttattttccctatattaagtcaataattcctaacgatgaagcaaggaggtgccccatgcgtcagttttatcagcactattttaccgcgacagcgaagttgtgctggttgcgttggttaagcgtcccacaacgattaaccatgcttgaagagctgatgcagtgggaggggagtcattctgactactgatttgcggacatcatgtgtgactgagtattggtgttaatcgccacgccagcagtgattatctgctggcttttttctttttggcgattgagtgccggacggtgtacaaactaacgcataaacgccggttgcttctcttcataagacgcaatagcatcgtcgtgctgcagagtcaggccgatgctgtccagaccgttcatcatgcagtggcggcggaaggcatcgatggtaaagcgataagttttctctcccgctttcacctcttgcgcttccaggtctacatcaaaatgaatccccggattggctttcaccagcgcaaacagctcatccacttctgcatcgcttaatttcaccggcagcagctggttgttaaagctattgccgtagaagatgtcagcaaaactcggcgcaatcaccaccttaaaaccgtaatcggtcaatgcccacggcgcgtgctcacgcgaggaaccgcagccgaagttttctcgtgccagcaaaatggaagcgccctgatactgcgggaagttcagcacgaagtccgggtttggctgttggcctttttcatccagaaaacgccagtcgttaaacagatgcgcgccaaaacccgtacgggtcactttctgcaaaaactgtttcgggatgattgcatcggtatcgacattggcggcatccaacggaaccaccaggcctgtgtgtttgataaatttctctgccatggtgtgctccttatttaatgttgcgaatgtcggcgaaatgtccggtcacagccgcggcggcagccattgccggactgaccagatgcgtgcgcccgccgcgcccctggcggccttcaaagttacggttgctggtggaggcgcaacgttcgcccggattcaggcggtcgttgttcatcgccaggcacattgaacaacctggcaagcgccattcaaaaccagcttcgataaaaattttgtccagaccttccgcttccgcctgggctttaaccggaccggagccgggaaccaccagcgcttgtacgcctggcgcgactttccggcctttggcgatttccgctgccgcgcgtaaatcttcaatacgcgagttagtacaggaaccaataaacactttgtcgatagccacttctgtcagcggaatacccggtttcagccccatataggccagcgctttttctgccgacgcgcgttcaaccggatcggcaaacgaagccggatcgggaatattgtcgttcacagaaatcacctggcctggattggtgccccaggtgacctgcggcgaaatctcttctgcttgcagagtgacaacggtatcgaaagttgctccttcgtcggtttgcagggttttccagtaggcaacggcgtcgtcgaaatctttgcctttcggcgcatgcagacggcctttaacatagttaaaggtggtttcgtccggtgcaaccagaccggcttttgcgcccatttcgattgccatattgcacagggtcatacgaccttccatgcttaaatcacggattgcttcgccgcaaaattccaccacatgcccggtaccgcctgcgctgccggttttaccaataattgccagcacgatatcttttgcggtaatgcccggcgcggctttgccctggacttcaattttcatggtcttcgcccggccctgtttcagggtttgcgttgccagtacgtgttcaacttcggaagtgccgataccaaaggccagtgcgccaaacgcgccgtgggtggcggtatgtgagtcgccgcagacaatggtcatccccggcaaggtcacgccctgttccggccccattacgtggacgatcccctgatacgggtgattcaggtcatacagctcgacgccaaattctttgcagtttttgatcagctcctgcatctggatgcgcgccatttcaccgcaggcattaatgtctttcgtctgagtagagacgttgtgatccatggtggcgaaggttttgcccggctgacgtaccgggcgaccgtgggcgcgcagaccatcgaacgcctgcggtgaggtcacttcatgcaccaggtggcggtcgatatataacagcggggtttcgttttcggcttcgtacactacgtgagcgtcgaataatttttcgtataacgtcttagccatgattacaccccttctgccacatagcgggcaatgatatcgcccatttcatcggtactaacggcggcagcgccacgggctaaatccccagtgcgaatgccttcttctaatgcgcggttaatggcgcgttcaatggcggaagccgcatcatcggcatccaggctgtaacgcagcagcagcgccagcgacagaatttgtgcaatcgggttggcgatatttttacctgcgatatcgggtgccgagccgcccgccggttcatacagaccaaaaccttgctcgttcaggctggcggaaggcaacatccccattgagccagtgatcattgcgcactcatcagacagaatgtcgccaaacaggttggagcacagcaagacgtcaaactgtgatggatctttaatcagctgcatggtggcgttgtcgatgtacatatgcgccagttcgacatccgggtattccgtggcgatctcgttaacgatctcccgccataaaatagaggattgcagcacgttggctttgtcgattgaggtgactttgtggcgacgcttgcgggcagattcaaatgcgatgcgggcaatacgctcgatctcaaaacggtggtacacctcggtatcaaacgctttttcatattgtccgctaccttcgcggccttttggctgaccgaaatagatgccgccggtcagttcgcgcacacacaggatgtcaaagccgtttgcggcaatgtcagcacgcagtgggcagaacgcttccagcccctgatacagttttgccggacgcagattgctgaataatttgaagtgtttacgcaaaggcagcagtgcgccgcgttctggttgctggtctggcggcaaatgttcccacttcggaccacctaccgagccaaacagcacggcatcggcttgctcacaaccttcaaccgtcgcaggcggcagcggctgtccgtggttatcaatggctgcgccgcctacatcgtaatggctggtggtgatacgcatcgcaaatcggttgcgcacggcatccagcactttcagcgcctgggtcatcacttccggaccaataccgtcccccggcaatacggcaatatggtaattcttcgacatcacacggtttccttgttgttttcgttgtgttgagctttgcgttgcaactctttttcgacttctgcggcacgccagatattgttcagtacgtgcaccatggctttggcggaggactcgacaatatcggtggccaggccgacgccgtggaagcggcgaccgttgtagttggcgacaatatccacctgacccagcgcatctttaccgtggcctttggcggtcaggctgtatttcaccagttcgacgttatagtcagtgatgcggtttatcgcctggtagacggcatcgaccggaccgttaccgttggcggcttctgctttgacttcttcgccacaggccagtttgacggcggcagtggcaatatcgttagaacctgactgcacgctgaagtaatccagacggaaatgctccggctcttcttgctgcttaccgatgaaggccagcgcctccagatcgtaatcaaacacctggccttttttgtccgccagcttcaggaaagcgtcgtacaggttgtctaaattatattcactttctttatatcccatctcatccatgcgatgtttcaccgccgcacgccccgaacgagaggtcagattcagctggatttggttcagaccaatagattctggtgtcatgatttcgtagttttcgcggtttttcagtacaccatcctggtggataccggaggagtgtgcgaatgcgccgctgccaacaatggctttgtttgccgggatcggcatattacaaatctggctaactaactggctggtgcgccatatctcctggtgattgatggcggtgtggacgttgagaatatccttacgaactttgatcgccatgatgacttcttcaagggaacagttaccggcacgctcgccgatcccgttcattgcgccttctacctgccgtgctccggcatgtaccgccgccagtgagttgccgaccgccaggcccaaatcgtcgtgggtatgtacggaaataatggctttgtcgatgttgggtacgcgttcatacaggccgctgatgattccggcgaactcaaatggcatggtgtagcccacggtgtctggaatgttgatggtggtggcaccggcattaatcgccgcttcgaccactcgcgccagatcggcaattggggtgcgtccggcatcttcgcaagaaaattcaacatcatcggtgtaattacgggcgcgtttcaccatatagatagcgcgttcgatcacttcgtccagcgtgctgcgcagcttggtggcgatgtgcattggcgaagtggcaataaaggtatgaatacggaaggcttcggcgactttcagggattcggctgccacgtcaatatctttttccacgcagcgagctaacgcgcatacacggctgtttttaacctggcgagcgatggtctgcactgattcaaaatcacccggcgaagagacggggaaaccgacttccataacgtcaacacccatacgctcaagggccagcgcaatttgcagtttttctttcacactcaagcttgcctgtaacgcctgttcaccgtcgcgcaatgtggtatcgaaaataatgacttgctggctcatggtttgggtccttgtctctttttgagcgcctcgcttcgggcataaaaaaacccgcgcaatggcgcgggtttttgtttgactgcgtgctggcttaatgctggatgccgctcactcgtctaccgcgcaaaaaagatgcgtttagtagtagtagaccgataaagcgaacgatgtgagtcattaaatcagctccagatgaatgcgatatgcttttagagttactggatacaaaaacggatgtcaaccctgaagcaataaaaacgtcacgccattgtgagttcggcatccgtaaaattagctaattgtgctgcggtggttaaaacaagcgatattaatttctgcttaaccgccgatgcttttcatcggttgacatatttcagaataattttttgcatctaatcaacgagggaaagggggataaaatgcacgcgttacaaaacctatcctgatgatttgtattgaattatatgttttgcgaattttttgatattcatttgctgaatattattgatcaattaatgttaagaattaatgcattaaacatataaattaattattaaaaaacacatttaatccattttgtggatgattgagtattcgtggtagttatgattagattgttttcgcaacaaaaacattatggattattatgctgtagtaaatgactctttgctcggcagtggattctgtttttatcagaacctgtatctttatgttttcctaattttactcattttgctttttcttattttatatgcatgataaatcatattctcgaggattatttctctgcattccaataagggaaagggagttaagtgtgacagtggagttaagtatgccagaggtacaaacagatcatccagagacggcggagttaagcaagccacagctacgcatggtcgatctcaacttattaaccgttttcgatgccgtgatgcaggagcaaaacatcacccgtgccgctcatgctctgggaatgtcgcaacctgcggtcagtaacgctgttgcacgcctgaaggtgatgtttaatgacgagctttttgttcgttatggccgtggtattcaaccgactgctcgcgcatttcaactttttggctcagttcgtcaggcattgcaactagtacaaaatgaattgcctggttcaggttttgaacccgcgagcagtgaacgtgtatttcatctttgtgtttgcagcccgttagacagcattctgacctcgcagatttataatcacattgagcagattgcgccaaatatacatgttatgttcaagtcttcattaaatcagaacactgaacatcagctgcgttatcaggaaacggagtttgtgattagttatgaagacttccatcgccctgaatttaccagtgtgccattatttaaagatgaaatggtgttggtagccagcaaaaatcatccaacaattaaaggcccgttactgaagcatgatgtttataacgaacaacacgctgcggtttcgctcgatcgtttcgcatcatttagtcaaacctggtatgacacggtagataagcaagccagtatcgcgtatcagggcatggcaatgatgagcgtacttagcgtggtgtcgcaaacgcatctggtcgctattgcgccgcgttggttggctgaagagttcgctgaatccttagagttacaggtattaccgctgccgttaaaacaaaacagcagaacctgttatctctcctggcatgaagctgccgggcgcgataaaggccatcagtggatggaagagcaattagtctcaatttgcaaacgctaactgaatgcagaataggtcagacatcaatgtctggtttattctgcattttttattgaatgtagaattttattctgaatgtttgtgctctctattttaggattaattaaaaaaatagagaaattgctgtaagttgtaggattcagccgatttattatcaatttcatcctctgtaatggaggattttatcgtttcttttcacctttcctcctgtttattcttattaccccgtgtttatgtctctgtctgccaattgcttaagcaagatcggacggttaatgtgttttacacattttttccgtcaaacagtgaggcaggccatggagatgttgtctggagccgagatggtcgtccgatcgcttatcgatcagggcgttaaacaagtattcggttatcctggaggcgcggtccttgatatttacgatgcattgcataccgtgggtggtatcgatcatgttttagttcgccatgagcaggcggcggtgcatatggccgatggtctggcgcgcgcgaccggggaagtcggcgtcgtgctggtaacgtcgggtccaggggcgaccaatgcgattactggcattgccaccgcttatatggattccattccattagttgtcctttccgggcaggtagcgacctcgttgataggttatgatgcctttcaggagtgcgacatggtggggatttctcgcccggtggttaaacacagttttctggttaagcaaacggaagacattccgcaggtgctgaaaaaggctttctggctagcggcaagtggtcgtcctggacccgtggtcgttgatttaccgaaagatattctaaatccggcgaacaaattaccctatgtctggccggagtcggtcagtatgcgttcttacaatcccacgacctccgggcataaagggcaaattaagcgcgctctgcaaacgctggtggcggcaaaaaaaccggttgtctacgtaggcggtggggcaatcacggcgggctgccatctgcagttgaaagaagcggtggaggtgttgaatctgcccgttgtttcctctttgatggggctgggggcgtttccggcaacgcatcgccaggcactgggcatgttgggaatgcacggtacctacgaagccaatatgacgatgcataacgcggatgtgattttcgccgtcggggtacgttttgatgaccgaacgacgaacaatctggcaaagtactgcccaaatgccactgttctgcatatcgatattgatccaacctcaatttctaaaaccgtgactgctgatatcccgattgtgggggatgctcgccaggtcctagaacaaatgcttgaactcctgtcgcaagaatccgcccatcaaccgctggatgagatccgcgactggtggcagcagattgaacagtggcgcgctcgtcagtgcctgaaatatgacactcacagtgaaaagattaaaccgcaggcggtgatcgagactctttggcggttgactcatggggacgcttacgtgacgtccgatgtcgggcagcaccagatgtttgctgcgctttattatccattcgacaaaccgcgtcgctggatcaactctggcggcctcggcacgatgggttttggtttacctgcggcactgggcgtcaaaatggcgttgccagaagaaaccgtggtttgcgtcactggtgacggcagtattcagatgaacatccaggaactgtctaccgcgttgcaatatgagttgcccgtactggtggtgaatctcaataaccgctatctggggatggtgaagcagtggcaggacatgatctattccggccgtcattcacaatcttatatgcagtccttaccagacttcgtccgtctggcggaagcctatggtcacgtcgggatccagatctctcatccgcaagaactggaaagcaaacttagcgaggcgctggaacaggtgcgcaataatcgcctggtgtttgttgatgttaccgtcgatggcagtgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtgcttgagcaaatcgaaaagcaattacacaagctggtcgatgtcttgcgcgtgagcgagttggggcagggcgcgcacgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcgataagcttgatgcatttttagcatcgattcgcgatgtggcgaaaattgtggaagttgctcgctctggtgtggtcggactttcgcgcggcgataaaataatgcgttgagaatgatctcaatgcgcaatttgcagcccaacatgtcacgttgggctttttttgcgaaatcagtgggaacctggaataaaagcagttgccgcagttaattttctgcgcttagatgttaatgaatttaatccataccagtacaatggctatggtttttacattttacgcaaggggcaattgtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctaactatcttgaacgccaggcgcggcaacggggttatcaactgctgattgcctgctcggaagatcagcccgacaacgaaatgcgctgcattgagcaccttttacagcgtcaggttgatgccattattgtttcgacgtcgttgccacctgagcatcctttttatcaacgctgggctaacgacccgttcccgattgtcgcgctggaccgcgccctcgatcgtgaacacttcaccagcgtggttggtgccgatcaggatgatgccgaaatgctggcggaagagttacgtaagtttcccgccgagacggtgctttatcttggcgcgctgccggagctttctgtcagcttcctgcgtgaacaaggcttccgtactgcctggaaagatgatccgcgcgaagtgcatttcctttatgccaacagctatgagcgggaggcagctgcccagttattcgaaaaatggctggaaacgcatccgatgccgcaggcgctgttcacaacgtcgtttgcgctgttgcaaggggtgatggatgtcacgctacgtcgcgacggcaaactgccttctgacctggcaattgccacctttggcgataacgaactgctcgacttcttacagtgcccggtgctggcagtggctcaacgtcaccgcgatgtcgcagaacgtgtgctggagattgtcctggcgagcctcgatgaaccgcgtaagccaaaacctggtttaacgcgcattaaacgtaatctctatcgccgcggcgtgctcagccgtagctaagccgcgaacaaaagtacgcgccaggtgaatttctctctggcgcgttgagtacgggaatggacatcaatatccttaaagtaaataagactattcctggctattattgataaatgcttttaaacccgcccgttaattaactcacctgctgaaattcacaataattaaatgatattgacagcgcgtttttgcattattttgttacatgcagagatgaattgccgatttaacaaacacttttctttgtttttgcgcaaacctgctggcatcaagcgccacacagacgcaacagggactgttaaccagagaagatatgtcctaaaatgccgctcgcgtcgcaaactgacactttatatttgctgtggaaaatagtgagtcattttaaaacggtgatgacgatgagggattttttcttacagctattcataacgttaatttgcttcgcacgttggacgtaaaataaacaacgctgatattagccgtaaacatcgggttttttacctcggtatgccttgtgactggcttgacaagcttttcctccgctccgtaaactcctttcagtgggaaattgtggggcaaagtgggaataaggggtgaggctggcatgttccggggagcaacgttagtcaatctcgacagcaaagggcgcttatcagtgcctacccgttatcgggaacagctgcttgagaacgctgccggtcaaatggtttgcaccattgacattcatcacccgtgcctgctgctttaccccctgcctgaatgggaaattatcgagcaaaaattatcgcgtctgtcgagcatgaacccggttgagcgccgtgtgcagcgcctactgttaggtcatgccagcgaatgtcagatggatggcgcaggtcgattgttaatcgcgccagtactgcggcaacatgccgggctgacaaaagaagtgatgctggttggacagttcaacaagtttgagctgtgggatgaaacaacctggcatcaacaggtcaaggaagatatcgacgcagagcagttggctaccggagacttatcggagcgactgcaggacttgtctctataaaatgatggaaaactataaacatactacggtgctgctggatgaagccgttaatggcctcaatatccgtcctgatggcatctacattgatgggacttttggtcgcggtggtcactcacgtctgatcctctcgcagcttggcgaagaggggcgtttgctggcgatcgatcgcgacccgcaggctatcgccgttgcgaagactattgatgatccgcgcttctccatcatccacggacctttctccgcgctgggcgaatacgttgccgagcgcgatcttatcggcaagatcgacggcattctcctcgatcttggcgtctcttcaccgcaacttgatgatgctgagcgcggcttttcctttatgcgcgatggtccgctggacatgcgtatggacccaacccgtgggcagtcagccgctgaatggctacaaaccgcagaagaagccgatatcgcctgggtattgaaaacctatggtgaagagcgttttgccaaacgcattgcccgcgccattgtcgagcgtaaccgcgaacagccgatgacccgcaccaaagaactggcggaagtcgtggctgccgcaacgccggtgaaagataagtttaaacatcccgcgacccgtaccttccaggcggtgcgcatttgggtaaacagtgaactggaggagatagagcaggcgctaaaaagctcgctcaatgtgctggccccgggtgggcggctttcgatcatcagcttccactcgctggaagaccgcattgtgaaacgttttatgcgtgaaaacagccgcggtccgcaagttccggcagggttaccgatgacagaagagcagctcaaaaaactggggggccgtcagttgcgagcactaggtaagttgatgccgggcgaagaagaggtggctgagaaccctcgtgcccgtagttcagttctgcgtattgcagagaggacgaacgcatgatcagcagagtgacagaagctctaagcaaagttaaaggatcgatgggaagccacgagcgccatgccttgcctggcgttatcggtgacgatcttttgcgatttgggaagctgccactctgcctgttcatttgcattattttgacggcggtgaccgtggtaaccacggcgcaccatacccgtttactgaccgctcagcgcgaacaactggtgctggagcgagatgctttagacattgaatggcgcaacctgatccttgaagagaatgcgctcggcgaccatagccgggtggaaagaatagccacggaaaagctgcaaatgcagcatgttgatccgtcacaagaaaatatcgtagtgcaaaaataaggataaacgcgacgcatgaaagcagcggcgaaaacgcagaaaccaaaacgtcaggaagaacatgccaactttatcagttggcgttttgcgttgttatgcggctgtattctcctggcgctggcttttctgctcggacgcgtagcgtggttacaagttatctccccggatatgctggtgaaagagggcgacatgcgttctcttcgcgttcagcaagtttccacctcccgcggcatgattactgaccgttctggtcgcccgttagcggtgagtgtgccagtaaaagcgatttgggctgacccaaaagaagtgcatgacgctggcggtatcagcgtcggtgaccgctggaaggcgctggctaacgcgctcaatattccgctggatcagctctcagcccgcattaacgccaacccgaaagggcgctttatttatctggcgcgtcaggtaaaccctgacatggcggactacatcaaaaaactgaaactgccggggattcatctgcgtgaagaatctcgccgttattatccatccggcgaagtgactgctcacctcatcggctttactaacgtcgatagccaagggattgagggcgtcgagaagagtttcgataaatggcttaccgggcagccgggtgagcgcattgtgcgtaaagaccgctatggtcgcgtaattgaagatatttcttctactgacagccaggcagcgcacaacctgacgctgagtattgatgaacgcctgcaggcgctggtttatcgcgaactgaacaacgcagtggcctttaacaaggctgaatctggtagcgccgtgctggtggatgtcaacaccggtgaagtgctggcgatggctaacagcccgtcatacaacccaaataatctgagcggcacgccgaaagaagcgatgcgtaaccgtaccatcaccgacgtgtttgaaccgggctcaacggttaaaccgatggtggtgatgaccgcgttgcaacgtggcgtggtgcgggaaaactcggtactcaataccgttccttatcgaattaacggtcacgaaatcaaagacgtggcgcgctacagcgaattaaccctgaccggggtattacagaagtcgagtaacgtcggtgtttccaaactggcgttagcgatgccgtcctcagcgttagtagatacttactcacgttttggactgggaaaagcgaccaatttggggttggtcggagaacgcagtggcttatatcctcaaaaacaacggtggtctgacatagagagggccaccttctctttcggctacgggctaatggtaacaccgttacagttagcgcgagtctacgcaactatcggcagctacggcatttatcgcccactgtcgattaccaaagttgaccccccggttcccggtgaacgtgtcttcccggaatccattgttcgcaccgtggtgcatatgatggaaagcgtggcgctaccgggcggcggcggcgtgaaggcggcgattaaaggctatcgtatcgccattaaaaccggtaccgcgaaaaaggtcgggccggacggtcgctacatcaataaatatattgcttataccgcaggcgttgcgcctgcgagtcagccgcgcttcgcgctggttgttgttatcaacgatccgcaggcgggtaaatactacggcggcgccgtttccgcgccggtctttggtgccatcatgggcggcgtattgcgtaccatgaacatcgagccggatgcgctgacaacgggcgataaaaatgaatttgtgattaatcaaggcgagggtacaggtggcagatcgtaatttgcgcgaccttcttgctccgtgggtgccagacgcaccttcgcgagcactgcgagagatgacactcgacagccgtgtggctgcggcgggcgatctctttgtagctgtagtaggtcatcaggcggacgggcgtcgatatatcccgcaggcgatagcgcaaggtgtggctgccattattgcagaggcgaaagatgaggcgaccgacggtgaaatccgtgaaatgcacggcgtaccggtcatctatctcagccagctcaacgagcgtttatctgcactggcgggccgcttttaccatgaaccctctgacaatttacgtcttgtaggcgtaacgggcaccaacggcaaaaccacgacgacccagctgctggcacagtggagccaactgcttggcgaaaccagcgcggtaatgggcaccgttggtaacggcctgctggggaaagtgatcccgacagaaaataccaccggttcggcagtcgatgttcagcatgagctggcggggctggtggatcagggcgcgactttttgcgcaatggaagtttcatcccacgggctggtacaacaccgtgtggcggcattgaaatttgcggcgtcggtctttaccaacttaagccgcgatcaccttgattatcatggtgatatggaacactacgaagctgcgaaatggctgctttattctgagcatcattgcggtcaggcgattattaacgccgacgatgaagtgggccgccgctggctggcaaaactgccggacgcggttgcggtatcaatggaagatcatatcaatccgaactgtcacggacgctggttgaaagcgaccgacgtgaactatcacgacagcggtgcgaccattcgctttagctcgagttggggcgatggggaaattgaaagtcgcctgatgggcgcattcaacgtcagcaacctgctgctggcgctggcgacactgctggcactcggctatccgctggctgatttgctgaaaaccgccgcgcgtctgcaaccggtttgcggacgtatggaagtgttcactgcaccaggcaaaccgacggtggtggtggattacgcgcatacgccggatgcactggaaaaagccttacaggcggcgcgcctgcactgtgcgggcaagctgtggtgcgtctttggctgcggtggcgatcgtgataaaggcaaacgtccactgatgggcgcaattgctgaagagtttgctgacgtggcggtggtgacggacgataacccgcgtaccgaagagcctcgtgccatcatcaacgatattctggcgggaatgttagatgccggatatgccaaagtgatggaaggccgtgctgaagcggtgacttgcgccgttatgcaggctaaagagaatgatgtggtactggtcgcgggcaaaggccatgaggattaccagattgttggcaatcagcgtctggactactccgatcgcgtcacggtggcgcgtctgctgggggtgattgcatgattagcgtaacccttagccaacttaccgatattctcaacggtgaactgcaaggtgcagatattacccttgatgctgtaaccactgacacgcgaaaactgacgccgggctgcctgtttgttgccctgaaaggcgaacgtttcgatgctcatgattttgccgaccaggcgaaagctggcggcgcaggcgcactactggttagccgtccgctggatattgatctgccgcagttaatcgtcaaggatacgcgtctggcgtttggtgaactggctgcatgggttcgccagcaagttccggcgcgcgtggttgctctgacaggttcctccggcaaaacctccgttaaagagatgacggcggcaattttaagccagtgcggcaacacactttatacggcaggcaatctcaataacgacatcggtgtaccgatgacgctgttgcgcttaacgccggaatacgattacgcagttattgaacttggcgcgaaccatcagggtgaaattgcctggactgtgagtctgactcgcccggaagcggcgctggtcaacaacctggcagcggcgcatttggaaggttttggctcgcttgcgggtgtcgcgaaagcgaaaggtgaaatctttagcggcctgccggaaaacggtatcgccattatgaacgccgacaacaacgactggctgaactggcagagcgtaattggctcacgcaaagtgtggcgtttctcacctaatgccgccaacagcgatttcaccgccaccaatatccatgtaacctcgcacggtacggaatttaccctgcaaacccctacaggtagcgtcgatgttctgctgccgttgccggggcgtcacaatattgcgaatgcgctggcagccgctgcgctctccatgtccgtgggcgcaacgcttgatgctatcaaagcggggctggcaaatctgaaagctgttccaggccgtctgttccccataaaactggcagaaaaccagttgctgctcgacgactcctacaacgccaatgtcggttcaatgaccgccgctgttcaggttctggctgaaatgccgggctaccgcgtgctggtggtgggcgatatggcggaactgggcgctgaaagcgaagcctgccatgtacaggtgggcgaagcggcaaaagctgctggtattgactgcgtgttaagtgtgggtaaacaaagccatgctatcagcaccgccagcggcgttggcgaacatttttccgataaaactgcgcttatcgcgcgtcttaaatcactgattgctgagcaacaggtaattacgattttagttaagggttcacgtagtgctgccatggaagaggtagtacgcgctttacaggagaatgggacatgttagtttggctggccgaacatttggtcaaatattattccggctttaacgtcttttcctatctgacgtttcgcgccatcgtcagcctgctgaccgcgctgttcatctcattgtggatgggcccgcgtatgattgctcatttgcaaaaactttcctttggtcaggtggtgcgtaacgacggtcctgaatcacacttcagcaagcgcggtacaccgaccatgggcgggataatgatcctgacggcgattgtgatctccgtgctgctgtgggcttacccgtccaatccgtacgtctggtgcgtactggtggtgctggtaggttatggtgttattggctttgttgatgattatcgcaaagtggtgcgtaaagacaccaagggcctgattgcccgttggaagtatttctggatgtcggtcattgcactgggtgttgccttcgcgctgtaccttgccggcaaagacacgcccgcaacgcagctggtggttccgttctttaaagatgtgatgccgcaactggggctgttctacattctgctggcttactttgtcattgtgggtactggcaacgcggtaaacctgaccgatggtctcgacggtctggcaattatgccgaccgtatttgtcgccggtggttttgcgctggtggcgtgggcgaccggcaacatgaactttgccagctatttacacataccgtatctacgacacgccggggaactggtcattgtctgtaccgcgatagtcggggcagggctgggcttcctgtggtttaacacctatccggcgcaggtctttatgggcgatgtaggttcgctggcgttaggtggtgcgttaggtattatcgccgtactgctgcgtcaggaattcctgctggtgattatggggggcgtgttcgtggtagaaacgctttccgtcatcctgcaggtcggctcctttaaactgcgcggacaacgtattttccgcatggcaccgattcatcaccactatgaactgaaaggctggccggaaccgcgcgtcattgtgcgtttctggattatttcgctgatgctggtcctgattggtctggcaacgctgaaggtacgttaatcatggctgattaccagggtaaaaatgtcgtcattatcggcctgggcctcaccgggctttcttgcgtggactttttcctcgctcgcggtgtgacgccgcgcgttatggatacgcgtatgacaccgcctggcctggataaattacccgaagccgtagaacgccacacgggcggtctgaatgatgaatggctgatggcggcagatctgattgtcgccagtcccggtattgcactggcgcatccatccttaagcgctgccgctgatgccggaatcgaaatcgttggcgatatcgagctgttctgtcgtgaagcacaagcaccgattgtggcgattaccggttctaacggcaaaagcacggtcaccacgctagtgggtgaaatggcgaaagcggcgggggttaacgttggtgtgggtggcaatattggcctgcctgcgttgatgctgttggatgatgagtgcgaactgtacgtgctggaactgtcgagcttccagctggaaaccacctccagcttacaggcggtagcagcgaccattctgaacgtgactgaagatcatatggatcgctatccgtttggtttacaacagtatcgtgcagcaaaactgcgcatttacgaaaacgcaaaagtttgcgtggttaatgctgatgatgccttaacaatgccgattcgcggtgcggatgaacgctgcgtcagctttggcgtcaacatgggcgactatcacctgaatcatcagcagggcgaaacctggctgcgggtgaaaggcgagaaagtgctgaacgtgaaagaaatgaaactttccgggcagcataactacaccaatgcgctggcggcgctggcgctggcagatgccgcagggttaccgcgtgccagcagcctgaaagcgttaaccacattcactggtctgccgcatcgctttgaagttgtgctggagcataacggtgtgcgctgggttaacgattcaaaagcgaccaacgtcggcagtacggaagcggcgctgaatggcctgcacgtagacggcacgctgcatttgttgctggggggcgatggtaaatcggcggactttagcccactggcgcgttacctgaatggcgataatgtacgtctgtattgtttcggtcgggacggcgcgcagctggcggcgctacgcccggaagtggcagaacaaaccgaaaccatggaacaggcgatgcgcttgctggctccgcgtgttcagccgggcgatatggttctgctctccccggcctgtgccagccttgatcaattcaagaactttgaacaacgaggcaatgagtttgcccgtctggcgaaggagttaggttgatgcgtttatctctccctcgcctgaaaatgccgcgcctgccaggattcagtattctggtctggatctccacggcgctaaagggctgggtgatgggctcgcgggaaaaagataccgacagcctgatcatgtacgatcgcaccttactgtggctgaccttcggcctcgcggcgattggctttatcatggtgacctcggcgtcaatgcccatagggcaacgcttaaccaacgatccgttcttcttcgcgaagcgtgatggcgtctatctgatcctggcattcattctggcgatcattacgctgcgtctgccgatggagttctggcaacgctacagtgccacgatgctgctcggatctatcatcctgctgatgatcgttctggtagtgggtagctcggttaaaggggcatcgcgttggatcgatctcggtttgctgcgtatccagcctgcggagctgacaaaactgtcgctgttttgctatatcgccaactatctggtgcgtaaaggcgacgaagtacgtaataacctgcgcggcttcctgaaaccgatgggcgtaattctggtgttggcagtgttactgctggcacagccagaccttggtacggtggtggtgttgtttgtgactacgctggcgatgttgttcctggcaggagcgaaattgtggcagttcattgccattatcggtatgggcatttcagcggttgtgttgctgatcctcgccgaaccgtaccgtatccgccgtgttaccgcattctggaacccgtgggaagatccctttggcagcggctatcagttaacgcaatcgttgatggcgtttggtcgcggtgaactgtggggacaaggtttaggtaactcggtacaaaaactggagtatctgccggaagcgcatactgactttattttcgccattatcggcgaagaactggggtatgtcggtgtggtgctggcacttttaatggtattcttcgtcgcttttcgcgcgatgtcgattggccgcaaagcattagaaattgaccaccgtttttccggttttctcgcctgttctattggtatctggtttagtttccaggcgctggttaacgtaggcgcggcggcggggatgttaccgaccaaaggtctgacattgccgctgatcagttacggtggttcgagcttactgattatgtcgacagccatcatgatgctgttgcgtattgattatgaaacgcgtctggagaaagcgcaggcgtttgtacgaggttcacgatgagtggtcaagggaagcgattaatggtgatggcaggcggaaccggtggacatgtattcccggggctggcggttgcgcaccatctaatggctcagggttggcaagttcgctggctggggactgccgaccgtatggaagcggacttagtgccaaaacatggcatcgaaattgatttcattcgtatctctggtctgcgtggaaaaggtataaaagcactgatagctgcgccgctgcgtatcttcaacgcctggcgtcaggcgcgggcgattatgaaagcgtacaaacctgacgtggtgctcggtatgggcggctatgtatcaggtccaggtggtctggccgcgtggtcgttaggcattccggttgtacttcatgaacaaaacggtattgcgggcttaaccaataaatggctggcgaagattgctaccaaagtgatgcaggcgtttccaggtgcttttcctaatgcggaagtggtgggtaacccggtgcgtaccgatgtgctggcgctgccgttgccgcagcaacgtttggctggacgtgaaggtccggttcgtgtgttggtagtgggtggttcccagggcgcacgcattcttaatcagacaatgccgcaggttgctgcgaaactgggtgattcagtcactatctggcatcagagcggcaaaggttcgcaacaatccgttgaacaggcgtatgccgaagcggggcaaccgcagcataaagtgacggaatttattgatgatatggcggcggcgtatgcgtgggcggatgtcgtcgtttgccgctccggtgcgttaacggtgagtgaaatcgccgcggcaggactaccggcgttgtttgtgccgtttcaacataaagaccgtcagcaatactggaatgcgctaccgctggaaaaagcgggcgcagccaaaattatcgagcagtcacagcttagcgtggatgctgtcgccaacaccctggccgggtggtcgcgagaaatcttattaaccatggcagaacgcgcccgcgctgcatccattccggatgccaccgagcgagtggcaaatgaagtgagccgggctgcccgggcgtaattgtagcgatgccttttgcatcgtatgaatttaagaagttaatggcgtaaagaatgaatacacaacaattggcaaaactgcgttccatcgtgcccgaaatgcgtcgcgttcggcacatacattttgtcggcatcggtggtgccggtatgggcggtattgccgaagttctggccaatgaaggttatcagatcagtggttccgatttagcgccaaatccggtcacgcagcagttaatgaatctgggagcgacgatttatttcaaccatcgcccggaaaacgtacgtgatgccagcgtggtcgttgtttccagcgcgatttctgccgataacccggaaattgttgcagctcatgaagcgcgtattccggtgatccgtcgtgctgaaatgctggctgagttaatgcgttttcgtcatggcatcgccattgccggaacacacggcaaaacgacaaccaccgcgatggtttctagcatctacgcagaagcgggactcgacccaaccttcgttaacggtgggctggtaaaagcggcgggggttcatgcgcgtttggggcatggtcggtacctgattgccgaagcagatgagagtgatgcatcgttcctgcatctgcaaccgatggtggcgattgtcaccaatatcgaagccgaccacatggatacctaccagggcgactttgagaatttaaaacagacttttattaattttctgcacaacctgccgttttacggtcgtgcggtgatgtgtgttgatgatccggtgatccgcgaattgttaccgcgtgtgggacgtcagaccacgacttacggcttcagcgaagatgccgacgtgcgtgtagaagattatcagcagattggcccgcaggggcactttacgctgctgcgccaggacaaagagccgatgcgcgtcaccctgaatgcgccaggtcgtcataacgcgctgaacgccgcagctgcggttgcggttgctacggaagagggaattgacgacgaggctattttgcgtgcgctggaaagcttccaggggacggggcgccgtttcgatttcctcggtgaattcccgctagagccagtgaatggaaaaagcggtacggcaatgctggtcgatgactacggccaccacccgacggaagtggacgccactattaaagcggcgcgcgcaggctggccggataaaaacctggtaatgctgtttcagccgcaccgttttacccgtacgcgcgacctgtatgatgatttcgccaatgtgctgacgcaggttgataccctgttgatgctggaagtgtatccggctggtgaagcgccaattccgggagcggacagccgttcgctgtgtcgcacaattcgtggacgtgggaaaattgatcccattctggtgccggacccggcgcaggtagccgagatgctggcaccggtattaaccggtaacgacctgattctcgttcagggggctggtaatatcggaaaaattgctcgttctttagctgaaatcaaactgaagccgcaaactccggaggaagaacaacatgactgataaaatcgcggtcctgttgggcgggacctccgctgagcgggaagtttctctgaattctggcgcagcggtgttagccgggctgcgtgaaggcggtattgacgcgtatcctgtcgacccgaaagaagtcgacgtgacgcaactgaagtcgatgggttttcagaaagtgtttatcgcgctacacggtcgcggcggtgaagatggtacgctgcagggcatgctcgagctgatgggcttgccttataccggcagcggagtgatggcatctgcgctttcaatggataaactacgcagcaaacttctgtggcagggtgccggtttaccggtcgcgccgtgggtagcgttaacccgcgcagagtttgaaaaaggccttaacgataagcagttagcagaaatttcttctctgggtttgccggttatcnnnnncattccattcattaattaattaatgaatgaatgnnnnntaatcgcctggtgtttgttgatgttaccgtcgatggcagtgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtgcttgagcaaatcgaaaagcaattacacaagctggtcgatgtcttgcgcgtgagcgagttggggcagggcgcgcacgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcgataagcttgatgcatttttagcatcgattcgcgatgtggcgaaaattgtggaagttgctcgctctggtgtggtcggactttcgcgcggcgataaaataatgcgttgagaatgatctcaatgcgcaatttgcagcccaacatgtcacgttgggctttttttgcgaaatcagtgggaacctggaataaaagcagttgccgcagttaattttctgcgcttagatgttaatgaatttaatccataccagtacaatggctatggtttttacattttacgcaaggggcaattgtgaaactggatgaaatcgctcggctgggcgggagtgtcgcggaccactgcaagctatgttattaacggcaaagcgaagcaataccgtgtgagcgacaaaaccgttgaaaaagtcatggctggtggtgcgtgagcacaattaccacccgaacgccgtggcagctgggcttcgtgctggacgcacacgttctattggtcttgtgatccccgatctggagaacaccagctatacccgcatcgctactatctgacgnnnnncattccattcattaattaattaatgaatgaatgnnnnntaatcgcctggtgtttgttgatgttaccgtcgatggcagtgagcacgtctacccgatgcagattcgcgggggcggaatggatgaaatgtggttaagcaaaacggagagaacctgattatgcgccggatattatcagtcttactcgaaaatgaatcaggcgcgttatcccgcgtgattggccttttttcccagcgtggctacaacattgaaagcctgaccgttgcgccaaccgacgatccgacattatcgcgtatgaccatccagaccgtgggcgatgaaaaagtgcttgagcaaatcgaaaagcaattacacaagctggtcgatgtcttgcgcgtgagcgagttggggcagggcgcgcacgttgagcgggaaatcatgctggtgaaaattcaggccagcggttacgggcgtgacgaagtgaaacgtaatacggaaatattccgtgggcaaattatcgatgtcacaccctcgctttataccgttcaattagcaggcaccagcgataagcttgatgcatttttagcatcgattcgcgatgtggcgaaaattgtggaagttgctcgctctggtgtggtcggactttcgcgcggcgataaaataatgcgttgagaatgatctcaatgcgcaatttgcagcccaacatgtcacgttgggctttttttgcgaaatcagtgggaacctggaataaaagcagttgccgcagttaattttctgcgcttagatgttaatgaatttaatccataccagtacaatggctatggtttttacattttacgcaaggggcaattgtgaaactggatgaaatcgctcggctggcgggagtgtcgcggaccactgcaagctatgttattaacggcaaagcgaagcaataccgtgtgagcgacaaaaccgttgaaaaagtcatggctgtggtgcgtgagcacaattaccacccgaacgccgtggcagctgggcttcgtgctggacgcacacgttctattggtcttgtgatccccgatctggagaacaccagctatacccgcatcgctactatctgacgnnnnncattccattcattaattaattaatgaatgaatgnnnnntcaaagtagtagcagaaatgctctacaagatgcattaagattggcatttcagcacgatgaagaagtattgattgaaaaatggctaagtgggccggagttcacgattgcgatactcggtgaagaaattttaccgtcaatacgtattcaaccggccggaaccttctatgattatgaggcgaagtatctctctgatgagacacagtatttctgccccgcaggtctggaagcgtcacaagaggccaatttgcaggcattagtgctaaaagcatggacgacgttaggttgcaaaggatggggacgtattgacgttatgctggacagtgatggacagttttatctgctggaagccaatacctcaccgggtatgaccagccacagtctggtgccgatggcggcacgtcaggcaggtatgagcttctcgcagttggtagtacgaattctggaactggcggactaatatgtcgcaggctgctctgaacacgcgaaatagcgaagaagaggtttcttctcgccgcaataatggaacgcgtctggcggggatccttttcctgctgaccgttttaacgacagtgttggtgagcggctgggtcgtgttgggctggatggaagatgcgcaacgcctgccgctctcaaagctggtgttgaccggtgaacgccattacacgcgtaatgacgatatccggcagtcgatcctggcattgggtgagccaggtacctttatgacccaggatgtcaacatcatccagacgcaaatagaacaacgcctgccgtggattaagcaggtgagcgtcagaaagcagtggcctgatgaattgaagattcatctggttgaatatgtgccgattgcgcggtggaatgatcaacatatggtagacgcggaaggaaacaccttcagcgtgccgccagatcgcaccagcaagcaggtgcttccaatgctgtatggcccggaaggcagcgccaatgaagtgttgcagggctatcgcgaaatggggcagatgctggcaaaggacagatttactctgaaggaagcggcgatgaccgcgcgacgttcctggcagttgacgctgaataacgatattaagctcaatcttggtcggggcgatacgatgaaacgtttggctcgctttgtagaactttatccggttttacagcagcaggcgcaaaccgatggcaaacggattagctacgttgatttgcgttatgactctggagcggcagtaggctgggcgcccttgccgccagaggaatctactcagcaacaaaatcaggcacaggcagaacaacaatgatcaaggcgacggacagaaaactggtagtaggactggagattggtaccgcgaaggttgccgctttagtaggggaagttctgcccgacggtatggtcaatatcattggcgtgggtagttgcccgtcgcgtggtatggataaaggtggggtgaacgacctcgaatccgtggtcaagtgcgtacaacgcgccattgaccaggcagaattgatggcagattgtcagatctcttcggtatatctggcgctttctggtaagcacatcagctgccagaatgaaattggtatggtgcctatttctgaagaagaagtgacgcaagaagatgtggaaaacgtcgtccataccgcgaaatcggtgcgtgtgcgcgatgagcatcgtgtgttgcatgtgatcccgcaagagtatgcgattgactatcaggaagggatcaagaatccggtagggctttcgggcgtgcggatgcaggcaaaagtgcacctgatcacatgtcacaatgatatggcgaaaaacatcgtcaaagcggttgaacgttgtgggctgaaagttgaccaactgatatttgccggtctggcatcaagttattcggtattgacggaagatgaacgtgaactgggtgtctgcgtcgttgatatcggtggtggtacaatggatatcgccgtttataccggtggggcattgcgccacacgaaggtaattccttatgctggcaatgtcgtgaccagtgatatcgcttacgcctttggcacaccgccaagtgacgccgaagcgattaaagttcgccacggttgtgcgctgggctccatcgttggaaaagatgagagcgtggaagtgccgagcgtaggcggtcgtccgccgcggagtctacaacgtcagaccctggcagaggtgatcgagccgcgctataccgagctgctcaatctggtcaacgaagagatattgcagttgcaggaaaagcttcgccaacaaggggttaaacatcacctggcggcaggcattgtattaaccggtggcgcagcgcagatcgaaggtcttgcagcctgtgctcagcgcgtgtttcatacgcaagtgcgtatcggcgcgccgctgaacattaccggtttaacggattatgctcaggagccgtattattcgacggcggtgggattgcttcactatgggaaagagtcacatcttaacggtgaagctgaagtagaaaaacgtgttacagcatcagttggctcgtggatcaagcgactcaatagttggctgcgaaaagagttttaatttttatgaggccgacgatgattacggcctcaggcgacaggcacaaatcggagagaaactatnnnnncattccattcattaattaattaatgaatgaatgnnnnnaaactgctgaaagttctgggccgaggtatctcctgctggatgcgtttggcgcagcgaacgatgtactgaaaggcgctgtgcaaggtatcgccgaactgattactcgtccgggtttgatgaacgtggactttgcagacgtacgcaccgtaatgtctgaaatgggctacgcaatgatgggttctggtgtggcgagcggtgaagatcgtgcggaagaagctgctgaaatggctatctcttctccgctgctggaagatatcgacctgtctggcgcacgcggcgtgctggttaacatcacagcgggcttcgacctgcgtctggatgagttcgaaacggtaggtaacaccatccgtgcatttgcttccgacaacgcgaccgtggttatcggtacttctcttgacccggatatgaatgacgagctgcgcgtaactgttgttgcgacaggtatcggcatggacaaacgtcctgaaatcactctggtgaccaataagcaggttcagcagccagtgatggatcgctaccagcagcacggtatggctccgctgacccaggagcagaagccggttgctaaagtcgtgaatgacaatgcgccgcaaactgcgaaagagccggattatctggatatcccagcattcctgcgtaagcaagctgattaagaattgactggaatttgggtttcgaggctctttgtgctaaactggcccgccgaatgtatagtacacttcggttggataggtaatttggcgagataatacgatgatcaaacaaaggacacttaaacgtatcgttcaggcgacgggtgtcggtttacataccggcaagaaagtcaccctgacgttacgccctgcgccggccaacaccggggtcatctatcgtcgcaccgacttgaatccaccggtagatttcccggccgatgccaaatctgtgcgtgataccatgctctgtacgtgtctggtcaacgagcatgatgtgcggatttcaaccgtagagcacctcaatgctgctctcgcgggcctgggcatcgataacattgttatcgaagttaacgcgccggaaatcccgatcatggacggcagcgccgctccgtttgtatacctgctgcttgacgccggtatcgacgagttgaactgcgccaagaaatttgttcgcattaaagagactgttcgtgtcgaagatggcgataagtgggctgaatttaagccgtacaatggtttttctctggatttcaccatcgattttaaccatccggctattgattccagcaaccagcgctatgcgatgaacttctccgctgatgcgtttatgcgccagatcagccgtgcgcgtacgttcggtttcatgcgtgatatcgaatatctgcagtcccgtggtttgtgcctgggcggcagcttcgattgtgccatcgttgttgacgattatcgcgtactgaacgaagacggcctgcgttttgaagacgaatttgtgcgtcacaaaatgctcgatgcgatcggtgacttgttcatgtgtggtcacaatattattggtgcatttaccgcttataaatctggtcatgcactgaataacaaactgctgcaggctgtccttgcaaaacaggaagcctgggaatatgtgaccttccaggacgacgcagaactgccgttggccttcaaagcgccttcagccgtactggcataacgacatttatactgtcgtataaaattcgactggcaaatctggcactctctccggccaggtgaaccagtcgtttttttttgaattttataagagctataaaaaacggtgcgaacgctgttttcttaagcacttttacgcacaacttatcttcattcgtgctgtggacttcaggctttaatgataagatttgtgcgctaaatacgtttgaatacgatcgggatggcaataacgtgagtggaatactgacgcgctggcgacagtttggtaaacgctacttctggccgcatctcttattagggatggtcgcggcgagtttaggtttgcctgcactcagcaatgccgccgaaccaaacgcgcccgcaaaagcgacaacccgcaaccacgagccttcagccaaagttaactttggtcaattggccttgctggaagcgaacacgcgccgcccgaattcgaactattccgttgattactggcatcaacatgccattcgcacggtaatccgccatctttccttcgcgatggcaccgcaaacgctgcccgttgctgaagaatctttgcctcttcaggcgcaacatcttgcattactggatacgcttagcgcgcttctgacccaggaaggcacgccgtctgaaaagggttatcgcattgattatgcgcattttaccccacaagcaaaattcagcacgcccgtctgggataagccaggcgcaaggcatccgtgctggcccctcaacgcctcagctaacaacaataaacctttacttcattttattaactcccgcaacgcgggggcgtttgagattttattatgctaatcaaattattaactaaagttttcggtagtcgtaacgatcgcaccctgcgccggatgcgcaaagtggtcaacatcatcaannnnncattccattcattaattaattaatgaatgaatgnnnnntgtcggtatcaacctgccgggcatgccagcaccggcaaagcgtgaagcctacgctgctgacatcacttacggtacgaacaacgaatacggctttgactacctgcgtgacaacatggcgttcagtcctgaagaacgtgtacagcgtaaactgcactatgcgctggtggacgaagtggactccatcctgatcgatgaagcgcgtacaccgctgatcatttccggcccggcagaagacagctcggaaatgtataaacgcgtgaataaaattattccgcacctgatccgtcaggaaaaagaagactccgaaaccttccagggcgaaggccacttctcggtggatgaaaaatctcgccaggtgaacctgaccgaacgtggtctggtcctgattgaagaactgctggttaaagaaggcatcatggatgaaggagagtctctgtactctccggccaacatcatgctgatgcaccacgtaacggcggcgctgcgcgctcatgcgctgtttacccgtgacgtcgactacatcgttaaagatggtgaagttatcatcgttgacgaacacaccggtcgtaccatgcagggccgtcgctggtccgatggtctgcaccaggctgtggaagcgaaagaaggtgtgcagatccagaacgaaaaccaaacgctggcttcgatcaccttccagaactacttccgtctgtatgaaaaactggcggggatgactggtactgctgataccgaagctttcgaattcagctccatctataagctggatactgtcgttgttccgaccaaccgcccaatgattcgtaaagatctgccggacctggtctacatgactgaagcggaaaaaattcaggcgatcattgaagatatcaaagaacgtactgcgaaaggccagccggtgctggtgggtacaatctccatcgaaaaatcggagctggtgtcaaatgaactgaccaaagccggtattaagcacaacgtcctgaacgccaaattccatgccaacgaagcggcgattgttgctcaggcaggttacccggctgcggtgactatcgcgaccaacatggcgggtcgtggtaccgatattgtgctcggtggtagctggcaggcagaagttgccgcgctggaaaatccgactgcagagcaaattgaaaaaattaaagccgactggcaggtacgtcacgatgcggtactggcagcaggtggcctgcatatcatcggtactgaacgtcacgaatcccgtcgtatcgataaccagctgcgcggtcgttctggtcgtcagggggatgctggttcttcccgtttctacctgtcgatggaagatgcgctgatgcgtatttttgcttccgaccgagtatccggcatgatgcgtaaactgggtatgaagccaggcgaagccattgagcacccgtgggtgaccaaagcgattgccaacgcccagcgtaaagttgaaagccgtaacttcgacattcgtaagcaactgctggaatatgatgacgtggctaacgatcagcgtcgcgccatttactcccagcgtaacgaactgctggatgtcagcgatgtgagcgaaaccatcaacagcattcgtgaagatgtgttcaaagcgaccattgatgcctacattccgccacagtcgctggaagaaatgtgggatattccggggctgcaggaacgtctgaagaacgatttcgacctcgatttaccaattgccgagtggctggataaagaaccagaactgcatgaagagacgctgcgtgagcgcattctggcgcagtccatcgaagtgtatcagcgtaaagaagaagtggttggtgctgagatgatgcgtcacttcgagaaaggcgtcatgctgcaaactctcgactctctgtggaaagagcacctggcagcgatggactatctgcgtcagggtatccacctgcgtggctatgcacagaaagatccgaagcaggaatacaaacgtgaatcgttctccatgtttgcagcgatgctggagtcgttgaaatatgaagttatcagtacgctgagcaaagttcaggtacgtatgcctgaagaggttgaggagctggaacaacagcgtcgtatggaagccgagcgtttagcgcaaatgcagcagcttagctatcaggatgacgactctgcagccgcagctgcactggcggcacaaaccggtgaacgcaaagtaggacgtaacgatccttgcccgtgtggttctggtaaaaaatacaagcagtgccatggccgcctgcaataaaagctaacagttgaagtaaaaggcgcaggattctgcgccttttttataggtttaagacaatgaaaaagctgcaaattgcggtaggtattattcgcaacgagaacaatgaaatctttataacgcgtcgcgcagcagatgcgcacatggcgaataaactggagtttcccggcggtaaagttgaaatgggcgaaacgccggaacaggcggtggtgcgtgaacttcaggaagaagtcgggattaccccacaacatttttcgctatttgaaaaactggaatatgaattcccggacaggcatataactctgtggttctggctggtcgaaagctgggaaggggagccgtggggtaaagaagggcaacccggtgagtggatgtcgctggtcggtcttaatgccgatgattttccgccagccaatgaaccggtaattgcgaaacttaagcgtgtgtatgccggataaggcgtcacgctgcatccgacatttgcatatgatgcctgatgcgacgctggcgcgttttatcaggccagcgtcgcactctcagatagaatgtcactgctttggctcttcgctccagtcatcgctttcggaaagatcgccactgctggggattcgtttttcttcagcagcccattctccgaggtcgatcagctgacaacgtttggagcaaaatggccgaaacgggctgatttcaccccacaccaccgttttcccgcaggttgggcaattcaccgtaatagtttctgacatttttactccttagcaacaggccagttcgaaatccagacgttctggtacctgtccgttttcactgtccagcggcataaaacgaatggcaaaacggctcttatgaccggaaatttgcggataaagctgtgaatcgagcgacagattcaggcgcagcaagtcggcatcgccaccgttatcctgataaaaaccattcaggctggtttgtttacggaagggggccgactggcgaattaaatccagcaccatggtaagtgcctgggtaagcgggttcaggctggcaatccaggtttctacctggctgtcgcgctgcgcctggggtagatgcagccaaatgtgcaatgtaggtaaatcaaagctgcaacagccgcccgggatgctcagtcgctgacgcaccagagcaatcaaacgatcttcacgtagaaattgcccgatacgcggcgcggagattaatacgctccccgccgcttttaactgctgaattaatgcttcaatacggctctggtccacgccgggcacgccaatccaggtctggagtttacgttgctgccggtcaagttctttcaacagctcagtgcggacttcgccgcgctcgaaaacatccagtaattcgctgacattacggaagaaatgcagcgcgccagcgtggtcaacgatgggtaaattaacggtgagttgctgaatcaaaaactcaatgcgcagccatgtacgcattttttcatttagtggatgttcaaaaaggacctgggtctgcattacggtttttcctgtgagacaaactgcgacgcaagctgcaaatagtgtgcgtgcaggcgggcaacatccgatgcgatagcatccggtgcgccgttattatcaatgacgtcatctgccacggcaaggcgagcttcgcgcgttgcctgagcagcaaggatttgttcgacatgctcgcgagttacatcgtcgcgctgcatggtgcgcttaagttgcgtttctgggctgacatccaccaccagcactcgattcgcttttttatacagtgagttttctaccagcaatggcacaacccatagtacatagggggaagtagcttgctggatctggtgttgcgtctcttgctgaatcagcggatgcagcagggcgttaagccagtttttctcttccgggttggcgaagatccgttcgcgcaaggcccggcgctgcaatgttccatcagcagcaatcatgttagcgccaaagtgatcagcaatggcatgtagcgcaggtgcacctggttcaaccacctgacgcgcaataatatcggcatcaatgacgttaattccgagattagcaaacgcattggcaacggtactcttgccactgccaatgcctcccgttaaggcaactatatacctcataatttatattcccgggaattcatcatgattatcaaaacgttaaaaatgagcgcacgaaagcgaaattgatgaaacgttcgctcactatttaccaggtaaatttatgggattgtagcgtaaaaaaagacaatttcgcagtcttgcgccgcattgattagtgcgtatgataacgtcactggagttgcgctcttacccttatagccattaaccccaggaatccgcacatgcgtattgaagaagatctgaagttaggttttaaagacgttctcatccgccctaaacgctccactcttaaaagccgttccgatgttgaactggaacgtcaattcaccttcaaacattcaggtcagagttggtccggcgtgccgattattgccgcaaatatggacaccgtaggcacattttctatggcctctgcgctggcttcttttgatattctgactgctgtgcataaacactattctgtcgaagagtggcaagcgtttatcaacaattcttccgctgatgtgctgaaacatgtgatggtttctaccggcacgtctgatgcggatttcgaaaaaactaaacagattctcgacctgaacccggcattaaatttcgtttgtattgacgtggcgaatggttattccgaacacttcgtgcagttcgttgcgaaagcgcgtgaagcgtggccgaccaaaaccatttgtgcaggcaacgtagtgactggtgaaatgtgtgaggagcttatcctctccggtgccgatatcgttaaagttggcattggcccaggttctgtttgtacaactcgcgtcaaaacaggcgtcggttatccgcaactttctgcggtgatcgaatgcgccgatgctgcgcacggtctgggcggaatgatcgtcagcgatggcggctgcaccacgccgggcgatgtcgcgaaagcctttggcggcggtgccgatttcgtaatgcttggcggcatgctggcgggccacgaagagagcggcggtcgcatcgttgaggagaacggcgagaaatttatgttgttctacggcatgagctcagagtctgcgatgaaacgtcacgttggcggcgttgcggaatatcgcgcagcagaaggtaaaaccgttaagctgccgctgcgaggcccggttgaaaataccgcgcgtgatattttgggcggcctgcgttcagcttgtacatacgttggggcttcacgcctgaaagaactgaccaagcgcaccacgtttatccgtgtgcaggaacaagaaaaccgcatcttcaacaacctgtaatataccaacgctggcgtggagcaacacgccagcgttatcccattccactcatcgcatcgcctaaatggaaaattggcagatacattgccaccaccagcgtaccgataattcctcccgttatgatcagcaacgccggttccagtaaggctgcgaggttatccgccagcgccattgtgttatcccgatgatgatgggcgaggttgtctaacatgagatccagcgagccggatgcctctcctgttctcactaattgcaaacagagcgggctaaactcaccggcattttttagcgccagccagatggggtgaccgttactgatatcgtgctggatttgtgtcagaagttgcacccagtacgggcagcgcattgtttctctgacgctctcaacgccctgtaaaaaagaaatgcctgcactttgtgtcagtgtcagaatcgtaaagatctgcgtgagtttttgtccccgcatcagtgaacccataatcgggatgcgtaacagcaatttctgccgtgcgataagcctggttgggtggcgcatcagcagcttattggctatcgccagcagaaagccgaatagcaccagcaaccaaccccattcgccactaaaacttgccagcgtcatgatcccctgcgttagcgccggtagcggagtgttaaaggtcttatagatagcggcaaactccggcagtacaaaatgcagcattgccacaaccaccatgattgccatcgctaaaatgataatgggataacgtaacgctgatttcactttgtcggtcaactgacgctgggctttttgctgacgcgccagttcaaagcagcattcatccagcttaccggtcagttcacccgtgcggatcatcgcctgatagagcggcggaaatacctctgaccagggtaataaggcattggaaaaggcaacgccctgttcaagatcgtgcgccagtgattgcagcaacgcttgccactgcttactgggatgctgttccgccagcagagccagcccttcagaaagcgttaacccggctttgagtagcgtcgccagttgatgaatgacttccgcgcttatatctcctcgccactgcgtagaattgatggtgattcgcttcaggcttagtggggtaaccatctgttgctgtagtgccatgagcagcaaagcacggctctctgcccatagcatcccatcttgcgcattgccgtcgccggttatgccatgccagcgccagagttgcttactcgccatgcggcatccctaatacgcggattaactcttcaaaggtggttaagccttgctccacggctaggcagccgttttcaaaaagcgttcgcatacccgcctgtcgggcgtgcgtttccagcgattcaacgtcggtattagcggaaataagctgacgtatgaccggtgttatgggcagaacttcaaataaggccgtgcgaccataaaaaccgtggtagcaatgtacacaaccgggtgcctgccagtggggcagcggcgacggccatacattgtctggaatatggatgggctccccttgctgccggcgacaatgcgggcaaagtttgcgtaccagacgctgggctattaccagcgtaagcgccgatgatagcatccagcgggcgactcccatttgctgtaaacgtaccagcgtttcgcaggtggagttagtgtgtagggtagacaacaccaggtgaccggtttgcgcggctttaatggcaatttctgccgtttcgccatcgcggatctctccgatcatgatgacgtcaggatcctggcgcaataacgcacgcaaaacgccctgaaaggtgagtccggcacgcgaatggatttgcgtctggtttagtccggctatggggatctcaaccggatcttcgacgctacaaatattaatgtcagcggtattcagcatttgcagggcactataaagcgtgaccgttttgccgctgcctgtagggccagttaccagcaccagtccctgtggttgttgcaaggcatgagcaaagtccaccagttgtgacggctgcattccaagcgtgttaacatccagtgcctggttcacctgctgtaacaaccttaataccaccttttcaccacctcgacatgctaaggtcgcaatacgaaatgagacggcgtttcctgccagttcgacagtgaattgcccgtcctgcggcaggcgatgttccgcaatatccaggtttcccagcacttttaatctggcggttaatgcgactccggcatccggtgaaacgtccggtaaaggatgcaatacgccgtcgatacgcaagcggatgcggtaggcattgtccgctggttcgatatgaatatcagacgcgcgttgttctagcgcagattgtaacgttcgagtcagcaactctgctttgggctgatgcttctcctgaacagctacgggcaatgtctgttgtgtgcgactggcgtgaccttccatttgttggcgtgtccagcaggtgatctcaatacgtttggtggtagcgaaatgcaatgcgtccagtagctcatgcgaaggtgcatcgactaccgcaacatgaaccacctcttcgctggcatccagcaagactccctgataacgcagacacagggcagtgagctgtggaatattcattgccgctccttagttggcgtcatcaaagcggaagacatcttcgcaggcttgctgcaatgcgctgtcactttgaatattgcagttacgcgtccagccggtgacgccgtttgcgttatcccaacccggcgtcatgacgacgcttagtccattgagactttcttgcccggtcagcgacaccacgccctttgccacactcatggctgaaacatagcgggtggtggtaggcgagggaatgccattgctgccaccgtcgcaggtatttaatccaccatgttccagcgcgcacaactctacggcggtacggtaaggcacaaaggtttgtagcatgtcggtgagtgcggctttgcgcaggtagttttgataagcgggaataccaatggcgcttaaaatggcaatgatgccaataaccaccatcagttcgataagtgtaaaaccgcgttgcttgtccatctgtttcgctccttgatttggttggcgctactttggcaaacgccatcagcacaagcgaggggcaaaaaacgaaacgggaaagcagcttccgaggttttttatttcgttgcagcgaaagacaagaaatttgcgaggcgttacgaagaaagttggggaaggggagatttatccgcccgcgatggagcggataaatctgttagcaattagcgaaaacgcattgaaaggtcgagtgcctgtacgtgtttagtcagcgcaccaacggagataaagtccacgcccgtttcggcaaattcgcgcagtgttttgtcagtgacgttgccagacacttccagtagcgccttgccgttggtgcgtttgacggcttcgcgcatctgttctgtttcgaagttatccagcatgatgatatcggcacctgctttcagggcttcatcaagttcttccagattctctacttcgacttctactggcgcatccgggtgcaaccaggacgctttttcgaccgcctggcgcactgagccggaggcaataatatggttttctttgatcaggaaggcatcagaaagccccagacggtgattcgctccgccgccgcaaagtaccgcgtatttcagagctgaacgcaggccgggtaaggttttgcgcgtatccaacagctgcgtgttggtgccttccagtaattcgacatagtggcgtaccttactggcaactcctgaaagggtttgcacaaaattaagcgcagtgcgttcgcccgttaacagcacgcgagatgggccttcgagttcgaacaagggttgattggcgttgatgacatcgccgtcatccacatgccagattatggtgacatcgtcgcctgccagttgaataaacacctcttcaacccagcgtttgccgcaaaatacgccattctcgcgggtgatcactgtggcatgagagcgagagttttccggtaaaagttttgccgtaatgtcattgttggcatcgactgttccgcctaaatcttcccgtagcgcctgggccaccgcgccggggatatcgagattaatgcgttccagcagctcgtcacgtcgggtgtcagggttatagcggcgaggcggcatgttaaaactccagatagctaacgaatcataaggtagaaacatgctactctgaaccgggtattagcaccacatataaggagatcctgcatgttgttagaacaggggtggctggctggcgcgcgccgcgttccctcaccacattacgattgccgcccggatgacgaaacacccactctgctggtggtgcacaatattagcctgccgccaggcgagtttggcggcccgtggatcgacgcattattcactggaactattgatccgcaggcgcatcctttctttgctgagatcgcccatttgcgcgtctccgctcactgtttgattcgccgtgatggtgaaatagtccagtatgttcctttcgataaacgagcctggcatgcgggagtctctcagtatcaggggcgtgaacgctgcaatgatttttctattgggattgagctggaaggcaccgatacgctggcgtataccgatgcgcagtatcaacagcttgcggcggttacacgggcactgattgatcgctatccggatatcgctaataacatgacgggccattgtgatattgcgccggatcggaaaaccgatcccggtcctgcatttgattgggcacggtttcgtgcgctggtcagcaaggagacaacatgacgctatttacaaccttactggtgttaattttcgagcgcctgtttaagttgggcgagcactggcagcttgatcatcgtcttgaagcgttctttcggcgggtgaaacatttttctctcgggcgcacgttatgcatgaccattattgcgatgggcgtgacttttttactgttacgcgcattgcagggagtattgttcaacgttcccacgctgctggtgtggctgctgattggtttgctgtgtattggcgcaggtaaagttcgtcttcattatcatgcttatctgacagctgcttcacgtaatgatagccatgcccgtgccacgatggctggcgaactcaccatgattcacggcgtcccggcaggctgcgatgaacgtgagtatttgcgtgagctgcaaaatgcattgctgtggattaactttcgtttttatcttgcaccgctgttctggctgattgtggggggaacctggggacccgttacgctgatggggtatgcgtttttgcgtgcatggcaatactggctggcgcgataccagacgccgcatcatcgtttacagtccggcattgatgccgtgcttcatgtacttgattgggtgccggttcgtcttgcgggtgtggtatatgccttgatcggtcatggtgagaaagcgttaccggcctggtttgcttcgctgggtgatttccatacttcgcaatatcaggtattaacgcgtctggcacagttctctctggcgcgtgaaccgcatgtcgataaggtggagacgccaaaggcagcggtttcaatggcgaagaaaacctcgttcgtggtcgtggtggttattgcgctactgacgatttacggggcgttggtgtaaagattattgccctcaccctgcacgggtgagggcgtagagagattaatgcgcttttacggctttggcggttttctctttaaacagatagcctatacctaacacgatcagccataccgggatcaggtataccgaaatcgccattcctggggtcatcagcataatcaccagtaccgccgccataaacagcaggcagatccagttacccagcggataaagcagggcagggaagcgagttaccacgccttgttcttgtttggcacgacggaatttcatatgcgccagactgatcatcgcccagttgatgaccagtgcagataccaccagcgccattaacagtccgaaagcggactctggggcaaggtagttaatcagtacgcacaatgccgtaaccagcgcagacaccagaatagtgttaaccggtacgccgcgtttatcgacagacgccagcgcttttggcgcgttcccttgttgtgccagaccgaacagcatacggctgttgcaatatacgcagctgttgtacacggagagcgcagcggtcagtaccacgatattcagcgcattcgctacaaaggtatcgcctaactcgtggaagatcagcacaaacggactggtatcagcggtaacgcgggtccacggcattagtgagagcagaacggctaacgagccaatatagaaaatcaggatgcggtagataacctggttagttgctttcgggatactttgctccgggttatcagcttctgctgcggtgatccccaccagttccagaccaccgaaagagaacatgataatcgccatcatcatcaccagaccggtgaagccgtgtggcaggaaaccaccctgatcccacaggttgctaacgctcgcctgcgggccgccgttgccgctgaatagcagccaggcgccgaagatgatcatcgctaccaccgcgataactttgataatggcaaaccagaactccatctcgccaaacacttttacgtttgtcaggttgatggcgttgatcaccacaaagaacacggcggcagaaacccaggttgggatttccggataccagaactgaatgtatttacccacggcagtcagctctgccatggcaactaaaacgtacagtacccagtagttccagccagaggcgaaaccggcaaaactgccccagtatttataagcaaagtggctaaaggagcctgcgacaggttcttcgaccaccatttcacctagctgacgcatgatcagaaaggcgataaaaccagcaatggcgtaacccaggataatccctggccctgcggattgtattacggaggcgctacccaggaatagccctgtccctatcgcgccacccagcgcgataagctgaatatggcggtttttaaggccgcgctttagctgctcgccgtgctgttgaccttccattatgaaacctcgtgttgtgttgtttttttgaactacgcagcaatgcgtgtgtaattttgtaattccgtttgttgtattggtttctttacattttatgtaactgaattatgatgatagtactttcaactatcacaagataatggtatatgcgcgagaatgcacctgctttatgtagatgtgttgattttctggataaaaaaaaagcaattgtaagtttttcatcacatttaatagatactttaagtctgataacatactgttttaactagctatatgtcggatttgtctgcctgctgaacaccatgccttagccaccagcacaataatcttacaaaaggtcatataagaataaatagatgttaataatacaatggggttgtaacgcgagtatttaaatataatattgcgagctaagtgaaaacgttaagtaattgaaataatttttcattaaaagcgtttcttattgatcgagaaataagttttctatttaatgcaaaaaagttaaggataaacgggaatgaaataaagtgggcgatattgtttacctgagaataatcggtgagaagcagggcgatatttcttcaggctgtgggacgtatgcgtcggttggtaatcgctggcaggttggccatgaagatgaaatttttgcctttgcactcaccaacgccattaccagtactggtaaaggcgttaatctacaggggctacaattttgcaaactcattgataaaagctcaccgctactgtctaatgccatcaatcagaatgagcggttatttattgaaatcgatttgtatcgtataaataaaagcgggcgctgggaacggtattattatattcagctaagaaatgcttcattaactgctattcatgtaaacatttctgacaataatcttcctaccgaatgtgtaaatgttaattatgactacatattatgcaaacatctaatagccaatacggaatttgactggttggcctttcctgctggctataatagcttatttattccacctaaaaacccacctgccagtaatcttaaccctgagccactaccagttgttaaccttccactctctccaccagcggttaaaccggtctatgccaaatcctgtctgaaggagaagggatgtacagatgccggaacggcagaagaacccgctgaaaacttcgggcaagtagcgatttttgctctgccagtggttgatgactgctgtggataccaccatccggaggctaacgatgttgggcaacccgcagaagctcaaaccatgctactgtttccgggtagtgtgttggcggctcaaatatggggaaaatggtcgctcagtggcatactcagtgcaacctgcggctcttacatcggtgcgttggcatctgctttgtatattccctctgcgggcgagggcagtgctcgcgtgcccggacgtgatgagttctggtatgaggaagaactgcggcagaaagcactagcaggcagtaccgccaccacccgggtacgttttttctggggaactgacattcacggcaagcctcaggtgtatggtgttcatacgggtgaaggtacgccgtatgaaaacgtccgcgtggcgaacatgcagtggaacgagcagacgcagcgttatgaatttacccccgctcacgatgtcgatggccccctgattacctggacgccggaaaatccggaacatgggtatgttccgggccataccggtaacgacaggccgccgctggagcagcccaccattctggtgacgccgattccggacggcaccgatacctataccacgccgccattcccggttcctgatccgaaagaattcaacgattatattctggtttttccggcgggatccggtattaagcccatctatgtttacctgaaggaggatccgcgaaagctgcctggtgttgtaacagggcgcggcgtcccgctttcaccaggaactcgctggctggatatgtcggtatccaataacggcaacggcgcaccaatcccggcgcatattgctgataaattgcgcggacgggagtttaaaacctttgatgagtttcgcgaggcgctgtggctggaggtgagtcaggatccggagttgatagcgcagttttcaagtggtaaccaaacacgtataaaacaaggattaaccgcaaaagcacctattgacggttggtattatggccctaaagaaatagttaaaaaattccagatacatcatcgtgttgcagttgaatatggcggcagcgtatacgatattgataatttacgaattgttacccccagactacacgatgagattcactacaggagataaatatgtttaaagaaaagctccaggattataccgaggatgaatttcttaattttttaggcggattgagatcatctatgaaagatggaaaatccttaaaaggtaaggagctagaaatgtactgggattcattagtagatcattttattgaaattacacagcatccgtcagggagcgatctaattttctaccctaaaagtcaaggagatgataagcctgaaaacatcctgaaaattgtcaaagaatggcggcgttcacaggggttacccttgtttaaagactctaaataaagtagataataaaactatatatggaacatcatcgcatctggctaatgcgatgatattaatgacataaaataataatgtgattgctcttaaaaaacaggtaaaaatactgaagcctcattaggttattttatcattttcccgcttttaccgataccctttggctggaggtgagtcagtatccggagttgatagcgcagttttcaagcggtaatcaaacacgtataaaacaaggattaatcgcaaaagcaccacttgaaggttggcattatggcactaaagaaatcgttaaaaaattccacatgtatcatcgtgttgcgattgaatatagtggcggaatttacgatattgataatttaaggagggcacacctcatttgcatgatgaaatttattacaggagatagttaaatgtataattttaaagatgaaatagaagattacacagagcgggaattcattgagttgcttggcgagtttacaaatccaaccggggataacgctcaattaaaaggggaagagcttgacaaatattgggatgatctagaagaacatcttaccagaattacacaacatccgttgatgagcgatcttatctactatcctgcaaagaagggagatgatgaacctgaaaacatcctgaaaattgtcaaagaatggcggcgttcacaggggctacccttgtttaaagactctaaataaagtagataataaaactatatatggaacatcatcgcgtctggctaatgcgatgatgttaataacataaaataataatgtgggtgctcttaaaaaacaggtaaaatactgaaatttcattaggttattttatcaatttcccgctttcaccgataccctttggctggaggtgagtcagtatccggagttgatagcgcagttttcaactggtaaccaaacacgtataaaacaaggattaatcgcaaaagcgcctcttgaaggttggcattatggctctaaggaaattgttaaagaattccatatatatcatagtgttgcgattgaatgtggtggcgaaatttatgatattgataattaaaggattgttacgcctcgactacatgatgaaattcactacaggagataatgtatatgcatgatttaaaatataaaatatatttttacacagaaggtgaatttcttgaaatgcttgaggagatagtaaatgcaactagcaaagataaatccctaaaagggaaaaaattagaaaaatatctcgataccttagtggatcatttcattaaaattactgaacatcctaaaaagggagatctcattttctatcctaattccccagaagatggtaaacctgaaaacatcctgaaaatcgtcaaagaatggcggcgttcgcaaggattgcctttgttcaaagattcagaatgaactctaaacagaatctgtcacctgaaaatcatcacgttctggttaagtgatgattttcgctacgagaaggttacggtggcgattgcagtgataataagcaatgtaaaaagaaaacataggtaaatactacctttctctccttccctgaacattcattttacatattaattcacataattgaattgttatgcgttttgttgcttggtgaatcggttcagaggaaatattttttcgtttcaattctgttaaggtcaccccttgatgggtaaatttaacatttgtgcatagttacaactttgaaacgttatatatgtcaagttgttaaaatgtgcacagtttcatgatttcaatcaaaacctgtatggacataaggtgaatactttgttactttagcgtcacagacatgaaattggtaagaccaattgacttcggcaagtggcttaagacaggaactcatggcctacagcaaaatccgccaaccaaaactctccgatgtgattgagcagcaactggagtttttgatcctcgaaggcactctccgcccgggcgaaaaactcccaccggaacgcgaactggcaaaacagtttgacgtctcccgtccctcattgcgtgaggcgattcaacgtctcgaagcgaagggcttgttgcttcgtcgccagggtggcggcacttttgtccagagcagcctatggcaaagcttcagcgatccgctggtggagctgctctccgaccatcctgaatcacagtatgacttgctcgaaacacgacacgccctggaaggtatcgccgcttattacgccgcgctgcgtagtaccgatgaagacaaggaacgcatccgtgaactccaccacgctatagagctggcgcagcagtctggcgatctggacgcggaatcaaacgccgtactccagtatcagattgccgtcaccgaagcggcccacaatgtggttctgcttcatctgctaaggtgtatggagccgatgttggcccagaatgtccgccagaacttcgaattgctctattcgcgtcgcgagatgctgccgctggtgagtagtcaccgcacccgcatatttgaagcgattatggccggtaagccggaagaagcgcgcgaagcatcgcatcgccatctggcctttatcgaagaaattttgctcgacagaagccgtgaagagagccgccgtgagcgttctctgcgtcgtctggagcaacgaaagaattagtgatttttctggtaaaaattatccagaagatgttgtaaatcaagcgcatataaaagcgcggcaactaaacgtagaacctgtcttattgagctttccggcgagagttcaatgggacaggttccagaaaactcaacgttattagatagataaggaataacccatgtcagaacgtttcccaaatgacgtggatccgatcgaaactcgcgactggctccaggcgatcgaatcggtcatccgtgaagaaggtgttgagcgtgctcagtatctgatcgaccaactgcttgctgaagcccgcaaaggcggtgtcaacgtagccgcaggcaccggtatcagcaactacatcaacaccatccccgttgaagaacaaccggagtatccgggtaatctggaactggaacgccgtattcgttcagctatccgctggaacgccatcatgacggtgctgcgtgcgtcgaaaaaagacctcgaactgggcggccacatggcgtccttccagtcttccgcaaccatttatgatgtgtgctttaaccacttcttccgtgcacgcaacgagcaggatggcggcgacctggtttacttccagggccacatctccccaggcgtttacgctcgtgctttcctggaaggtcgtctgactcaggagcagctggataacttccgtcaggaagttcacggcaatggcctctcttcctatccgcacccgaaactgatgccggaattctggcagttcccgaccgtatctatggggctgggtccgattggtgctatttaccaggctaagttcctgaaatatctggaacaccgtggcctgaaagatacctctaaacaaaccgtttacgcgttcctcggcgacggtgaaatggacgaaccggaatccaaaggtgcgatcaccatcgctacccgtgaaaaactggataatctggtcttcgttatcaactgtaacctgcagcgtcttgacggcccggtcaccggtaacggcaagatcatcaacgaactggaaggcatcttcgaaggtgctggctggaacgtgatcaaagtgatgtggggtagccgttgggacgaactgctgcgtaaagataccagcggtaaactgatccagctgatgaacgaaaccgttgacggcgattaccagaccttcaaatcgaaagatggtgcgtatgttcgcgaacactttttcggtaaatatcctgaaaccgcagcactggttgcagactggactgacgagcagatctgggcactgaaccgtggtggtcacgatccgaagaaaatctacgctgcattcaagaaagcgcaggaaaccaaaggcaaagcgacggtaatccttgctcataccattaaaggttacggcatgggcgacgcggctgaaggtaaaaacatcgcgcaccaggttaagaaaatgaacatggacggtgtgcgtcacatccgcgaccgtttcaatgtgccggtgtctgatgcagatatcgaaaaactgccgtacatcaccttcccggaaggttctgaagagcatacctatctgcacgctcaacgtcagaaactgcacggttatctgccaagccgccagccgaacttcaccgagaagctggagctgccgagcctgcaagatttcggcgcgctgctggaagagcagagcaaagagatctctaccactatcgctttcgttcgtgctctgaacgtgatgctgaagaacaagtcgatcaaagatcgtctggtaccgatcatcgccgacgaagcgcgtactttcggtatggaaggtctgttccgtcagattggtatttacagcccgaacggtcagcagtacaccccgcaggaccgcgagcaggttgcttactataaagaagacgagaaaggtcagattctgcaggaagggatcaacgagctgggcgcaggttgttcctggctggcagcggcgacctcttacagcaccaacaatctgccgatgatcccgttctacatctattactcgatgttcggtttccagcgtatcggcgatctgtgctgggcggctggcgaccagcaagcgcgtggcttcctgatcggcggtacttccggtcgtaccaccctgaacggcgaaggtctgcagcacgaagatggtcacagccacattcagtcgctgactatcccgaactgtatctcttacgatccggcttacgcttacgaagttgctgtcatcatgcatgacggtctggagcgtatgtacggtgaaaaacaagagaacgtttactactacatcactacgctgaacgaaaactaccatatgccggcaatgccggaaggtgctgaggaaggtatccgtaaaggtatctacaaactcgaaacccttgaaggtagcaaaggtaaagttcagctgctgggctccggttctatcctgcgtcacgtccgtgaagcggcagagatcctggcgaaagattacggcgtaggttctgacgtttatagcgtgacttccttcaccgaattggcgcgtgatggtcaggattgtgaacgctggaacatgctgcacccgctggaaactccgcgcgttccgtatatcgctcaggtgatgaacgacgctccggcagtggcatctaccgactatatgaaactgttcgctgagcaggtccgtacttacgtaccggctgacgactaccgcgtactgggtactgatggcttcggtcgttccgacagccgtgagaacctgcgtcaccactttgaagttgatgcttcttatgtcgtggttgcggcgctgggcgaactggctaaacgtggcgaaatcgataagaaagtggttgctgacgcaatcgccaaattcaacatcgatgcagataaagttaacccgcgtctggcgtaagaggtaaaagaataatggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagtaccatctccgcaggcgggtatcgttaaagagatcaaagtctctgttggcgataaaacccagaccggcgcactgattatgattttcgattccgccgacggtgcagctgacgctgcacctgctcaggcagaagagaagaaagaagcagctccggcagcagcaccagcggctgccgcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggtagctccggcagctaaacaggaagcagctccggcagcggcccctgcatcagcagctggcgtgaaagaagttaacgttccggatatcggcggtgacgaagttgaagtgaccgaagtgatggtgaaagtgggcgacaaagttgccgctgaacagtcactgatcaccgtagaaggcgataaagcttctatggaagttccggctccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggctccggcagcaaaagctgaagctccagcagcagctccggctgcgaaagccgaaggcaaatctgaatttgctgaaaacgacgcttacgttcacgcgactccgctgatccgccgtctggcacgcgaatttggcgttaacctggcgaaagtgaagggcactggccgtaaaggtcgtatcctgcgcgaagacgttcaggcttacgtgaaagaagctatcaaacgtgcagaagcggctccggcggcgactggcggcggtatcccaggcatgctgccgtggccgaaggtggacttcagcaagtttggtgaaatcgaagaagtggaactgggccgtatccagaaaatctctggtgcgaacctgagccgtaactgggtgatgatcccgcatgttacccacttcgacaaaaccgatatcaccgagctggaagcgttccgtaaacagcagaacgaagaagcggcgaaacgtaagctggatgtgaagataaccccagttgtcttcatcatgaaagccgttgctgcagctcttgagcagatgcctcgcttcaacagttcgttgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctggggactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaagtaaaagagccggcccaacggccggcttttttctggtaatctcatgaatgtattgaggttattagcgaatagacaaatcggttgccgtttgttgtttaaaaattgttaacaattttgtaagataccgacggatagaacgacccggtggataatgggcgtcataaaaaaaacgtcagacccgccggagataaatatatagaggtcatgatgagtactgaaatcaaaactcaggtcgtggtacttggggcaggccccgcaggttactccgctgccttccgttgcgctgatttaggtctggaaaccgtaatcgtagaacgctacaacacccttggcggtgtttgcctgaacgtcggctgtatcccttctaaagcactgctgcacgtagcaaaagttatcgaagaagccaaagcgctggctgaacacggtatcgtctttggcgaaccgaaaaccgatatcgacaagattcgtacctggaaagagaaagtgatcaatcagctgaccggtggtctggctggtatggcgaaaggccgcaaagtcaaagtggtcaacggtctgggtaaatttaccggggctaacaccctggaagttgaaggtgagaacggtaaaaccgtgatcaacttcgacaacgcgatcattgcagcgggttctcgcccgattcaactgccgtttattccgcatgaagatccgcgtatctgggactccactgacgcgctggaactgaaagaagtaccagaacgcctgctggtaatgggtggcggtatcatcggtctggaaatgggcaccgtataccacgcgctgggttcacagattgacgtggttgaaatgttcgaccaggtcatcccggcagctgataaagacatcgttaaagtctttaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagctggcgtggaagttgacgaccgtggtttcatccgcgttgacaaacagctgcgtaccaacgtaccgcacatctttgctatcggtgatatcgtcggtcagccaatgctggcacacaaaggtgttcacgaaggtcacgttgccgctgaagttatcgccggtaaaaaacattacttcgatccgaaagttatcccgtccatcgcctataccgaaccagaagttgcatgggtaggtctgactgagaaagaagcgaaagagaaaggcatcagctacgaaaccgccaccttcccgtgggctgcttctggtcgtgctatcgcttccgactgcgcagacggtatgaccaagctgattttcgacaaagaatctcaccgtgtgatcggtggtgcaattgtcggtactaacggcggtgagctgctgggtgaaatcggcctggcaatcgaaatgggttgtgacgctgaagacatcgcactgaccatccatgcgcacccgactctgcacgagtctgtgggcctggcggcagaagtgttcgaaggtagcattaccgacctgccgaacccgaaagcgaagaagaagtaatttttcgtttgccggaacatcctgcaaattaagaagcggctattctggccgcttcagattgttgataaagtgctcgtggttgatgccggatgcggcgtaaacgccttatccgacctacaaaatcatgcaaattcaatatattgcatggcttgtgtaggcccgataagcttgcgcatcgggcgattcgatgtttgtcatcagtcttaagcggctaacaacgccgcttttttacgcctgcaatttacctttccagtctccttgctccacgctcagacaaccgttcgcgtaccgctgaccgttgctcattattcaatcgggcagtatggttactgtcgtttagacgctgcgggcggctctcctgaactttctctcgaaaaacctgacgctgctcaggcgaggcagactggatacgctgacgtgctgcatctctttgctgttgattctgcgggttagtctgcattttctcgcgaaccgcctggcgctgctcaggcgacgcggactgaatacgctgacgtgccgcttctcttctctgctgattctgcgggttagcctgaattttctcgcggactgcctggcgctgctcaggagaagccgactgataacgctgacgagcggcgtccttttgttgctgggtcagtggctggcgacggctgaagtcgcggaagtcgtcatagctcccatagtgttcagcttcattaaaccgctgtgccgctgcctgacgttgggtatctcgcgtaatgacgggggcggcgtgtgttcgttgctgaaactgacttgctgccgcatgacgctggctgtcgcgtgttggagcaggtaactgcgtggcgctcattccgccgttgacatcggtttgatgaaaccgctttgccatatcctgatcatgataggtcacaccattacggtagtttggattgtgccgccatgccatattcttatcagtaagatgctcaccggtgatacggttgaaattgttgacgtcgatattgatgttgtcgccgttgtgttgccagtcattaccgtcacgatgaccgccatcgtggtgatgataatcatcatcgtcatgatgatgatggtcatgatcgtcgtcgtcccagtcgatgctgctgaatagtgcgtatgtggtagcaacgcccatgctatagccgaatccgcgcacaaagctgtcaacaaacggttctccggctggcggcggcagataaactggcggataagcggtattggcccaactgccgtaaaccacgtttgggttgtagttcggaatataaaccacatccggattggctggctcaatggttattacggtcggtgcaggttctgcgacgacggggctggacgtagaaacggtatttgattgtgtggcaggggcgttggcgggctgatttaccggtacgacttttttcgttgtcgcgatgatcttttgttcagttgatgacttcagcgagccggtttgttgcgccagttgccgcaatcgctgtaccgagtccatcacgtcctgcggctgcgccagaaaagcatcgcccaggttttgcacccattgcgggttttcgcccatcaatgccatcaactgtggaaaggccaccagtgatttgacgctggcgtcccagggctggtcagatacagcctgaatagcagcatcgccttgtttaagtggattatcgtgcgaccattgcactgcttgagcaacgtttgccggataggttgatgccattaacacttgtgaaagcagagagtcggggtatagcgcgacaggtgcaacccattgatctatttgagcagtgctgaatgcggatttgacgacggcaggcgttacgggaggcgcggaaaccgttgcaggaagcgtaactgcggagatgtcaggcgcagtctgttgtgtcgattgcgcttccacaggcgcttccactgtgcggctttttatatatagcccggcagaggcggcacaaagcccggcactgcaaattagcgccagcacatggggtttaaacggcaaagtcattttcataattcggatctcaaggaaatcgcaatggtcggcgaactgccacccgcaggtgctgtgaatccgagtataaagaggccgtagtttaaattttgactaatcttgggattcgttgagaaaggtgattatcaccatgcgaattaacgaagtttttacggagggaaacattctctagactatccttaacgattcagccacttttttatgttgcttttttgtaaacagattaacacatcgtcaaaatcctgctattctgcccgttgcggtactgggcatttaccctacaaactgctgtctcacaggagcgtgaagagaatcgcctgccgcactatgacaatgagagcgaggagaaccgtcgtgctagaagaataccgtaagcacgtagctgagcgtgccgctgaggggattgcgcccaaacccctggatgcaaaccaaatggccgcacttgtagagctgctgaaaaacccgcccgcgggcgaagaagaattcctgttagatctgttaaccaaccgtgttccccctggcgtcgatgaagccgcctatgtcaaagcaggcttcctggctgctgtcgccaaaggcgaagctaaatccccgctgctgactccggaaaaagccattgaactgctgggcactatgcagggtggttacaacattcatccgctgatcgacgcgctggatgatgccaaactggcaccgatcgctgccaaagcactttctcacacgctgctgatgttcgataacttctatgacgtagaagagaaagccaaagcaggcaacgaatatgcgaagcaggtaatgcagtcctgggcggatgccgaatggttcctgaatcgcccggcgctggctgaaaaactgaccgttaccgtcttcaaagtcactggcgaaaccaacaccgatgacctctctccggcaccagatgcgtggtcacgcccggatatcccactgcacgcgctggcgatgctgaaaaacgcccgtgaaggtattgagccagatcagcctggtgttgttggcccgatcaaacagattgaagctctgcaacagaaaggtttcccgctggcgtacgtcggtgacgttgtgggtacgggttcatcgcgtaaatccgccacgaactccgttctgtggtttatgggcgatgatattccacatgtgccgaacaaacgcggcggtggtttgtgcctcggcggtaaaattgcaccaatcttttttaacacgatggaagacgcgggtgcactgccaatcgaagtcgacgtctctaacctgaacatgggcgacgtaattgacgtttacccgtacaaaggtgaagtgcgtaaccacgaaaccggcgaactgctggcaaccttcgaactgaaaaccgacgtgctgattgatgaagtgcgtgctggcggccgtattccgctgattatcgggcgtggcctgaccaccaaagcgcgtgaagcacttggcctgccgcacagcgatgtgttccgtcaggcgaaagatgtcgctgagagcgaccgtggcttctcgctggcgcagaaaatggtgggccgagcctgtggcgtgaaaggcattcgtccgggcgcgtactgtgaaccgaaaatgacttctgtaggttcccaggacaccaccggcccgatgacccgtgatgaactgaaagacctggcgtgcctgggcttctcggctgacctggtgatgcagtctttctgccacaccgcggcgtatccgaagccagttgacgtgaacacgcaccacacgctgccggacttcattatgaaccgtggcggtgtgtcgctgcgtccgggtgacggcgtaatccactcctggctgaaccgtatgctgctgccggataccgtcggtaccggtggtgactcccatacccgtttcccgatcggtatctctttcccggcgggttctggtctggtggcatttgcagccgcaacaggcgtaatgccgctggatatgccagaatccgttctggtgcgcttcaaaggcaaaatgcagccgggtatcaccctgcgcgatctggtacacgcgatcccgctgtatgcaatcaaacaaggtctgctgaccgttgagaagaaaggtaagaaaaacatcttctctggccgcattctggaaattgaaggtctgccggatctgaaagttgagcaggcatttgagctgaccgatgcgtctgccgagcgttctgctgccggttgtaccatcaagctgaacaaagaaccgatcattgaatacctgaactctaacatcgtcctgctgaagtggatgatcgcggaaggttacggcgatcgtcgtaccctggagcgtcgtattcagggcatggaaaaatggctggcgaatcctgagctgctggaagccgatgcagatgcggaatacgcggcagtgatcgacatcgatctggcggatatcaaagagccaatcctctgtgcaccgaatgacccggacgacgcacgtccgctgtctgcggtacagggcgagaagatcgacgaagtatttatcggttcttgcatgactaacatcggtcacttccgtgctgctggtaaactgctggatgcgcacaaaggtcagttgccgacccgcctgtgggtggcaccgccaacgcgtatggacgctgcgcagctgaccgaagaaggctactacagcgtcttcggtaagagtggtgctcgtatcgagatccctggctgttccctgtgtatgggtaaccaggcgcgtgtagcagacggtgcgacggtggtttccacctctacccgtaacttcccgaaccgtttgggtactggcgcgaatgtcttcctggcttctgcggaactggctgctgttgcggcgctgattggcaaactgccgacgccggaagagtaccagacctacgtggcgcaggtagataaaacagccgttgatacttaccgttatctgaacttcgaccagctttctcagtacaccgaaaaagcggacggggtgattttccagactgcggtttaataagtaagcgcacgcgctgcgcataaacgacacaatgcccggtgaatgagattcccgggcattttttatttctaaaccatcgccgttccgctgtttttctccggtaaggctgcgataattacatcaatggcgcaatgcgatttcggcgcattgccgggagcagaggaacacacnnnnncattccattcattaattaattaatgaatgaatgnnnnntggtggcggcttaccgtaatttcgtgcagcagaagtaagtaaatcaggcggagcctccgtgctccgcctgagacgttaaacagcgggcatattgcgcccgtaataaatctcgcgcatttctttccacagcgcagcggtaatttcctggcgctcgctgtcggttaaatcttccggtttggtgtggaacatgtagtgcttaaggtcgaactctttaagcaacatcttggtatggaagatattctcctgatagacgtttacatccaccatgtcatacagcgccttcatatcttcggacataaagttctgaatcgaattaatctcatggtcgataaagtgcttcataccgttaatgtcgcgggtaaaaccgcgcacgcgataatcaatagtcacaatatcggactcaagctggtggatcaggtaattcagcgccttcagcggagaaatcacgccgcaggtagagacttcaatatcggcgcggaaggtacataaaccgccttcaggatgactttccgggtaggtatgtacgcaaatatgacttttatcgagatgggcaacgaccgtttctggcagtgggccgggatgttctgttttgtcgataagtttcgggtcgaccggttcttcactcaccagaatagtgacgctggcaccttgtggctcgtaatcctggcgggcgatgttaagaatattggccccgataatggaacaggtttctgacaggatttcggtcagacggttggcattatagagttcatcgatataagcaatataaccgtcgcgctcttcggtagttttggcgtagcagatatcgtaaatacaaaaactcagacttttggtcagattattaaagccatgcagtttcagttttttcaatttcttatcttctccttaggacggctgtgaagccagtgcatcttgcagatactggggtaaggcaaaagctgccgtatggactgccggattgtaataacggcatttcaggccagaagcgagaaaacgcgcctgaataatttcggttgagagatggcgtaaggcgtcgttatctgtcgcccatgcaaaggtcatgatgccgccgtaataggtcgggatcgccgcctgataaaagccaacatcgctgaagtaatggctgagtttgcgatgactgtcgatggcctcttcctgctgtaaaaagcagacgccgttttgtgcgacgaagataccgccaggattcaggcaacgtttgcagccttcataaaatgcagaagtaaacagactttcgccgggaccgataggatcggtgcagtcggagataatgacatcaaaggtctggttggtttgattaacgaaattgacaccatcgtcgatcaccagtttaaagcgcggatcgtcgtaactaccggcgttatggttgggaagatactgacggcagaacgacacgacacccgcatcgatttccaccatcgtgattgactcaacgtttttatgtcgggttacttcacgcagcatggcaccgtcgccgccgccgataatcagcacatgtttcgcgtgaccgtgggccagtagcggaacatgggtcatcatctcatgatagataaactcgtcacgctcggtggtttgtactacaccatccagcgccattacgcgaccaaatgcggcgttctcaaaaatgatcagatcctggtgatcggtcttttcatgatacagaacgttatctaccgcaaagtactgcccaaactggtcgtgtagcgtttcatgccactgttttttttcggccatgggttgatacctcctttgttaacacccgtaaaaaaatggcgcaacataatagctaacattgaccgcggatgcacggtcaatatttctacaaaaaggtatcagggattatttgacgtaggcaagcaggcttaaggaatcgcgagccagggctttgcactttttagcgacgggaatgccaatgccgctgagatcgcggtagctgtcttcaccgagggctttcatgtcgaaggtgtcgtaattactgagatcccactggttttgctgggcgaaaaagaccagcgcgcgacgaatttgcccgttaggtaagttctggtaaccacaatcgttcttcagaaaaacaaaaactgccgttaaatcggccatatcttcggcttcagactcgctgagcgcgtaactgtttgcgcaaacggccatcaggctgccgaataacactgttctgaaaaacgtcttcattgcttctaccaggggcttaaagaagataaacgttagcacactgcgagcgaggcgacgaccattattgtcgattaaattgtgtctgcggcttgaccttcccgtaaggggaaggactatgctcaacgtttgattttgtttcgcctgcttaagaataaggaaataactatgcaacgtcgtgatttcttgaaatattccgtcgcgctgggtgtggcttcagccttgccgctgtggagccgcgcagtatttgcggcggaacgcccaacgttaccaatccctgatttgctcacgaccgatgcccgtaatcgcattcagttaactattggcgcaggtcagtccacctttggcgggaaaaccgcaactacctggggctataacggcaatctgctggggccggcggtgaaattacagcgtggcaaagcggtaacggttgatatctacaaccaactgacggaagagacgacgttgcactggcacgggctggaagtaccgggtgaagtggacggcggcccgcagggaattattccgccaggtggcaagcgctcggtgacgttgaacgttgatcaacctgccgctacctgctggttccatccacatcaacatggcaagaccggacgtcaggtggcgatggggctggctggtttggtggtgattgaagatgacgagatcctgaaattaatgctgccaaaacagtggggtattgatgatgtcccggtgattgttcaggataaaaaatttaacgctgacgggcagattgattatcaactggatgtgatgaccgccgccgtgggctggtttggcgatacgctgctgaccaacggtgcaatctacccgcaacacgctgccccgcgcggctggctgcgcctgcgtttgctcaatggctgtaatgcccgttcgctcaatttcgccaccagcgacaatcgcccgctgtatgtgattgccagcgacggtggtctgctacctgaaccagtgaaggtgagcgagctaccggtgctgatgggtgagcgttttgaagtgctggtggaggttaacgacaacaaaccatttgacctggtgacgctgccggtcagtcagatggggatggcgattgcgccgtttgacaagccgcatccggtaatgcggattcagccgattgccattagtgcctctggtgctttgccagacacattaagtagcctgcctgcgttaccttcgctggaagggctgacggtacgcaagctgcaactttctatggacccaatgctcgatatgatggggatgcagatgctgatggagaaatatggcgatcaggcgatggccgggatggatcacagccagatgatgggccatatggggcacggcaatatgaatcatatgaaccacagcgggaagtttgatttccaccatgccaacaaaatcaacggtcaggcgtttgatatgaataagccgatgtttgcggcggcgaaagggcagtacgaacgttgggttatctctggcgtgggcgacatgatgctgcatccgttccatatccacggtacgcagttccgtatcttgtcagaaaatggcaaaccgccagcgacgcatcgtgcaggctggaaagataccgttaaggtagaaggtaatgtcagcgaagtgctggtgaagtttaatcacgatgcaccgaaagaacatgcttatatggcgcactgccatctgctggagcatgaagatacggggatgatgttagggtttacggtataaaaagaccgtattcggaaatatgcccggatctctccgggcattatggttacttcacatcatccggcaacgcataagccacaatatagtcgcccatcttcgtaccaaatgaaccgtgaccgcctgcggagatcaccacatactgcttgccattcacttcataggtcattggcgtagcctgaccacccgctggtaaacgaccctgccacagtttttcaccgttgctcatgttgtaagcgcgcaggtagttatctgccgtagcggcgataaacagcacgttacccgccgtggagattggcccgcccagcatcggcatacccatattgaacggtaccggtacaggcattgggaatggcatactgtcctgcggcgtaccaatacgtttcttccacaccacttcattggttttcagatccaatgctgagatatagccccatgctggctgtttacatggcagaccaaacggtgagaggaacgggttgagcgtgacgccatacggtacaccgtactgcggctggatgccggattccgtacccgtgcctttggcatctttcggctgttccatcgggttaccaggaccgcgtgggatcagtttcgaaacaaacggcagtgccattgggttggcaatcgccacttcacgattcggatcaacggaaatcccgccccattcgaacatccccaggttacccgggaagaccagcgtaccctgttcagatggcggcgtaaaaatgccttcatagcgcatctggtggaacatcacgcggcacaccaactggtcaaacatggtggcaccccacatatccgcaccgctcaaatctttcgtcggacggaagctcagttccgagaagggttgagtaggggtcacgtaatcgcctttggcagcaccttggggaaccggtttttccggggccggaaccaccagttcaccattgcgacgatcgagcacaaaaatgttgccggttttcgccggagcataaatgaccggcactttctgaccattaacggtgatgtccgccagcgtcggctgtgcaggaagatccatatcccacaggtcgtggtgaacggtctggtagctccacgccagtttcccggtagtggcattcagcgccagaatcgagctggcataacgttcctgttccggtgtgcgattaccgccccagatatctggcgtggtcacgcccatcggcagatagaccagatccagcttcgcgtcataggccgctggtgcccacgagtttggtgagttaaaggtaaaggtgtgttcgtcagacgggatcgcattcggatctttcgcgcccggatcaaaagcccacagcagctccccggtgttgacatcaaaaccacggatcacgccagacgtttcgcgggttgagaagttgtcggtgactgaaccggccatcacgatggttttatcggtgataatcggcggcgaagtcggctcatacagacccggtttggtgtccggcatattgctttgcagattgagcacgcctttattggcgaaggtttcgcacagcttgccgttttcagcgttaatcgcaatcagacgaccatcattgaccggaagaatgatacgacgcgggcaatccgccatcacttccggcgaagcagtttctgctttggcttcatgataagagacgccacggcaggttacatgctggaaggactcgttggttttcagctcaggatcgtaatgccatttctctttaccgctggcggcatccagcgcaaacagacgttgatgcgcggtacacaggtaaagggtgtcgcccactttaattggcgtcacttcattggtgatttcgcccggatcgttcggctgcttcacatcgccagtacggaacacccaggcttctttcagcttgtggacgttatcagtgttaatttgcttcagtggtgaaaagcgttgaccttcctgattgcgaccataggcaggccagtcctgatcggcaacgggggagatggcttctgctggcgtggtatcggcgcttaaggtgccgctgatttcctgcggatcgttaaatccggcccaggtcaggataccaccgctaatcagcagtgcgaccaccagtgcggcaactgcgccgctggcaggaatgaccaggcgacgccagacaaacggcaggatcagccagatgccgaagaagaccagaatgtcgctgcgcggagtcagcgcccagaagtcgaaaccaacttcccagacgccccaaatcatagtgccgagcagcagggctgcgtacagccaaagcgcggcgcgtttactgcgccacagcatccaggcgacgccgagcatcacaaggccagcgatagggtagtaccaggagccgccaatcgcgaccagccagcctccgccaatgagtagatacagcccgcaaagcgctgcaaaaagggctgttagcgtgacgagtaatcgccgcgagccggtattgttaattgccataaagagacaccatttcaattcattaatattttagtagcaattaattataggttttaacatgtgtgatcgtcatcacaattcgagctttattaacagattccgcgaatgaatagttttactggtatactgcgtgtcttgcgctttgttgcggtgctgaaacctgcccgtgcgaagtgatttgtttttaaatcatatggttatagatatgaaacatactgtagaagtaatgatccccgaagcggagattaaagcgcgtatcgccgaactgggtcgtcagattactgagcgttacaaagacagcggcagcgatatggtgctggtgggtctgctgcgtggctcatttatgtttatggcggacctgtgccgtgaagttcaggtatctcatgaagtcgactttatgaccgcctccagctacggtagcggcatgtccaccacccgtgatgtgaaaatcctcaaagacctggatgaagatatccgtggcaaggacgtgctgattgttgaagatatcatcgactcggggaatacactgtcgaaagtgcgtgagatcttaagcctgcgcgaaccgaagtcgttggcgatttgtacgctgctggataaaccgtcccgtcgtgaagtgaacgtcccggtagaatttatcggtttctcgatcccggatgagtttgtggtgggttacggcattgattacgcacagcgttaccgtcatctgccgtatatcggcaaagtgattctgctggacgagtaagtgtgaagttgccggatgtgttgcatccggcatggcgaatttatttgtgattgatgtgcttcagcttgaggttggagatcccgtgacggtaacgttgctcaagggtttcgcggttagtcgctgtgacatccagatcacgcagcaagccgtcgtgaatgccgtaggcccagccgtgaatggtaactttctgcccgcgtttccacgctgattgcataatggtggagtggcccaggttatacacctgttccatgacgttcagttcacacaaggtatccagacggcgctcttgcggcatttcgccgagcaatgagctatgtttgaaccagatatcgcggatatgcagcagccagttgttgataagccccagttctgggttttcaactgcggcttgtacgccgccgcaaccgtagtggccacagataataatgtgttcaacttcgagtacatccactgcatactgaaccacggaaaggcagttcaggtcggtgtgaatgaccaggttagcaacattacggtgaacaaagagttcgcccggctcaagaccggttaaacgttctgcaggaacgcgactgtcggaacatccaatccatagaaagcgcggtttttgcgcttgtgccagtttctcaaaaaacccgggatcctcttccaccagcatttttgaccatagtgcattgttgctgatgagtgtatctatgtctttcatggaggttaacgacctgtaaccaaataattacgtttggctaatatagggcaactccgggacgatttaaaccacagataaagtgtaagaacgtaaggtaagtaaaaatttatgaccattgcactggaacttcaacagcttaaaaaaacctatccaggcggcgttcaggcgcttcgtggaatcgatttgcaggtcgaagcgggtgatttttatgcgcttctcgggccgaacggggccggaaaatcgaccactatcggtattatcagctctctggtaaataaaacctccgggcgggtcagcgtatttggttacgatctcgagaaagatgtcgtaaacgctaaacgtcagttggggctggtgccacaggaatttaacttcaacccgtttgaaaccgtgcagcaaattgtggtgaatcaggcagggtactacggtgtggagcgcaaagaagcgtacattcgcagcgaaaagtatcttaaacaactcgatctatggggaaaacgcaacgaacgtgcgcgtatgttatctggcgggatgaagcgccgtttaatgattgcccgtgcgttaatgcatgaacctaaactactgattctcgacgaaccgaccgcaggcgtggatattgaacttcgccgctcaatgtggggctttttgaaggatttaaacgacaaaggcaccaccatcattctcaccacacattacctggaagaagcagaaatgctgtgccgcaatatcggcattattcaacacggtgagctggtggaaaatacttcgatgaaggcgctgctggcgaagctgaaatcagaaacctttattctcgatctcgcaccgaaaagtccgttaccgaagctcgatggctatcagtatcgactggtagataccgccacgctggaagttgaagtgctgcgtgagcagggcatcaacagcgtatttacgcagttaagtgagcagggcattcaggtattaagtatgcgtaacaaagctaaccgtctggaagagctgtttgtttcactggttaatgaaaaacaaggagatcgcacatgatgcatctttactgggtggcgctaaaaagcatctgggcgaaagagatccatcgctttatgcgcatctgggtgcagacgctggtgccgccagtcatcaccatgaccctttactttattatcttcggtaacctgattggttcgcgtattggcgatatgcatggcttcagctacatgcagttcatcgtaccggggctgatcatgatgtcggtgatcaccaacgcctacgctaacgtcgcgtcatcattttttggtgccaagttccagcgtaatattgaagagctgctggtagcgccggttccgactcatgtcattattgccggatatgtcggtggtggcgtggcgcgtggtctgtttgttggtattttggtgacggcaatttcactgttttttgtgccgtttcaggtgcattcgtgggtattcgttgccttaaccctggtgctcactgcggtgctattctcccttgcgggtttgctgaacggcgtgtttgccaaaacgttcgatgacatcagcctggtgccaacctttgtgttaacgccactcacgtatttgggcggggtgttttactccctgactttgttgccgccgttctggcaagggctgtcgcacctgaacccaatcgtttatatgatcagtggtttccgctacggcttcctcggtatcaatgatgttccgctggtcactaccttcggtgtactggtggtctttattgtggcgttttatttgatctgttggtcgctgatccaacgtggacgtggtttgcgtagctaaggctatttcctctcctctggatttgggggagaggagttttgacggctatcaccctttatcaacaatggtcagggtagactgattttcggctaaggaggaaggcgatgttaggttgggtaattacctgtcacgatgaccgggcgcaagagatactggatgcgctggagaaaaaacatggggcacttcttcagtgccgggccgtgaatttctggcgcggattaagctctaatatgctcagccgcatgatgtgcgatgccttgcatgaaacggactctggtgagggcgttatctttttaaccgatatagccggagcgccaccgtaccgcgtggcttcattattaagccacaaacactcccgttgcgaagtgatttctggtgtcacgttaccgttaattgaacagatgatggcttgccgtgaaaccatgaccagttcagcgtttcgcgagcatattgtcgaactgggtgcgccggaggtgagtagtctttggcaccaacaacaaaaaaatccgcctttcgtcctcaaacataatttgtatgagtattaacccgcgattctgatgacgcttttgctacaataaaggcgttgtttcaccctcggttattttttcatgtacaaacaagctgttattctcctgctgatgctgtttaccgcaagtgtcagtgccgcgttacctgcccgttatatgcaaaccatcgaaaatgccgcggtctgggcgcaaattggcgacaaaatggtgacggtagggaatattcgggccggacaaatcattgccgtggagcccactgccgcaagttattacgtatttaattttggctttggtaaagggtttatcgataaaggccatctcgagccggttcaggggcgacaaaaagttgaagatggtttgggtgacctcaacaagccgctgagtaatcagaacttaataaccaggaaagatacgccggtttataacgcaccgagtgtgggcagtgcgccatttggagtactggcggacaatttgcgctacccgattttgcataaactgaaagacaggttaaatcaaacctggtatcagatccgtattggcgatcgactggcctatatcagcgcgctggatgcccaacccgataatggcttgccggtgctaacctatcaccatattttgcgcgacgaagaaaacacccgttttcgccatacttcgacgaccacctcggtacgcgctttcaataaccagatggcctggctgcgcgacaggggatacgcgacactgagcatggcgcagctggaaggttacgtgaagaataagatcaatctccctgcgcgagcggtggtaattacctttgatgatggcctcaagtcggtgagccgctatgcgtatcctgtgttgaaacaatatggtatgaaggcgacggcgtttattgttacctcgcgcatcaaacgtcacccgcagaaatggaacccaaaatcgctgcaatttatgagcgtttctgaacttaacgaaattcgcgatgtatttgatttccagtcacatactcattttttgcatcggatagatggttatcggcggcctatattgctgagccgtagtgagcacaatattctgtttgattttgcacgttcacgccgcgctctggcgcaatttaatccacatgttttgtatctttcttatccatttggcggatttaatgacaaagccgtgaaggcagcaaaagaagccggatttcacctggcggtgacgaccatgaaaggcaaagtaaaaccgggggataatccgttgttactaaaacgactttatatcttaagaacggattcgctggagacgatgtcgcggctggtgagtaaccagccgcagggataacaatcaggcaacctgtaccggaatcgctttcgcggtacgtttcatttcgttgtcgccttcaaaataggcgacgttgggtcgccaggtgcgagcttcttcatctggcatggtaacgaagctggcgatgatgacaatatcgccgacgctggcgcagtgggccgccgcaccgttaacagaaataattctcgaaccgcgttctgccgcgatggcataggtggagaaacgcttgccgttggtgacattccagatatcaatggcttcgttttcgagaataccggctgcgtcaagaaaatcctgatcaatggcgcaagaaccttcatagtgcaggtccgcatgagtcactttcacgcggtggagtttgccctgcagcatcgtgcgaatcataacttctacctttctaccctgtcgttaacgaagcaggcgatgcctgctttgaggaaattctcacgcagtattgcccgatttttgttgagtgtctactcatctgacggcatttgcagcagcagtttgcgtaccgtgccgaagcgtgccatgtaacgcctgtaaccaattgaaatttatctgaacgctgctcggtaaacactaaagaggcggctgacgacggcacaccatgactggatactgccttcacgcaagaccacacggaaggcagggaagatggatgcaccgagtaccacaccgcatgatgcggtgtttaaacaatttttaatgcatgcggaaacggctcgcgactttctggatatccatttgccagcggagctacgcgaactgtgtgacctcgacacgctgcatcttgagtcggggagttttattgaagaaagcctgaaagggcacagcactgacgtgctctattccgtacagatgcagggtagtacgggttatctgcatgttgtgattgaacaccaaagcaagccagataagaaaatggcctttcgcatgatgcgttattctattgctgccatgcaccggcatctggaggctgatcacgataagctgccgctggtggtgccaattctgttttatcagggcgaggccacaccttatccgctatcaatgtgctggtttgatatgttttactcaccggaactggcgcgacgcgtctataacagtcctttcccgctggtggatatcactatcacaccggatgacgaaatcatgcaacatcggcggattgcgattctcgaactgctgcaaaaacatattcgccagcgcgacttaatgttattgctggagcaactggtcacgctgattgacgaagggtacactagcggaagtcagttagttgccatgcaaaactatatgctgcaacgcggtcatactgaacaagcggatttgttttatggtgtggtgagagacagggaaacgggaggggagtctatgatgacgctggcgcagtggtttgaagagaaggggattcagcagggaagacaggaagtaagtcaggaattcgccctgcgtcttctgagtaaaggaatgtctcgggaagacgttgcagagatggcaaatttacctcttgctgagattgataaaatgattaactaagttgtctgcattatgaataattgcctacagataacgtggcaatgaataactggcgccatcagccgtagcgccagttaagcattacgccagttcgaccagtttgttgtcgatcaggcgagcatcgccaagccaggcggctaccagaatcactgcgcgtttgctgttttcagagacttccagcaatgtgtcggcatcacgaatctgaatatcatcggaacggaaacctttttcattcagttcttgcccggcaatagcaataatttcatcgagatcccgttcgccagcctgcaatttgtcggcaattgaacttaaaaccttgtacagaccgggcgcaattttgcgttgttccgccgtcagataaccgttacgggaactcagcgccagaccgtctttcgcacgcataatcggtacgccgacaatctcaatatcgaagcccatatcagcaaccattttgcggatcagcgccagttgctgaaaatctttttcaccgaagcaagcgatatctggctggaccaggttgaacagcttgctgacgatagtcgacacgccgcgaaaatgtcccggacggctggcaccttccagcatggtggaaagaccgggaacatcaacataggtgtgggtttcagtaccgttcgggtagatctcttttaccgaaggcgcgaaaactaaatccactttacgtttgttcagcttttcgcagtcctcttgcaaggtccgtggataacgtgccagatcttccgggcggtcaaactgcattgggttaacgaaaatactgacgacgaccacatcggcgcgggctttggcttcgtcgaccagcttcatatggccgtcgtgcaggttacccatggtgggcaccagcgccacgcgcttaccttccatacgcaggcggcggatttgctgacgcagcagcggcagggtttcgataattaacacaacgtcactccttaatggaaactgtgttcttcgcccgggtaaacgccggactccacttcagccatatactgccgcacagccgcgcggatgtcgcccgtttcggcgaggaaatttttggcaaatttagggatatgaccgccagtaatgccgaacgcatcgtgcatcacgaggatctgtccatcggtaacgttgcctgcgccaataccgataaccgggatcgccagtgcttcggtaatgcgttttgccagttcaaccggcacgcactccagtaccagcagttgtgccccagcagcttctaaggctaatgcatcgctgagcagtcgatcgcccgcttcatcgccgcgcccctggactttgtagccaccgaaaatattcactgactgtggggttaggcctaaatgaccacaaactggaacggcacgttcggtcagcatttgtacggtttctaccagccactcgccgccttcaattttgaccatgttggccccagcacgcatgacagtcgcggcgttttcaaaggcttgttccggcgtggcatacgccataaatggcaggtcagccagcagaaggcagtttggcgcgccgcgacgcacagcggcggtgtgataggcgatatcggcaacggtaaccggtagcgtggagtcatgcccctgaaccgtcatgcccagtgaatcgccgaccagcatgacgttaagtccttcttcggcaaacagttttgcgaagctgtagtcgtaagcggtgatggttgcgaaacgttttttgtcctgcttgcatttctgcaatgaagcaatcgtggttggtttcatagcgtatcctgataaatgatgttgtgctgtctcgcattttatcagtcacattggtgggggcaatgatttatccgtatcgcaccgccgttgtctggcggtgcgatagtgttatcaggggtaggtaacctgaaaagtgctggtggctttaaaatcccccggttctatagcaatattaccgtcttgttttaatgtagcctggaaatgaagaggttgtgaggtaccgtttcctttatccgggtaaattcctccggtagtgtcatcttctgtttcataatctttataaatagacgttgcatcatttggtttcagtaccatttgtgcacttttagtgttttttaaaccttcaatcagtacaccaacgccttttgctgcgtcatttcctgtgagtgtgttagccagaagttctttgcttacactacccaccttgtttgacttgagttttgtttctatattgcgaacacgaatacagttctgtagcgtgatatcaaaaggaaccgctgttgcgccattttttatttgcgctggggtataatcacccattttaaccgttgaaccacttaccgatgagccactaagcgccgcagtaaaacaggtagggtttgttaatacgatatctgtcaggtcaaagtctattttaagaaaatagctgtagtcattgataccaatgccagcaccatatgctttgaatgagtagaggtaattatctgttctggataatgttacccgttgattcgttgtcgggttaaagtcggtatcggtataaaattcaatcgtgagcgtttgcataacgccgccaacggcccaatatttattttttgtattcgcattgttgcaagaccaatatagtgtttgctcgctttcgccacgccagttaaaagattggctcgtagaatcgccaatatacatgcctgatgggttgatatcagtatatgtatatgttgaccaaatgtttgatattgctaacgtgtaatacaggcctggaacagatgtcttaaagagtttatgtccgccataacttttaccggaatcaaccattttattttcaatatgcattggcccgccgcttgtgctaccactcctgttacagtaaaggaaacctccacctgaagcggaatctaactgcgcccattttaatgacaccccggttgggccaagttgggttggtttataaaaaactaaattattggtgactgagccataccggaatttgacggtaacatctccattaggacctgtctctcgccatttttggcctgatggaccaacaccgtaattattcccaacaacatagccgacgtgatcatcggtaccggcacttgctatataacaacaagagcacagtgctaaaaaaagaaagtatctgaagaatatcttcatttttactccattgtcatgctgcaagataatgcttgcagcactttgtctgttattcgtagtaaatatccactaacacatggcttatcagtgggccagaggtgacattcagcgctggatcgattttttgcattcgggtgctaaatttccaggatgaattatttagtgctgatgacatgaccggataaacggaacgtgagctaccagtggcactaagaacgttgaaggtatttgccgggtcctgaatagaaaatataactaccccaacatttttagccccggcgttgtcttcattagcgaatatttgactggaacctgtcgccattacgccactgagtgcgcgaaaattaatatgtaactgatttaacacattccctgtgccctgaagtgtgcagtcctgtactgtaatagtgaactcttttccaccggggtgataattttcggctgaaatgtttccggtaaaatcgcccacgccaacgacacctaaatcaatatttccgttgttgctgattccactttggcaggtgttattttttatatttgcaacaatgtcaacatcctgtcctgcaaccacaggggaagtggcgctgaatagcaacgacagaagcagaattgattttttcatcagattacgttgagtgggacgcatatttagttcctgaatcagtctgcctgttagttataagtcacggtgaatgttgccggggcagtgaaatcacccgcagtgacatttgtgacagttttatcttttgcgaccaccaacaccgcactcattgggtaatcgacaacattgctgcccgtcgcattagcaatactgacttcttctgttgcgggggtgacacaactgaattgtttagcgccgttcttacctggtgtggatgtgctccagacctcaacggcgaccgccgctgcttttgctgttgccgttgatgcgttagcaaatccaggaccattattagaattaccttcacataatgctcgtgtagtcaattttattttggcctttttcccgggaatccccgcacagtctttgaactgtaatttgaaggttttaattttagtttcggcattaatttcagaaatatatacatcaccgaaattgatggtggaaattttagttgtaccgtcatcagtcaacgttgatgtacaggtacccatttctacgtcagtagtaacagtcaggccaatactgtcagtggccgcatgtgaggaaatggttaacagtgatgaagccagaaatagactacccgataatccataacataatttttttaatatcatcattgtcatccttgttattgatagctgaagttaaaagttgccagtgcgcgaaacttgcctggaacacctttccctacacttgtttcacgcagtgcgacagtcatctcaagtccatcggtgctaatttctgatgcactccaacgtatatattctgcgctattaggtttcagaaatgtatcgcctgaagtcgccttccttttaaatcccattccgatatagcttgtggtggaggttgtatcactggccagggggataattagcgcgggtgaacttcctgattgatttcctgtcagggttgtatcaatccagctaattccactgctgcatccattggctaccaatttaaagttggcttcagattgtgctgttttattggctattttatccattcccatcgagggaataactaaggtgtacttatcttttccattatcagtgacattagttccggtaagtgtaatattacaggttgttgctttcacggtagcggtaaaatcgacattaacatccgttgcaaataccgaaggcgataacaatagtcccatgagtattgttattttatgtggtgtgatttttatcattggaagtcccttgtggttactgtatctgacaacgaagtccgttcagaataatagattgtgctattttttctgatgtcgtgttttgttgataatgagcaaaacaactgaccggtttgccctcttcaatccaggtaattcgtatatttccttcctgcccgataccgcgaacaaaggcctgaccaccctgacctacgttgccgatgatattgttttgttcatcataaatatccgctgcaaatggaatatttttaccatcgcttcgcacgatgttcataattgccgattgtccctgaactgtttcaaaatcagcaaagacgacggctccctggcgcgggacggcgacagtactggtgcttttcaattcaacatcgttttccagatcgttaatgtccagtgcgatacgattttcatggtatggcgaaagggcgctggtcacaccataaccccagcggtctacggtgctgtttccgtagttaatacgagcgccttttgctcctggcgcctgaatgacagccagagtgtcggaatcactaaaactgtcattactgaacgtcagcccgccgctatgtaacacaaatccaccatcagtattgagtgagaattggcgactattatcactgcttgctgaggctgaacctgacagcgttccccacggcgattcataactggcataaccgccgatataactcaaatcatcactggatttattcatcatataacccgtgtttacgctgtagctgatgcgattggtatcgctgtaaccactactgctgatattgagttggttattacccttaaagtcgctgtttaattgtgtatcaatactctggaagccggagctgcggtgttccgtacccagtaaattttctattggaattgtgaagctgagataaatgctatcgtcggtttgaccatcttcattcaacgaacgttgagcactgatactgtaactgccccaggacgcactattgctataaccaatagagtaattagtactgttttgcccggaggcccagtaatctgaccagcttccagagagataaaatgaaccgtaatcctttttctcaaatttcagcggttggttgatactgaccgtgacctgatttttcatgcgcgagtaattgcgcatggatttaggctcaagatcttgctcaggatgttctacttcatcaatcagcgtcagcgcatcattgaggcccagataatgctgggtggagtagcgataggccgcgatatttaatgatgtactggtattttcaaataacttgttccaggaaatacggtagctttgtccttgataggttttatcgtccggaatgctgacatttgagtgagtaacatcgacagaaaaagcccccacgggggtattcataccaagccccagcaatccggcggtatagttattatcggttagctgaataccggtatatcctgtcaggtagttattcaaaccatagtagtagctggcttgaaataaattaggctcatcctggatactgtcttttaaaacctgaccggcgctaatatcccagcgaccaacgccagggcgcagcatttgcacaacagatgaaaatggctgggagaacgtccgttttgtgccatcagcttcttcgatagtcacaatgagatcgctgccataacctgacgggctaagatcgtcaatggcaaaagcccctggcggcaccgtcgtttcatagatcttataaccattttgcataacggttactttggcattggtattcgctacgccatgaatgattggcgcaaaactggctaataccggaggcagcattcgactgtcactgtataagcgaataccgcgaattctgactgaatcgaaggtctcgccggtcgtgtaagattcaccaataaccagttgtgaacgtagtgacgcaagatcgcgttgtaaatagcgattctgaaaatcgtaatcgctatggacattggtcatccagttgtagttacctgaggcacgtaaccgccacgcgcctaagtttatcccaccgttgaatgccgcgtagatactgtcatttgttctgcctggactttcactgtgatatccattgaggttgtaggaaagcatggctgcattaatgccattttcccacaaagagggatcaacatagttttgataattcttcataatccatgcctgggggacatcgatatccaggcgttgatcgttaacatcgtaacgaatggatgattgagggatcatttcagccagattgaggcaatcaccaagatcgtcgtctcgcttaagcaaaatggctttttcgctattcttgtctggtgaactgatatgaaattgcaataaatttttctgcgtaatgcaggcctgagcgttctttttaccttcaataacagcaaaagcaatgctttggctcatgatgggttgatcgttaacatacacactgacatcgtaaatgccaggtagtgtgggattgccttctgtataccgactaaggtcgatatttgaagcatcctttcccatcagaaatgtatggtcatattcgacgagttcagcgcataaagcactattgctatacagcagagcgcaaaacgtggcgatgtgggtaaggtgattagtagatttaatagtcacgttctgcttcctgctgtgttatatccttgccagattaaaggttggcgttgccttcaatagatccaccaaaatcattaatggcgaaaaaatgcacttttgcagagcttgttctgccactcatcccatttaccttgatgacgtcgttactgaacggcgcaatcattgtcatatccaggggatagcgtttgccgttggcttctaaatcaccactgctaaaagagacatagtagggcgtagggttatcaacgcgtaatgctgctttgccttcagatgttgcccaggaccacttcagagccaatggtgcatcagatgaaattccactcaatccttccgggcgatagaacagttttatacgtgtgcgaaatgccagttgtagcaggctttgatttgctgcttttgctgcatcgggttttggtggaacttccagtacgttaaaccagaacacactttctctgtcttttggcagagcactactggcggtgtacatcagtttgattgtttggccacgtttagcatcaatacgtgatactggtggcgtagcggtaaaggggacagtaatactgcctggttcagcgttatcatctccagtatctaaccaactctgaaccagcaatgggttattgcctttattttccagacgtacattgacgcttttttgttcgcttttataaactacgcgtgtacctgaaattacgatgtctgcaatagctgatgagctaaaagccatacagctcgctaagcacaatgctgcggtatgtttagtattaaaaaacataaaccattccttacagaattaattaaaacagggaataattatcaaaagtaaaaatatttgatgttattccctgtatatattcacccgatcaatttaagcggttgatatttactggtaagtaatggtatatgctgagttggtttttacataaccggcagtagctgctttgcttgcatccgcacgaacataggatgctttaaaatcgtaggttgcagatttagacgttgaatccagagttttgctgtaaacatcacccggattattgacctgaacctgtttaatagtagaaccttcaatattgtgcagagcgatatttacgccgtcagacggggtgttaatagacatgtcgttgttcagtgttcctttgctgttaccaaagaaaacagaaccgaaggtcatttttgcagtagtacccggagccgggttagctttgctgcagtcaatagtaatgctgaatggtttagctttagcacctacagtggtatccagtacaccatcagtaatttcagcaacagtagcggtttgcagcaggatcagaccgtctttgttaccgccatcaacacgagcttcacaagtgttatcaacgaccagaccgctaatatttaattgaccgccgtccatatcgttagcagcaaatgcagtaccagcagccattgccaacataataccggacagcgcaaaacctaattttttagacataaaaatccttgagtaatattccataaagcagataacagcattgcatgatgatgagattttgatgcaatgccatgtaactgaacgttactttgttaatgatgtttgtttgttttttactaagtattacattcattcatcattgggacagctattttgcataatgccatgacatatgcaatttaattttactaaatatgaaaattagtaaaattaactttaaaaaattaagggggtggtgtatggaattagaacttcaggaaggtatattatatttctgtgcttttatttatcttaaatatattattatttgcaatagctcgagattattttcggaatatatttatattcatgcaaaaaataattaccacttatctaattcattaaagccttttgcctgtagagcttcaactaatgataagccatcaggaaataccaattccggcgcaatttcaaacagtggccacagcataaagccgcgatttttcatatcgtagtgcggaacggtcagacgttcggtatttattacttcattaccaaacagcatgatgtcgagatccagcgtgcgcggtccccagcgttcagctttacggacgcgaccttgctgcaattcgatacgctgtgtgtgattgagtagcccttcaggggcaagagtggttttcagcgcgacggcggcatttaagtaatcgggttgatcttgcggccccagcggtggggtgcggtaaaacgaagaaacagcaagaatgcggctttctggaatatcgcctaatgctttcagggcagcattgacctgctccagcggagaggccagattgctgcctatggcaatatacgccactgtcatgcggtaccctcacgacgcggtgcgcgtttgcgtggacgacgagtacgacgacgcggtgacggttcttcatccagttcgttaagcatccctttttggtctggtggcgcggaaacctggaactcaccccaccatttcaccagacgttgcagttcagcgttacgctcaacttcggctcgtaaggccaacaggtcgtatgccgcacggaacttaggatgctccagcagtttccatgcgcgtttaccctgacgacgggacatacgcaactgcaactgccagatatcgcgggttagcgtggtcagccgtttcgggatcgccagtgaacggcaggcttcgtccagcacgtcgttcatcgccagtgcgaaagcgtcgtgataggtcaggccgctttcctgggcgatcttctgtgccgtctccagcaatgggtaccagaacatggcggcaaacaggaacgccgggttcacgcgcatatcgttatggatacgcgtatcggtattcttcagtacctgctcaataatgcgttccatcgggctgtcgccattttccgtgaagtagcgggtaatggtcgggaacagcggctggaacagatgatattcacacagcagcttataggtttcgtaaccgtagcccgcttgtagcagtttaagcgattcttcaaacaggcgtgccggtgggatatcgttcagcagggtagcgaggcgagggatcggttctgnnnnncattccattcattaattaattaatgaatgaatgnnnnncttcacggtagcgcgtttccgggttaccaatcagacggataacgccgtctttcagatccttcatgccgccaacgtaatcacggacggtaaaatctgccacgctgtaatacaggctgttgatagtgaaatcgcggcgctgggcgtcttcttcgatggagccgaaaatgttgtcgcgcagcaacataccgttttgcccgcgttgggaggtcgtgcggtcgctgacgttaccttcgtgatgtccacggaaggtcgcaacttcgataatctccgggccaaacatcacatgagccagacggaaacggcgacccaccaggcggcaattacggaacagtttgcgcacctgctctggcgtggcgttggtggtcacgtcaaaatctttcggctttttgccaagtaacaggtcgcgcacgccgccgccaaccagccaggcttcgtatcccgctttattgagcctgtacattaccttcagggcattttcactgatatctttgcgggaaatagcatgctgctcacgcgggatcaccgtcacctgtggacgggcgactgcctgttcagcctcgctttcctcgcggcttagcaccttgcggcaaaaattagcgactcgggtaaaaatagtacacctcggtagtgtcaaacatcattcaggacaaaaaaatagcggctaatcatagctcagcatgacgcatttgagaatgttgaatttacaattgccgactcaggcacggcggtcagcgtccagtttttgacggctgactgaaggatttgctcgacgctgaaatcctgccagtgtgtttctacctgctgacccagaaaatgaagtgccgcgattaacaccgggcgcggatcgcctttcggcaacgcaggcgcatgattctgcttggaaagtttagcgccttgtggattaagcgccagcggtaaatggatgtaatctggcactttccagccaaaaagctggtacagcgagatttgccgcaccgtcggttcgatcaaatctgccccgcggacaatttcgctcacgccctggaagtgatcatccaccaccaccgccaggttataggcaaacaaaccatcacggcgatgaataataaaatcttcccgtgccagtttttcgtcggcgtgaataatgcctcgcagcagatcagtaaactgggtgaccggatgctgctggcggatacgtactgcggcgttgtctggtccatgatgcaaatcccggcaatgaccgtcgtaaataccgccaatgctttgaatacgcgcacgcgtgcaggtgcagtaataacttagtccttgctcatgtaaccaggcgagtgcttcgcgataggcgtggtgacgttgcgattgccagagaacgtcgccgtcccagtgcaggccgtaatgttccagctggcgcaggatagtttctgcggcaccgggaacttcacgaggcgggtcgatatcttcaatgcgtaccagccagcgaccttgccgggcgcgagcctgcaaatagctgccaagcgcagcaatcagagaaccaaaatgaagctcgccggaaggagagggggcgaagcggccaatatagtgtgtgtctgtcatctctttgaacaaaaaataaggcgggagcatttcccgcctgtggtaaacgtgatggaacggctgtaattagccagccatctgtttttcgcgaatttcagccagcgttttgcagtcgatgcacagatcggctgtcgggcgcgcttccagacggcgaataccaatttcaacaccgcaggattcgcagtagccgaaatcttcgtcttccacttttttcagcgtcttctcgatctttttgatcagcttacgctcgcgatcgcggttacgcagttcgaggctgaactcttcttcctgggctgcacggtctaccgggtccgggaagttggctgcttcatcctgcatatgtgtaacggtgcgatcgacttcatccctgagttgattacgccatgcttccagaatacgacggaagtgcgccagctgggcttcattcatatactcttcgcccggcttctcctgatatggttccaccccagcgatggcgagaatactcagggacgatgttttacggttttgcccttcttgcatgttgcttctccttaacacgcactatcgatccccatgttcgggggaaaaatgaggccgctataaatagcagatgcttttccggatagcaattatctaaacgtaacacttgacaactgtgtgaggaaaagcgtatttgcgcacgcgaccagaatgtaaattaaccagttacttactctactacaatgtaaccggtagtgattttttaagagccatgccttcggcagaaagttccgctttgtaagccagaatttctacccccctctgttgagcttctgacaatagttgcgcgtatttctcatcgatgtggcgcgcgggtgaaaaccgtgtaatggctgaatgcagcacggcgaaaaagataaccgcacgctggccttcagccgctacgctcatcaactcccgaaggtgtttctgacctcgttcagtgaccgcatcgggaaaatatccctgttcgttctccgctaacgtaaccgatttcacttcaatatagcagtctggacgcgaatccgcctgcaacataaagtcaatacggctgcgttcggcgccgtattttacttcgcttttcagcgagctatagcctgccagctctgaaattgattcattaaggatagcctctttcgtcaacctgttagcccaaagcgtattgacgcaaataattgcgccgctctggctttgagttaattcccaggtgtgtgggtatttccgtttggtgttgtctgaagtcgaataccagacggtatcgccaggcgttgcacaaccggtcatcgcacccgtattcgggcagtgtagcgttaattcgcgaccatcgggtgtgatcacatcggctaaaaaacgtttgtaacgctgaattagcgtcgcgcgctgtagagggggagaaaattccattgcgacaatccttgttattgcgttagcgcccagcgttttagcggcgtgtagcgtgtgcgtccacgggcaaacgaggaggcgtaaagggtgaactccgtcaccgtatacgaccagttaaaacctggcggcgggattgtcaccgcctcgctggcgtcgcgcaataaggtaatatgtggatgaaacggacgattgctttgaaaacaaccgctgcgggcagcctgtgaacggagcatattcgccagctggattaagccgcgtggcggctgtcgcatccctaaccacaccacacgcgaacgcagccattgaccggcgtcatcaagcgtgagtgtgaaaccaggttgacgaatccgtccggctaaaagagaaagcgccttctctttctctgcgctcacttcgcctaaaaatgccagagtcagatgcaaattatcggcggcgaccggacgtcccgcctcaggtgggaagtgtgtggcgcgccagcggataatctgttcgcggatttctgcaggtaagtcgatagcaaagaacagccgttgcggttcagacatgtgaggcactcggttatgaattaccgcgatgctacaatgtggcgcgaagaatgttaaccctctggagcgttttgtgtcgtcgttgcccgttgctgccgtcttacctgagttacttgctgccctcgatggtgcatcgcaggtgttattaagtgcgccgaccggggccgggaaatcaacctggctgccgctgcaactgctggcgcatcccggcattaacgggaaaattatcctgctggagccgcgtcgtctggcggcgcgtaacgttgcgcaacgactggcggagctgcttaacgaaaagccaggcgataccgttggctaccggatgcgtgcgcaaaactgcgtcgggccgaatacccgcctggaagtggttaccgaaggcgtgctgacgcggatgatccagcgtgacccggaactgagcggtgttggattggtgatccttgatgaatttcatgagcgcagcttgcaggcggatttggcgttggcgctgttactcgatgtgcaacaaggtctgcgtgatgaccttaaactgctgattatgtcggctacgctggacaacgaccgcttgcagcaaatgctgccagaagcgcccgtcgtcatctcagaagggcgctcgtttccggttgaacgccgttatttgccgctgcccgctcatcagcgttttgacgaagccgtcgcggttgccaccgccgaaatgctgcgtcaggaaagtggatcattactgttatttttacctggcgtcggagaaattcagcgtgtgcaggaacaactggcttcacgcatcggcagtgatgtgttgctctgcccgctgtatggcgcgttgtcgctgaacgatcagcgaaaagcgatcctcccggcaccgcaagggatgcgtaaagtggtgctggcgaccaatattgctgaaaccagtttaaccatcgaaggtattcgtctggtggtggattgtgcccaggagcgtgtggcgcgttttgatccgcgtacagggcttacgcggctggttactcaacgcgttagtcaggcgtcgatgacgcaacgtgccgggcgtgccgggcgtctggagccgggtatctgcctgcatttaatcgccaaagaacaagcagaacgcgctgccgcacaaagtgaaccggagatcttacaaagcgatctttccggtttgctgatggaattactgcaatggggatgcagcgatccggcgcagatgagctggctggatcaaccgccaacggtgaatctactggccgcgaaacgcctgttacggatgctgggggcgctggacggtgaacggcttagtgcgcaagggcaaaaaatggcaacgctgggtaacgatccgcgtttagcggcaatgctggttagcgcgaagaacgacgacgaagctgctaccgcggcaaaaattgccgccattctcgaagagccgccacggatgggcaatagtgacctgggcgtggcgttttcgcgcaatcaacccgcctggcagcaacgtagtcagcaactgttaaaacgcttaaacgtacgcggcggtgaggcagacagttcgcttatcgcgccgctacttgccagagcgtatgccgatcgcattgctcgtcgccgtgggcaagatgaacgctatcaactggcgaacggcatgggggcgatgctcgatgccgacgatgcgctaagccgccacgaatggttgatcgcaccgttattattgcagggcagcgcctcaccggatgcacggattttactggcgctgccggtcgatattgatgagttagtacaacgctgcccgcagctggtacagcagtctgacactgtggagtgggatgacgcgcaaggtacgctgaaagcctggcgtcggctgcaaattggtcagttgatggttaaagtgcaaccgctggcgaaaccctcggaagacgagttgcatcaggcgatgcttaacggcattcgtgataaaggtttaagcgtgctcaactggacggcggaagcggaacagctacgcttgcgtttgttatgcgccgcaaagtggttgccggaatatgactggccagcggttgatgatgaaagtttgttggcgacgctggaaacgtggctactgccgcatatgacaggcgtacattcgctacgcggcctgaaatcactcgatatttatcaggcactgcgtggattacttgattgggtaatgcagcaacgtctggatagtgaattgcctgcgcattacactgtgccgacgggaagccggatcgccattcgttaccatgaagataacccgcccgcgctggcggtgagaatgcaggagatgtttggtgaggccactaatccgactatcgcccaggggcgcgtaccgttggtgctggagttgctttcccctgcccaaaggccgctgcaaatcacgcgtgatttgagcgccttctggaaaggagcgtaccgtgaggtgcaaaaagagatgaaagggcgttatcccaaacatgtctggccggacgacccggcaaacaccgcaccgacgcgacgaacgaaaaagtattcgtgaagaccaaagcaaatttgagagatatcttcttctgtcttgcaacagaagaacagaaaatcgggcttttgcgcctgaatattgcggagaaaaagcatggccgggaatgaccgcgagccaattggacgcaaagggaaaccgacgcgtccggtcaaacaaaaggtaagccgtcgtcgttacgaagatgacgatgattacgacgattatgatgactatgaggatgaagaaccgatgccgcgcaaaggtaagggcaaaggcaaagggcgtaagcctcgtggcaaacgcggctggctatggctgctgctaaaactggctatcgtttttgccgtgctgatcgccatttacggcgtttatctcgatcaaaaaattcgtagccgtattgatggcaaggtctggcaattgcccgcggcagtttatggtcgaatggtcaaccttgagccagacatgaccatcagcaagaacgagatggtgaagctgctggaggcgacccagtatcgccaggtgtcgaaaatgacccgtcctggcgagtttaccgtacaggccaacagcattgagatgatccgccgtccgtttgatttcccggacagcaaagaagggcaggtgcgcgcgtgtctgacctttgatggcgatcatctggcgacgatcgtcaatatggagaacaaccgtcagttcggtttcttccgtcttgatccgcgcctgatcaccatgatttcttcgccaaacggtgagcagcgtctgtttgtgccgcgcagtgnnnnncattccattcattaattaattaatgaatgaatgnnnnngacgtgcggtgctggcaaacctgactgccggacgcacggtgcagggggcgagtacgctgacgcaacagttggttaaaaacctgttcctctccagcgagcgttcttactggcgtaaagcgaacgaagcctacatggcgctgatcatggacgcgcgttacagcaaagaccgtattcttgagctgtatatgaacgaggtgtatctcggtcagagcggcgacaacgaaatccgcggcttcccgctggcgagcttgtattactttggtcgcccggtagaagaattgagcctcgatcagcaggcgctgttggtgggtatggtgaaaggggcgtccatctacaacccgtggcgtaacccgaaactggcgctggagcgacgtaacctggtactacgtttgctgcaacagcaacaaattattgatcaagaactctacgacatgctgagtgcgcgtccgctgggtgttcagccgcgcggtggggtgatctctcctcagccagcctttatgcagctggtgcgtcaggagctgcaggcgaaattaggcgataaggtaaaagatctctccggcgtgaagatcttcactacctttgactcggtggcccaggacgcggcagaaaaagccgccgtggaaggcattccggcactgaagaaacagcgtaagttgagcgatcttgaaaccgcgattgtggttgttgaccgctttagcggtgaagttcgtgcgatggtcggtggttctgagccgcagtttgcgggctacaaccgtgcgatgcaggcgcgtcgttcgattggttcccttgcaaaaccagcgacttatctaacggccttaagccagccgaaaatctatcgtttgaatacgtggattgccgatgcgccaatcgcgctgcgtcagccgaatggccaggtctggtcaccgcagaacgatgatcgtcgttatagcgaaagtggcagggtgatgctggtagatgcgttgacccgttcgatgaacgtgccgacggtgaatctgggcatggcgttggggctacctgcggttacggagacctggattaaactgggtgtgccgaaagatcaactgaatccagttccagcaatgttgttgggggcgttgaacttaacgccaatcgaagtggcgcaggccttccagactatcgccagcggtggtaatcgtgctccgctttccgcgctacgttcagtcatcgcagaagacggcaaggtgttgtatcagagcttcccgcaggcggaacgcgctgttccggcgcaggcggcgtatctgacactatggaccatgcagcaggttgtacaacgcggtacgggtcgtcagcttggggcgaaatacccgaacctgcatctggcagggaaaacagggactaccaacaataacgtagatacctggtttgcgggcattgatgggagcacggtgaccatcacctgggtcggccgtgataacaaccagccgaccaaactgtatggtgccagcggggcaatgtcgatttatcagcgttatctggctaaccagacgccaacaccgctgaatcttgttccgccggaagatattgcagatatgggcgtggactacgacggcaactttgtttgcagcggtggtatgcgtgtcttgccggtctggaccagcgatccgcaatcgctgtgccagcagagtgagatgcagcagcaaccgtcaggcaatccgtttgatcagtcttctcagccgcagcaacagccgcaacagcaacctgctcagcaagagcagaaagacagcgacggtgtagccggttggattaaagatatgtttgggagtaattaacgtctaagcgtgatataccggatggcgagctgccatccggtaaaataacatcccctccaaagtattaaccctttcttttcatctgattgtttattgacccttcaggaatgcgcagattgcgtaccgcttgcgaacccgccagcgtttcgaatattatctcatctttataataatcattctcgtttacgttatcattcactttacaccagagaaataccaatggcaccttccaaaactgctcagccaaaacactcactgcgtaaaatcgcagttgtagtagccacagcggttagcggcatgtctgtttatgcacaggcagcggttgaaccgaaagaagacactatcaccgttaccgctgcacctgcgccgcaagaaagcgcatgggggccggctgcaactattgcggcgcgacagtcagctaccggcactaaaaccgatacgccgattcaaaaagtacctcaatctatttctgtcgtcaccgctgaagagatggcgctgcatcagcctaagtcggtgaaagaagcgcttagctatacgccgggtgtctctgttggtacgcgtggcgcatccaacacctatgaccacctgatcattcgcggttttgcggcagaaggccaaagccagaataactatctgaatggcctgaagttgcagggcaacttctataacgatgcggtcatcgacccgtatatgctggaacgtgctgaaattatgcgtggcccggtttccgtgctttacggtaaaagcagtcctggcggtctgttgaatatggtcagcaagcgtccgaccaccgaaccgctgaaagaagttcagtttaaagccggtactgacagcctgttccagaccggttttgacttcagcgatgcgctggatgatgacggcgtttattcttatcgcctgaccggtcttgcgcgttctgccaatgcccagcagaaagggtcagaagagcagcgttatgctattgcaccggcgttcacctggcgtccggatgataaaaccaatttcaccttcctttcttacttccagaacgagccggaaactggttattacggctggttgccgaaagagggaaccgttgagccgctgccgaacggtaagcgtctgccgacagactttaacgaaggggcgaagaacaacacctattctcgtaacgagaagatggtcggctacagcttcgatcacgaatttaacgatacctttactgtgcgtcagaacctgcgctttgctgaaaacaaaacctcgcaaaacagcgtttatggttacggcgtctgctccgatccggcgaatgcttacagcaaacagtgtgcggcattagcgccagcggataaaggccattatctggcacgtaaatacgtcgttgatgatgagaagctgcaaaacttctccgttgatacccagttgcagagcaagtttgccactggcgatatcgaccacactctgctgaccggtgtcgactttatgcgtatgcgtaatgacatcaacgcctggtttggttacgacgactctgtgccactgctcgatctgtacaatccggtgaataccgattttgacttcaatgcgaaagacccggataactccgggccgtaccgcattctgaataagcagaagcaaacgggcgtttatgttcaggatcaggcgcagtgggataaagtgctggtcaccctgggcggtcgttacgactgggcagatcaagaatctcttaaccgcgtagcgggaacgaccgataaacgtgatgacaaacagtttacctggcgtggtggtgttaactacctgtttgataatggtgtaacaccatacttcagctatagcgaatcgtttgaaccttcttcgcaagttgggaaggatggtaatattttcgcaccgtctaaaggtaagcagtatgaagtcggcgtgaaatatgtaccggaagatcgtccgattgtagttactggtgccgtgtataatcttactaaaaccaacaacctgatggcggaccctgagggttccttcttctcggttgaaggtggcgagatccgcgctcgtggcgtagaaatcgaagcgaaagcggcgctgtcggcgagtgttaacgtagtcggttcttatacttacaccgatgcggaatacactaccgatactacctacaaaggcaatacgcctgcacaggtgccaaaacacatggcttcgctgtgggctgactataccttctttgacggtccgctttcaggtctgacgctgggcaccggtggtcgttatactggctccagctatggtgatccggctaactcctttaaagtgggaagttatacggtcgtggatgcgttagtgcgttatgatctggcgcgagtcggcatggcgggctccaacgtggcgctgcatgtcaacaacctgtttgatcgtgaatacgtcgccagctgctttaacacttatggttgcttctggggcgcagaacgtcaggtcgttgcaaccgcaaccttccgtttctaatttctcttttggggcacggatttccgtgcccgtttcacaagttggctgttatgcaggaatacacgaatcattccgataccacttttgcactgcgtaatatctcctttcgtgtgcccgggcgcacgcttttgcatccgttgtcgttaacctttcctgccgggaaagtgactggtctgattggtcacaacggttctggtaaatccactctgctcaaaatgcttggtcgtcaccagccaccgtcggaaggggagattcttcttgatgcccaaccgctggaaagctggagcagcaaagcgtttgcccgcaaagtggcttatttaccgcagcagcttcctccggcagaagggatgaccgtgcgtgaactggtggcgattggtcgttacccgtggcatggcgcactagggcgctttggtgctgcagatcgcgaaaaggtcgaggaagctatctcgctggttggcttaaaaccgctggcgcatcggctggtcgatagcctctctggcggcgaacgtcaacgggcgtggatcgccatgctggtggcgcaggatagccgctgtctgttgctcgacgaaccgacctcggcgctggatatcgcccaccaggttgatgtactggcgctggtgcatcgtttaagtcaggagcgaggcctgacggtcattgccgtgctgcacgatataaatatggcggcgcgctactgtgattatctggtcgccctgcgcggcggtgaaatgattgctcagggaacgcctgcggaaattatgcgcggcgaaaccctcgaaatgatttatggcatcccgatgggtattctgccgcatccggcgggtgctgcacctgtgagttttgtttattgatgagcggcttacctcttatttcgcgccgccgactgttaacggcgatggcgctttctccgttgttatggcagatgaataccgcccacgcggcagttattgatcccaatcgtattgtggcactggagtggttgccggtggagttactgctggcgctcggcatcgtgccttacggcgtggcggacaccatcaactatcgcctgtgggtcagcgaaccgccattgccggactcagtgattgacgttggtttgcgtacagaacccaaccttgaactgctgaccgaaatgaaaccgtcgtttatggtctggtctgcaggatatggcccttcaccagaaatgctggcacgtattgcgccggggcgcggatttaacttcagcgacggcaaacagccactggcgatggcgcgtaaatcactgacggaaatggcagatttacttaacctgcaaagcgcagcggaaacgcatttagcgcactatgaagactttatccgcagcatgaaaccccgctttgtgaagcgtggtgcacgcccgttattgctgacgacgcttatcgatccgcgccatatgttggtcttcggtccaaacagcttgttccaggaaattctcgatgagtacggcatcccaaatgcctggcaaggggaaaccaacttctggggcagtaccgccgtcagtatcgatcgtctggcagcgtataaagacgttgatgtgctctgttttgatcacgacaacagcaaagacatggatgcgctaatggcaaccccgctgtggcaggccatgccgtttgtccgcgccggacgctttcagcgcgtacctgcagtctggttctatggtgcgacgctttctgcaatgcactttgtgcgtattctggataacgccatcggaggtaaagcgtgagtaaacgaattgcgctttttccggtgttattgctggcgctgctggtggttgctgctgcggcgttgacctggatgaacttctcgcaggcgctgccgcgcagccagtgggcgcaggccgcctggtcgccggatattgacgtcatcgagcagatgatttttcactacagcttgttgccgcgtctggcgatttcgctgctggtgggcgcgggcctggggctggtgggcgtgctgtttcagcaagtgctgcgtaacccgctggcggaaccgacgacattgggtgttgcaacaggcgcgcaactggggattaccgtcaccacgctctgggcaatccccggcgcgatggcgagccagtttgctgcgctggcaggggcttgtgttgttggcttaatcgtctttggcgtcgcgtgggggaaacggctttcgccggtaacgctgatcctcgcggggctggtagtgagcctttattgcggcgcaatcaatcagttactggttatcttccatcatgaccaactgcaaagcatgttcctgtggagcaccggaacgctgacgcaaaccgactggggcggcgttgagcgtttatggccgcagctgctgggcggcgtgatgctgacgttattgctacttcgcccgttaactctgatggggcttgatgatggcgtggcgcgcaatctcgggctggccttgtcgctcgctcgtctggcggcgttgtcgctggcgattgtcatcagtgcgctgctggtgaacgcggtggggattatcggctttatcggtttgttcgcgccactgctggcgaaaatgctgggggcgcggcgtttgttgccacggttgatgctggcatcgctgattggtgcgttaattctgtggctttctgatcaaatcatcctctggctgactcgcgtgtggatggaagtgtccaccggttcggtcactgcgttgatcggtgcgccgctgctactgtggttgctgccgcgtttacgcagcattagcgcgccggatatgaaggtgaacgatcgtgtcgcgactgaacgccaacacgtgctggcgtttgccctcgcgggcggcgtgctgctgttgatggctgtggtggtggcgctgtcgtttggtcgtgatgcgcacggctggacgtgggcgagcggggcgttgctcgaggatttgatgccctggcgctggccgcgaattatggctgcgctgtttgcgggcgtcatgctggcggtggcgggctgtattattcagcggctgaccggaaacccgatggcaagcccggaagtgctggggattagctccggcgcggcgtttggcgtggtgttaatgctgtttctggtgccgggtaatgcctttggctggctgttacccgcaggcagtctcggggcggcggtgacgctgttgatcattatgatcgccgccggacgtggtggattttccccacaccgcatgttactggcggggatggcgttaagtaccgcgttcaccatgcttttgatgatgttgcaggcaagtggtgacccgcgaatggcgcaagttctgacctggatttccggttcgacctacaacgcgaccgatgcgcaggtctggcgtaccggaattgtgatggtgattttgctggcgattaccccgctgtgccgccgctggctgaccattttaccgctgggtggtgataccgcacgagccgtggggatggcgctgacgccgacgcgaattgcgctgctgctgttagcggcttgcctgacggcgaccgcgacaatgaccattggaccgttgagttttgttggtttaatggcaccgcatattgcgcggatgatgggctttcgacggacgatgccacacatcgtaatttcggcgctggtgggtggtttactgctggtgttcgctgactggtgtgggcggatggtgctgtttccattccagatccccgcggggctgctgtcgacctttatcggcgcgccatattttatctatttgttgagaaagcagagccgttaattgaatgcctcgcccggtgggcgaggcaaaatcatcacaacttcgcaaacacccgacgtgcagcatcgatggtgttattgatatcttccatgctgtgcgccacagacataaaacccgcttcaaacgctgacggtgccagataaacaccttcgtccagcatcatatggaagaaacgcttaaaacgttccacgtcacaggccatcacatcctgatagcacgtcacggactcggcgtcggtaaagaaaataccgaacatgccgccaacgtggtttaccaccagcggaattccggcttcttctgccgcttcccgcagaccttctgccagacgtgttgtcagctcatccagcgtctcgtgaacgcccggctgtgcgacttcattcagacaggcgaaaccagcagccatcgcaatcgggttaccggaaagcgtacccgcctgatagaccggaccggtcggggccagcgcatccattacatcacgacgaccaccgaatgcgcctaccggcattccaccgccgatgattttgccgaggcaggtgagatccggttccacaccgtaataatcctgtgcgccagctagcgctacgcggaaaccggtcatcacttcatcgatgatcagcaacgcgccaaattcgtcgcacagcgcgcgcagacctggcaggaactctggcagcggtggaacgcagttcatattgcctgccaccggctcgacgataatacaggcaatctcttgcgggtattgctcaaacgcggcgcgtacagaggccagatcgttataagtacaggttaaggtatgtttggcgaaatctgccggaacgcccggcgaatttggctggcctaacgtgagtgcgccagaaccggctttcaccagcaggcagtcagcgtgaccgtggtaacaaccttcaaatttaataattttgtcgcgaccggtaaaaccacgggccaggcggatggcgctcatcgtcgcttcagtgccggagttcaccatgcgcaccatatccatggtcgggaccagttcggtcaccagttgcgccattttcacttccatttcggttggtgcaccaaagcttaaaccacgctcggcggcttcaatcacggcattgcggatcgccggatggttatggcccagcaccatcggcccccaggaaccgacataatcgatataggctttgccatcaacatcgtacagataagcgccgtccgctttttcgataaacagtggagtgccgcccacgccagtaaaggcgcgaacaggggagttcacaccgccagggatcagctcgcgcgctgcgctgtaaagattttcagacttactcatggagggttcctgattcgtagaaaaagtgaatggctgctattctatgttattcataacaagttaaatactcgtcaaacatcaggctgcttgtactggtgcaatcctgatttcttagagtataaaagttttgtgcatttgaaacattacgctttgcaaaggattttcatggaacgtgcgagtaaaatgccgtcatcttatttgtatgaccaataagtgatcattggatgaaaactgatactccctctttagaaacaccgcaggccgcgcgcctgcgacgcagacaactgattcgccaacttcttgagcgcgataaaaccccgttagccattttgtttatggcggcagtcgtcggcacgcttgtcgggctggctgcggttgcttttgacaaaggtgtcgcctggttgcagaaccaacgtatgggggcactggtacatactgctgataattatccgcttctgttaaccgtcgcttttctctgttcggcggtgctggcgatgttcggctactttttggtgcgcaaatacgcgccggaagcaggtggttcggggatcccggaaattgaaggggcgctggaagatcaacgtcccgttcgctggtggcgtgtgttgccggtgaaattctttggcgggctgggaacactcggcggaggcatggtgttggggcgcgaagggccaaccgtgcagataggcggcaatatcgggcggatggtactcgatgttttccgcctgaaaggtgacgaagctcgtcatacgctgttggcaaccggtgctgctgcggggctggctgcggcctttaacgcgccgctggcgggtattttgtttattatcgaagagatgcgtccgcagtttcgctatacgttaatttcgattaaagcggtatttattggcgtcattatgtcgaccattatgtaccggatttttaatcatgaagttgcgttgattgacgtcggtaaactttctgatgcgccgcttaatacgctgtggctttatctgatcctcggtattatttttggcattttcggccctatttttaataaatgggtgctggggatgcaggatttgctgcaccgtgtgcacggtggcaatattaccaaatgggtactgatgggcggtgcgattggcggtctgtgtggattgctggggtttgtggcaccagcaacttcgggcggcggttttaacctgattcctatcgctaccgcggggaatttcagcatgggaatgctggtgtttatcttcgtcgcgcgggtcattaccactttactctgcttctcttccggcgcgccgggcggtatttttgccccgatgctggcgctgggtactgtgctgggaaccgctttcggaatggttgccgttgagttgtttccgcaatatcaccttgaggcggggacgtttgctattgccggaatgggggcgttactggcggcatctattcgcgcgccgttaacggggatcattctggttctggaaatgaccgataactaccagctcattttgccaatgattattaccggtcttggcgcaacactattagcacaatttaccggtgggaaaccgctatactcggcgattcttgcgcgcacgctggcaaaacaggaagctgagcaactggcgcgaagcaaggccgcatcagcccgcgagaatacttgaacgaaataccagggtattagataatggcgattattattgggttagaatttgcccaattgccgatgtcgtttggagcaaaatatgagtgatgacgtagcactgccgctggagtttaccgacgcagcagccaacaaagttaaaagcctgatcgctgacgaagataacccgaatctgaaattacgcgtgtatatcaccggtggcggttgcagcggcttccagtatggtttcacctttgatgatcaggtgaacgaaggcgatatgaccatcgaaaaacagggcgttggcctggtggttgatccgatgagcctgcaatatctggtcggcggttccgttgactataccgaaggtctggaaggttctcgtttcatcgtgaccaacccgaacgcgaaaagtacctgcggttgcggttcttcctttagtatctaatctgctgttcatgtgccggataaactatccggcacatctcctctcttcaacgaccattctcatccagcgcaaacgtcggtagcttaagatgccaacgaatagccgccagccgaatcaatagcgtcacgaccatgcccatcatactggctgtttccagtggtacggaaaatgtgtaataagccgtagcgtggacaataccgccgataatacaggcagttgcgtagatttctgtacgtaaaatcatggggatttcgcgggccagtacatcacgaatgatcccgccgccaacgccagtaatgacgcccatacaaaccgcgattaacggaccggcttccgcattaaaggctttattcacgccaatgccgacaaacaccgccagaccaacggcgtccagcaccggcaacatccattttggtaagcgtcttggctggcgcaccagcacgatggtcagcatgctggtgaccattgcaacgaccagatcggtgggatctttcacccaaaataccgggccgtgatccagcgccatgtcgcgaattgttccgccgcctactgcggtaaccacgcccaataccagaacaccaaaagggtccatacgcaattttccggctaacaaaacgccagagatagcaaataccgctgtgccgactatatccagccaatagacgagcattgttcaatccccactgagcacctgaaaaggtcaggcactaatctacctgtgaaagcgcattacagagctgttgtgcagcgaggataatacgtgggcttgcacgttcaaaccagtcactcgtgagaggaataacgggaattttgagctgttcaccccagtattgtttgattttaggaatttggtccggtccgcctgtaatgacaatcgcctgtggcgagcgtgctaacacctgttcgcggctaacttgcggccagggaacccggctgtctttaaagatgttttctccgccacaaacttcgagtacctggttctgaatcgactcttttccactggtaaatggcggattaatgccgaattgcagaaaaacacgttttttaggtttatcagcatattgcgctttcaattgcgcgtactgatccagcagggattgcgcggcttgttcggccttatccggttgcggactccagggggccagttgacgtaacgcattggcaatttgttcaatgcttgtcgcatcgacccacatcacttttattcccagcgaagccagctggtcaacctgccgctcggcattacctccacgccaggcaatcaccagatcgggtttcagcgcgacaatgcgttccagattcatcccctgccaggtggaaacctgcccaatcttttgcgcttgtggaggatagtcggaatagctgctgaccccaaccggcgtgatcccggcggcaaaggcaagttcagtgttggcgggagaaagcgtgatgacgcgcggcgcggcattgagccacagcggcgcgagaaaagacagggcgaccagcgccctgaacagtgacttagccatgtgccagtttctgcaccagtgactcaaccatcaggctggactgtttagcggcaacagccaggaactcatcgaagctaagatgagactgttgatcggccacgtcggagatggcgcgtactacgacaaacgggacgttgaaattgtggcagacatgggcgattgccgtcgcttccatctctacagcaatggcctgtgggaagttgtggcggattttcgccagaccaacagaaccgttgatgaaagcgtcgccgctaacaatcaggccacgtacagcgttaagattcagttcggcaatgcaggcctcagcggcagcgatcagtttatcgtcagctttgaagcctgccgggcagcctggtaactgaccgtattcataaccaaatgccgtgacatccgcgtcgtgataacgcgcttcgtccgagacaacgatatcgcccactttcagcgttggtgccaggccaccggcagaaccggtgttaataatcacatctggcttgcagtgttccaacagcaaagtggcacccagcgccgcagcgactttaccgatgcccgatttcagaagcgcaacctcggttccattcagttggccggtatagatttcgcaaccgcccagactgatagtttgacggttttcgattttgtcacgcagcagcgtaacttcttcttccattgcaccaatgatgccgattttcatagatttactcgcgataagcccgatttgaaggcatagtttaccatgcgcttacggggaagcgtatttctcacgcgggagaggacatggcacagattgatttccgaaaaaaaataaactggcatcgtcgttaccgttcaccgcagggcgttaaaaccgaacatgagattctgcggatcttcgagagcgatcgcgggcgtatcatcaactctccggcaattcgtcgtctgcaacaaaagacccaggtttttccactggagcgcaatgccgccgtgcgcacgcgtcttacccactcgatggaagtccagcaggtggggcgctacatcgctaaagaaattttaagccgtttgaaagagcttaaattactggaggcgtatggtctcgatgaactgaccgggccctttgaaagcattgttgagatgtcatgcctgatgcacgatatcggcaatccgccgtttggtcattttggcgaagcggcgataaatgactggtttcgccagcgtttgtacccggaagatgccgaaagccagcctctgactgacgatcgctgcagcgtggcggcactacgtttacgggacggggaagaaccgcttaacgcgctgcggcgcaagattcgtcaggacttatgtcattttgaaggtaacgcacagggtattcgtttggtgcatacattgatgcggatgaatctcacctgggcacaggttggcggtattttaaaatatacccgtccggcgtggtggcgtggcgaaacgcctgagacacatcactatttaatgaaaaagccgggctattatctttccgaagaagcctatattgcccggttgcgtaaagaacttaatttggcgctttacagtcgttttccgttaacgtggattatggaagctgccgacgacatctcctattgtgtggcagaccttgaagatgcggtagagaaaaggatatttaccgttgagcagctttatcatcatttgcacgaggcgtggggccagcatgagaaaggttcgctcttttcgctggtggttgaaaatgcctgggaaaaatcacgctcaaatagtttaagccgcagtacggaagatcagttttttatgtatttacgggtaaacaccctaaataaactggtaccctatgcggcacaacgatttattgataatctgcctgcgattttcgccggaacgtttaatcatgcattattggaagatgccagcgaatgcagcgatcttcttaagctatataaaaatgtcgctgtaaaacatgtgtttagccatccagatgtcgagcagcttgaattgcagggctatcgggtcattagcggattattagagatttatcgtcctttattaaacctgccgttatcagactttactgaactggtagaaaaagaacgggtgaaacgtttccctattgaaacgcgcttattccacaaactctcgacgcgccatcggctggcctatgtcgaggctgtcagtaaattaccgtcagattctcctgagtttccgctatgggaatattattaccgttgccgcctgctgcaggattatatcagcggtatgaccgacctctatgcgtgggatgaataccgacgtctgatggccgtagaacaataaccaggcttttgtaaagacgaacaataaatttttaccttttgcagaaactttagttcggaacttcgcgctataaaacgaatctgaagaacacagcaattttgcgttatctgttaatcgagactgaaatacatgaaaaaaaccacattagcactgagtgcactggctctgagtttaggtttggcgttatctccgctctctgcaacggcggctgagacttcttcagcaacgacagcccagcagatgccaagccttgcaccgatgctcgaaaaggtgatgccttcagtggtcagcattaacgtagaaggtagcacaaccgttaatacgccgcgtatgccgcgtaatttccagcagttcttcggtgatgattctccgttctgccaggagggttctccgttccagagctctccgttctgccaggggggcctgggcggtaatggcggcggccagcaacagaaattcatggcgctgggttccggcgttatcattgatgccgataaaggctatgtcgtcaccaacaaccacgttgttgataacgcgacggtgattaaagtccaactgagcgatggtcgtaagttcgacgcgaagatggttggcaaagatccgcgctctgatatcgcgctgatccagatccagaacccgaaaaacctgaccgcaattaagatggcggattctgatgcgctgcgcgtgggtgattacaccgtagcaattggtaacccgttcggcctgggcgagacagtaacttccgggattgtctctgcgctgggacgtagcggcctgaacgctgaaaactacgaaaacttcatccagactgatgcagcgatcaaccggggtaactcaggtggtgcgttggttaacctgaacggcgaactgattggtatcaacaccgcgattctcgcaccggacggcggaaacatcggtatcggttttgctatcccgagcaacatggtgaaaaacctgacctcgcagatggtggaatacggccaggtgaaacgtggtgagttgggtattatgggcactgagctgaactccgatctggcgaaagcgatgaaagttgacgcccagcgcggtgctttcgtaagccaggttctgccgaattcttccgccgcgaaagcgggcattaaagcgggtgatgtgatcacctcactgaacggtaagccaatcagcagctttgccgcactgcgtgctcaggtgggcactatgccggtaggtagcaaactgaccctaggcttactgcgcgacgggaagcaggttaacgtgaacctggaacttcagcagagcagccagaatcaggttgattccagcaccatcttcaacggcattgaaggcgctgagatgagtaacaaaggcaaagatcagggcgtggtggtgaacaacgtgaaaacgggcactccggctgcgcagatcggcctgaagaaaggtgatgtgattattggcgcgaaccagcaggcagtgaaaaacatcgctgaactgcgtaaagttctcgacagcaaaccgtctgtgctggcactgaacattcagcgcggcgacagcaccatctacctgttaatgcagtaatctccctcaaccccttcctgaaaacgggaaggggttctccttacaatctgtgaacttcaccacaactccatacatcttcatcatcctttgggcatttgcacaatgccgtacgttacgtacttccttatgctaagccgtgcataatggaggacttatggctggcatcttgataccaaaatggcgcaggatatcgtggcacgtaccatgcgcatcatcgataccaatatcaacgtaatggatgcccgcgggcgaattatcggcagcggcgatcgtgagcgtattggtgaattgcacgaaggagcattgctggtactttcacaaggacgagtcgtcgatatcgatgacgcggtggcacgtcatctgcacggtgtgcggcaggggattaatctaccgttacggctggaaggtgaaattgtcggcgtaattggcctgacaggtgaaccagagaatctgcgtaaatatggcgaactggtctgcatgacggctgaaatgatgctggaacagtcgcggttgatgcacctgttggcgcaggatagccgtttgcgggaagaactggtgatgaacctcattcaggctgaggagaatactcccgcacttactgaatgggcgcaacggctggggatcgatctcaatcaaccgcgagtggtggctattgttgaggtcgacagcggtcagcttggcgtggacagcgcaatggcggagttacagcaactgcaaaatgcgctgactacgcccgagcgtaataatctggtggcgattgtctcgctaaccgaaatggtggtgttgaaaccggcgttgaactcttttgggcgctgggacgcagaagatcatcgtaagcgagttgaacaactgattacccgcatgaaagagtatggccagctgcgttttcgcgtttcgctgggcaactattttaccggtcctggcagtattgcccgatcctatcgtacggcgaaaacgacgatggtggtgggtaaacagcggatgccagaaagtcgctgctatttttatcaggatctgatgttacctgtgttactcgacagtttgcgtggcgactggcaggccaacgaactggcgcgaccgctggcgcggctgaaagcgatggacaataacggcttgctgcggcgaactctggcggcgtggtttcgccacaatgtgcaaccgctggcaacgtcaaaggcgttgtttattcatcgtaatactctggaatatcggcttaatcgtatatcggaactgaccgggcttgatttgggcaattttgatgacaggttgctgctgtatgtggcgttacaactggatgaagagcggtaggtcgattacaaaattacagccgggtgagactttacccggcccacagaatggcattatttacgcgtcagtttttccagatcggcttcaatctcgctgatcttattggttactactgactccaggtgacgtaagtcgtcgaggatcttacgcttaagatcaacttcgctgcggtcacgctggcagatttgatcaagctcatcaatgatataccgtagattcgggctaatttcctggacttctttataaccctgacccacaccatcagcgacgaccgttttacgctgacgcgggtatttaaacttcacgctcttggcgaaaaactcgcctttgtctttctggaaatagattttcagaatatcgttgttggcttcctgccggaggctgtaacgatcaatttcttcaggattggtaatacccagacttttcagattgtcgtacatagtgttacctcaaaatgagtcagtaaattgtgcttattttagcatttggcctggcccgcccggctcgactgtgatcgcagaaagcctttttcttccagacttctatcatggcgtaaaaatcaaaaaattacctgctttattgtggtgatattccatgggatggattagcacatttatcttcattttgcgaattacatgacagtccgaaacaagatgaaaaagtatttaaaaaaaagggggaaaatgagtaggacgaattattctgagccagaaagcaatcgggcagcgtcgtgctgcccgtgtacatacttttagtcgatggtacgcagcagttcgttaataccaactttaccgcgagttttcgcgtcaactttcttaacgataactgcacagtagaggctgtatttgccatctttcgacggcagattacctgaaacaaccacagaccccgccggaacgcgaccgtagtggatttcgccggtttcacggtcataaatacgggtgctctgaccaatgtatacgcccatagagatgacggaaccttcttcgacaatcaccccttcaaccacttcagagcgtgcgccgatgaagcagttatcttcaataatggtcgggttagcctgcagcggctccagcacgccgccgatacccacgccaccggaaaggtggacgtttttaccaatctgcgcacaggaaccgacggtcgcccaggtatcaaccatggtgccttcatcaacatatgcgccgatgttgacgtaagacggcatcagcacggtgttacgggcaatgaacgcgccctgacgcactgccgctggtggcacgacgcggaagccttctttctggaaacgtgcttcatcgtagttagcgaatttcatcggcactttgtcgaagtagcggctttctgccccttcgatcacctgattatcattaatacggaaagagagcagcaccgcttttttcaaccactgatgcgtcacccactgaccgtcaattttttccgctacacgcagtgcgccggaatccagcagggcgatcacctgatttaccgcttcgcgggtaacggtgtctgcattggctggcgtgatctcggcacggcgttcaaaagcggtttcaataatgttctgtaactgctgcattgttaaactcttttcatatcagtaaacacatcaccctttatcgtttggattgagggcctctgtcaaccgctgatgcacttcctgctgcaactcgttattaagcgcacgccggtcagcggtggcaattatgaataaatcttctactcgctcgccaatggttgtaattcgggcgccatgaagcgaaattcccagatcggcaaaaattttcccgactcgcgccagcagtccaggttggtcgagggcgatcagttcgaggaacgatttgcggtcggtatgggtcggcaaaaacgtcacttcggtttcaacagtaaaatggcgcaatttggcgggttggcgacggggctgcggtggctgccagctactttgtgtcagtacttgctccagaccaaaccgaataacctcatgacgatctgcggatagcgggctaccatcgggttccagcactataaaggtatccatcgccataccgtcgcgagtggtgaaaatttgtgcgtcgtgaacacttaaattgcggcggtctaattcggcacagacggcggcaaacagataggggcggtccgggctccagataaaaatctcggtgcctccacgcgtagcctgcgggctaagcagtaccagcggtttgcttaaatcatgctgtaataaatggcgtgcgtgccaggccagttgatttgggctatggcggacaaaatagttagcgcgacagcgtgaccaaatttggtgcagcgcctcttcgtcgatgttatccatgcgcagtagtgccagcgcctggagttggtgatggcgaacccgttcgcgcatatccggcgtgttttgcattccgcgtcgtagctgcttttcggtggcaaaatagagttcgcgcaacagactttgcttccagctattccacagtgtttcgttggtggcgcaaatgtcagccactgtcaggcataccagatagcgcagacgattttccgtttgaacttcttcggcaaattgcttgatgacttccgggtcctgaatatcgcggcgctgagcggtcaccgacatcagcaagtgctggcgaaccagccatgcgaccagctgtgtttcgcgtgagttcagcccgtggagttcggcaaaatgcactacatcctgagcaccgagaatggagtggtcgccgccgcgtcctttggcgatatcgtgaaacagcgcggcgatgaaaatcagctcagttgacggcaggcgcggccagacgtccacacacaacggatggcgctggcgcgtttcttcactggcaaaactctccagtttcagcatcacgcggatagtatgttcatccaccgtgtaggcatggaacaggtcaaactgcatctgcccgacgatatgcgaccattgcggcatatacgcgccgagcacgctatggcgatgcattggcaatagcccgcgccgcaccgctccggggtgacgcagaatgctcaaaaacagttttcgcgcttccggaatattacacagaggttgttgcagatggcgacgggcgtggcgtaactggcgtagcgtggtggagtaaatgccggtgatcgcactgttgcgcaccatggtgtagaacatacgcaagatggcttccggctggcgcataaatagtgtttcatcacgcaggtcgatcagcgttccgcgtagctgaaactcatcgtcgattggacgtggtttttcgtcggcgggaagggcgaggatggcttcatcgaacagttgcagcagcatctggttgagttcactgacgcggcgtgtaacgcggaagtaatccttcatcatccgctcgaccggttcgttaccttcaccactgtaattcaaacgctgggcgacgctaagctggcgatcgaataacaggcgattatcgtaacgactgacgaccagatgcagggcaaagcgaatgcgccacaatatatgcaggcattcgtttaattccgctctctccgcagaggttaagaagccaaaccctaccatttcatccagcgatgttgctccaaaatgacggcgggccacccattgcagagtgtggatatcgcgcaagccgccggggctacttttgatgtctggttcaaggttgtagctggtgccgtggtaacgctgatggcgctggttctgttcttcaactttcgccgcgtagaacttgtcggaaggccagaatccttcgctaaaaatatgtttttgcagttcgaggaacagcgcaacatcgccaattaataagcgggattcgattaaattggtggcgacggttaaatccgataacccttccagcatgcactcttcaagcgtgcgcacgctatgacctacttccagctttacatcccagagcagtgttaacagctcgcccactttttgcgcctgatcgtccgggagctttttacggcttaaaatcagtaaatcgatgtcagaaagtggatgcagctcgccacgaccgtagccaccgacggcgaccaatgccaggtcggcaatctggctgaatcccgcttcaatccataatcgttgaagaagctggtcgataaactcggtacgcgcctcaatcaactgttctgcggagataccattgtcaaaggcatcacccagccaacgctggaaagtatcgatatgggcttttatcccaccgacggttaattcatcacggggccaggcgcatggattttgcggttgaccggacagggtggggagagcggtgtttgcgtactgttctggaagggtattcattgtgcgccacccataagattaaattattgcattaaaaaagccggcattcgccggcttcattttattcgtcgtgcgagattatcgccgggatggtgtcatccttgcgtagcgtcagaatttcgcagccgttatcagtcaccacaatagtatgctcatattgtgcagacaagctgcgatctttggtttttaccgtccagccatctttcatggtgcggatctcttttttacccgcgttgaccattggctcgatggtgaacgtcatccccggtttcagcacgacgttggtttcacgggagtcatagtgcagcacctgcggttcttcgtggaagccgcgaccaataccgtgtccacaatattcacgaacgacggagaagccttctgcttcgacaaatttctgaattgccgcaccgatttcgcgcagattaatgccaggttttaccatgcgtagcgccaggtacaggctttcttgcgtgatgcggcacagacgttcgcccatgatggtcggcttaccgacgataaacattttcgaggtatcgccgtggaaaccatctttgattacggtgacatcaatgttaacgatatcgccatctttcagcagcttggcgtcgtccgggataccgtggcacaccacttcattaatagagatgcaaacggatttcggatagccgtgatagccgaggcaggcagaaaccgcgtgttgttcattaacaatgtaatcattacagatgcgatccagctcgccggtgctgacgcccggtttaacatacggttcgatcatctccagcacttcggcagccagtcggccagcgacgcgcattttttcgatatcttctggggtcttgattgagatagccattaattctgtccatcagcgtcggtgataccgacaatatatatgtaagtgccgtcaatggtatcacacccgggcaaattgagaatcattctgaatttcgccaaacgtgccactgaaggttttctataatagaaaattcaacgtctgatgctgtacacagcgccaacaattattggtgtccacgacgtatttgtggtataaagcgcgccggacttccgatccatttcgtatacacagactggacggaagcgacaatctcactttgtgtaacaacacacacgtatcggcacatattccggggtgccctttggggtcggtaatatgggatacgtggaggcataaccccaacttttatatagaggttttaatcatggcaactgtttccatgcgcgacatgctcaaggctggtgttcacttcggtcaccagacccgttactggaacccgaaaatgaagccgttcatcttcggtgcgcgtaacaaagttcacatcatcaaccttgagaaaactgtaccgatgttcaacgaagctctggctgaactgaacaagattgcttctcgcaaaggtaaaatccttttcgttggtactaaacgtgctgcaagcgaagcggtgaaagacgctgctctgagctgcgaccagttcttcgtgaaccatcgctggctgggcggtatgctgactaactggaaaaccgttcgtcagtccatcaaacgtctgaaagacctggaaactcagtctcaggacggtactttcgacaagctgaccaagaaagaagcgctgatgcgcactcgtgagctggagaaactggaaaacagcctgggcggtatcaaagacatgggcggtctgccggacgctctgtttgtaatcgatgctgaccacgaacacattgctatcaaagaggcaaacaacctgggtattccggtatttgctatcgttgataccaactctgatccggacggtgttgacttcgttatcccgggtaacgacgacgcaatccgtgctgtgaccctgtacctgggcgctgttgctgcaaccgtacgtgaaggccgttctcaggatctggcttcccaggcggaagaaagcttcgtagaagctgagtaataaggcacgctcgtacgagcccttatagaccaggtagtacacgtttggttagggggcctgcatatggccccctttttcacttttatatctgtgcggtttaatgccgggcagatcacatctccgaggattttagaatggctgaaattaccgcatccctggtaaaagagctgcgtgagcgtactggcgcaggcatgatggattgcaaaaaagcactgactgaagctaacggcgacatcgagctggcaatcgaaaacatgcgtaagtccggtgctattaaagcagcgaaaaaagcaggcaacgttgctgctgacggcgtgatcaaaaccaaaatcgacggcaactacggcatcattctggaagttaactgccagactgacttcgttgcaaaagacgctggtttccaggcgttcgcagacaaagttctggacgcagctgttgctggcaaaatcactgacgttgaagtactgaaagcacagttcgaagaagaacgtgttgcgctggtagcgaaaattggtgaaaacatcaacattcgccgcgttgctgcgctggaaggcgacgttctgggttcttatcagcacggtgcgcgtatcggtgttctggttgctgctaaaggcgctgacgaagagctggttaaacacatcgctatgcacgttgctgcaagcaagccagaattcatcaaaccagaagacgtatccgctgaagtggtagaaaaagaataccaggtacagctggatatcgcgatgcagtctggtaagccgaaagaaatcgcagagaaaatggttgaaggccgcatgaagaaattcaccggcgaagtttctctgaccggtcagccgttcgttatggaaccaagcaaaactgttggtcagctgctgaaagagcataacgctgaagtgactggcttcatccgcttcgaagtgggtgaaggcatcgagaaagttgagactgactttgcagcagaagttgctgcgatgtccaagcagtcttaattatcgaaaaggagccgcctgagggcggcttctttttgtgcccatcttgtaaattcagctaacccttgtggggctgcgctgaaaagcgacgtacaatgtcgctagtattaattcatttcaatcgttgacagtctcaggaaagaaacatggctaccaatgcaaaacccgtctataaacgcattctgcttaagttgagtggcgaagctctgcagggcactgaaggcttcggtattgatgcaagcatactggatcgcatggctcaggaaatcaaagaactggttgaactgggtattcaggttggtgtggtgattggtgggggtaacctgttccgtggcgctggtctggcgaaagcgggtatgaaccgcgttgtgggcgaccacatggggatgctggcgaccgtaatgaacggcctggcaatgcgtgatgcactgcaccgcgcctatgtgaacgctcgtctgatgtccgctattccattgaatggcgtgtgcgacagctacagctgggcagaagctatcagcctgttgcgcaacaaccgtgtggtgatcctctccgccggtacaggtaacccgttctttaccaccgactcagcagcttgcctgcgtggtatcgaaattgaagccgatgtggtgctgaaagcaaccaaagttgacggcgtgtttactgctgatccggcgaaagatccaaccgcaaccatgtacgagcaactgacttacagcgaagtgctggaaaaagagctgaaagtcatggacctggcggccttcacgcttgctcgtgaccataaattaccgattcgtgttttcaacatgaacaaaccgggtgcgctgcgccgtgtggtaatgggtgaaaaagaagggactttaatcacggaataattcccgtgatggataaataagggtaagattccgcgtaagtatcgcgggggatcttacccgtaatatgtttaatcagggctatacttagcacacttccactgtgtgtgactgtctggtctgactgagacaagttttcaaggattcgtaacgtgattagcgatatcagaaaagatgctgaagtacgcatggataaatgcgtagaagcgttcaaaacccaaatcagcaaaatacgcacgggtcgtgcttctcccagcctgctggatggcattgtcgtggaatattacggcacgccgacgccgctgcgtcagctggcaagcgtaacggtagaagattcccgtactctgaaaatcaacgtgtttgatcgttcaatgtctccggccgttgaaaaagcgattatggcgtccgatcttggcctgaacccgaactctgcgggtagcgacatccgtgttccgctgccgccgctgacggaagaacgtcgtaaagatctgaccaaaatcgttcgtggtgaagcagaacaagcgcgtgttgcagtacgtaatgtgcgtcgtgacgcgaacgacaaagtgaaagcactgttgaaagataaagagattagcgaagacgacgatcgccgttctcaggacgatgtacagaaactgactgatgctgcaatcaagaaaattgaagcggcgctggcagacaaagaagcagaactgatgcagttctgatttcttgaacgacaaaaacgccgctcagtagatccttgcggatcggctggcggcgttttgctttttattctgtctcaactctggatgtttcatgaagcaactcaccattctgggctcgaccggctcgattggttgcagcacgctggacgtggtgcgccataatcccgaacacttccgcgtagttgcgctggtggcaggcaaaaatgtcgctcgcatggtagaacagtgcctggaattctctccccgctatgctgtaatggacgatgaagcgagtgcgaaacttcttaaaacgatgctacagcaacagggtagccgcaccgaagtcttaagtgggcaacaagccgcttgcgatatggcagcgcttgaggatgttgatcaggtgatggcagccattgttggcgctgctgggctgttacctacgcttgctgcgatccgcgcgggtaaaaccattttgctggccaataaagaatcactggttacctgcggacgtctgtttatggacgccgtaaagcagagcaaagcgcaattgttaccggtcgatagcgaacataacgccatttttcagagtttaccgcaacctatccagcataatctgggatacgctgaccttgagcaaaatggcgtggtgtccattttacttaccgggtctggtggccctttccgtgagacgccattgcgcgatttggcaacaatgacgcccgatcaagcctgccgtcatccgaactggtcgatgggacgtaaaatttctgtcgattcggctaccatgatgaacaaaggtctggaatacattgaagcgcgttggctgtttaacgccagcgccagccagatggaagtgctgattcacccgcagtcagtgattcactcaatggtgcgctatcaggacggcagtgttctggcgcagctgggggaaccggatatgcgtacgccaattgcccacaccatggcatggccgaatcgcgtgaactctggcgtgaagccgctcgatttttgcaaactaagtgcgttgacatttgccgcaccggattatgatcgttatccatgcctgaaactggcgatggaggcgttcgaacaaggccaggcagcgacgacagcattgaatgccgcaaacgaaatcaccgtggctgcttttcttgcgcaacaaatccgctttacggatatcgccgcgttgaatttatccgtactggaaaaaatggatatgcgcgaaccacaatgtgtggatgatgtgttatctgttgatgcgaacgcgcgtgaagtcgccagaaaagaggtgatgcgtctcgcaagctgaggataatccggctacagagagtcgcgctatttgttagcgtagggcttcagtgatatagtctgcgccatctgatcgtaagtagttggctttataaggtcaggtatgccgtggttttacacggcttttttttgtataggcttcagtattcctgagtaccgtaaaccctgtcagggaataagaaacgcgtgatgttgtctgctactcaaccacttagcgaaaaattgccagcgcatggctgtcgtcatgttgcgatcattatggacggcaatggtcgctgggcaaaaaagcaagggaagattcgtgcctttgggcataaagccggggcaaaatccgtccgccgggctgtctcttttgcggccaacaacggtattgaggcgttaacgctgtatgcctttagtagtgaaaactggaaccgaccagcgcaggaagtcagtgcgttaatggaactgtttgtgtgggcgctagatagcgaagtaaaaagtctgcaccgacataacgtgcgtctgcgtattattggcgataccagtcgctttaactcgcgtttgcaagaacgtattcgtaaatctgaagcgctaacagccgggaataccggtctgacgctgaatattgcggcgaactacggtggacgttgggatatagtccagggagtcaggcaactggctgaaaaggtgcagcaaggaaacctgcaaccagatcagatagatgaagagatgctaaaccagcatgtctgtatgcatgaactggcccctgtagatttagtaattaggactgggggggagcatcgcattagtaactttttgctttggcaaattgcctatgccgaactttactttacagatgttctctggcccgatttcgatgaacaagactttgaaggggcgttaaatgcctttgctaatcgagagcgtcgtttcggcggcaccgagcccggtgatgaaacagcctgatgggggtcgcttttgctgaagtatcgcctgatatctgcttttgtgttaatacccgtcgtcatcgcggcgttgtttctgttgccgccggtggggttcgccattgtaacgctggtggtctgtatgctggcagcgtgggaatggggacagcttagcggttttaccactcgttcgcagcgagtatggttggcggtgttatgcgggttattgttggcgctgatgctttttctgttgccggaatatcaccgaaatattcatcaaccgctggttgaaatctcactttgggcttcgctgggttggtggattgtcgcgctattgctggtgctgttttacccaggttccgcagcaatctggcgtaactctaaaacattgcgcattatttttggcgtgctaaccattgttcccttcttctggggcatgctggcgttacgggcctggcactacgacgagaatcattacagtggcgcaatatggctgctctatgtcatgatcctggtatggggcgctgactctggcgcatatatgtttggcaaattgtttggtaaacataaactagcaccgaaggtttctccgggtaaaacctggcaaggctttatcggtggactagtgaccgcagcggtaatctcatggggttatggcatgtgggtgaatctcgacgtcgctcccgtcaccttactcatttgctctattgtcgcagcgttagcctcagtgctcggcgatctgaccgaaagtatgtttaagcgtgaagcaggaattaaggacagcggtcatttaattccaggacacggtggtattttagatcgtattgatagcctgacggctgcggtaccggtctttgcttgcttgttgttactggtattcaggacgctttaacggaaggtaatatgctgagttttctctgggatttggcttcgttcatcgttgcactgggtgtacttatcaccgtgcatgaatttggtcatttctgggttgcccggcgttgtggtgttcgcgttgagcgtttctcaatagggtttggtaaggcgctctggcggcgaactgataagctcggcaccgaatatgttatcgccctgatcccgttgggcggttatgtcaaaatgctggatgagcgcgcagaaccggtcgttccggaactccgccaccatgccttcaataataaatctgtcggccaacgagcggcgattattgccgcaggtccggttgcaaacttcatttttgctatctttgcctactggctggtttttattattggtgtgcctggcgtacgtccggtggttggtgaaatagcagccaattcgatagctgcggaagcacaaattgcaccaggtacggaactaaaagccgtagatggtatcgaaacgcctgattgggatgccgtgcgtttgcagttggtcgataaaattggcgatgaaagcaccaccattacggtagcgccatttggcagcgaccaacggcgggatgtaaagctcgatttacgtcactgggcgtttgagcctgataaagaagatccggtatcttcgttggggattcgtcctcgtgggccgcaaattgaacctgtactggaaaatgtgcagccaaactcggcggcaagcaaggcaggtttgcaagcaggcgacaggatcgttaaagtcgatggtcagcccttaacgcagtgggtgacctttgtgatgcttgtccgggataacccgggtaaatccttagcgttagaaatcgaaaggcaggggagtcccttgtctttgacattaatcccggagagtaaaccgggtaagggtaaagcgattggttttgtcggtattgagccgaaagtcattcctttgccagatgagtataaagttgtacgccagtatgggccgttcaacgctatcgtcgaagccacggacaaaacgtggcagttgatgaagctgacggtcagtatgctgggaaaattgatcaccggtgatgtgaaactgaacaacctcagtgggccgatctctatcgccaagggggctgggatgacagcggaactcggggtagtttattacctgccgtttcttgcgcttattagcgtgaacttagggataattaacctgtttccgttgcccgtacttgacggggggcatctgctgttccttgcgatcgaaaagatcaagggcggaccggtatccgagcgggttcaagacttttgttatcgcattggctcgattctgctggtgctgttaatggggcttgcacttttcaatgatttctctcggttatgagagttagttaggaagaacgcataataacgatggcgatgaaaaagttgctcatagcgtcgctgctgtttagcagcgccaccgtatacggtgctgaagggttcgtagtgaaagatattcatttcgaaggccttcagcgtgtcgccgttggtgcggccctcctcagtatgccggtgcgcacaggcgacacggttaatgatgaagatatcagtaataccattcgcgctctgtttgctaccggcaactttgaggatgttcgcgtccttcgtgatggtgatacccttctggttcaggtaaaagaacgtccgaccattgccagcattactttctccggtaacaaatcggtgaaagatgacatgctgaagcaaaacctcgaggcttctggtgtgcgtgtgggcgaatccctcgatcgcaccaccattgccgatatcgagaaaggtctggaagacttctactacagcgtcggtaaatatagcgccagcgttaaagctgtcgtgaccccgctgccgcgcaaccgtgttgacctaaaactggtgttccaggaaggtgtgtcagctgaaatccagcaaattaacattgttggtaaccatgctttcaccaccgatgaactgatctctcatttccaactgcgtgacgaagtgccgtggtggaacgtggtaggcgatcgtaaataccagaaacagaaactggcgggcgaccttgaaaccctgcgcagttactatctggatcgcggttatgcccgtttcaacatcgattctacccaggtcagtctgacgccagataaaaaaggtatttacgtcacggtgaacatcaccgaaggcgatcagtacaagctttctggcgttgaagttagcggcaatcttgccgggcactccgctgaaattgagcaactgactaagatcgagccgggcgagctgtataacggcaccaaagtgaccaaaatggaagatgacattaaaaagcttcttggtcgctatggttatgcctatccgcgcgtacagtcgatgcctgaaattaacgatgccgacaaaaccgttaaattacgcgtgaacgttgatgcgggtaaccgtttctatgtgcgtaagatccgttttgaaggtaacgatacctcgaaagatgccgtcctgcgtcgcgaaatgcgtcagatggaaggtgcatggctggggagcgatctggtcgatcagggtaaggagcgtctgaaccgtctgggcttctttgaaactgtcgataccgatacccaacgtgttccggggagcccggatcaggttgatgtagtttacaaggtgaaagaacgtaacactggtagcttcaacttcgggattggttacggtactgaaagtggcgtgagcttccaggctggcgtgcaacaggataactggttaggtacaggttatgctgttggtatcaacgggaccaaaaacgattaccagacctatgctgaactgtcggtaaccaacccgtacttcaccgtagatggtgtaagcctcggtggtcgtctcttctataatgacttccaggcagatgacgccgacctgtccgactataccaacaagagttatggtacagacgtgacgttgggcttcccgatcaacgaatataactcgctgcgtgcaggtctgggttatgtacataactccctgtccaacatgcagcctcaggttgcgatgtggcgttatctgtactctatgggtgaacatccgagcacctctgatcaggataacagcttcaaaacggacgacttcacgttcaactatggttggacctataacaagcttgaccgtggttacttcccgacagatggttcacgtgtcaacctgaccggtaaagtgaccattccgggatcggataacgaatactacaaagtgacgttagacacggcgacttatgtgccgattgatgacgatcacaaatgggttgttctgggtcgtacccgctggggttatggtgatggtttaggcggcaaagagatgccgttctatgagaacttctatgccggtggttccagcaccgtgcgtggcttccagtccaataccattggtccgaaagcagtttacttcccgcatcaggccagtaattatgatccggactatgattacgaatgtgcgactcaggacggcgcgaaagatctgtgtaaatcggatgatgctgtaggcggtaacgccatggcggttgccagcctcgagttcatcaccccgacgccgtttattagcgataagtatgctaactcggttcgtacttccttcttctgggatatgggtaccgtttgggatacaaactgggattccagccaatattctggatatccggactatagtgatccaagcaatatccgtatgtctgcgggtatcgcattacaatggatgtccccattggggccgttggtgttctcctacgcccagccgttcaaaaagtacgatggagacaaggcagaacagttccagtttaacatcggtaaaacctggtaagtgttctccacaaaggaatgtagtggtagtgtagcgatgactttaggcgatcaatataagatcgccgggccacgcaaagaactgcaccctccggtgcaaatgggatggtaaggagtttattgtgaaaaagtggttattagctgcaggtctcggtttagcactggcaacttctgctcaggcggctgacaaaattgcaatcgtcaatatgggcagcctgttccagcaggtagcgcagaaaaccggtgtttctaacacgctggaaaacgagttcaaaggccgtgccagcgaactgcagcgtatggaaaccgatctgcaggctaaaatgaaaaagctgcagtccatgaaagcgggcagcgatcgcactaagctggaaaaagacgtgatggctcagcgccagacttttgctcagaaagcgcaggcttttgagcaggatcgcgcacgtcgttccaacgaagaacgcggcaaactggttactcgtatccagactgctgtgaaatccgttgccaacagccaggatatcgatctggttgttgatgcaaatgccgttgcttacaacagcagcgatgtaaaagacatcactgccgacgtactgaaacaggttaaataagtaatgccttcaattcgactggctgatttagcgcagcagttggatgcagaactacacggtgatggcgatatcgtcatcaccggcgttgcgtccatgcaatctgcacaaacaggtcacattacgttcatggttaaccccaaataccgtgagcatttaggcttgtgccaggcgtccgcggttgtcatgacccaggacgatcttcctttcgcgaaaagtgccgcgctggtagtgaagaatccctacctgacttacgcgcgcatggcgcaaattttagataccacgccgaagcccgcgcagaacattgcacccagtgcggtgattgacgagacagcgaagctgggtaacaacgtatcgattggcgctaacgcggtgattgagtctggcgttgaactgggcgataacgtgattatcggtgccggttgcttcgtaggtaaaaacagcaaaatcggtgcaggttcgcgtctctgggcgaacgtaaccatttaccatgagatccagatcggtcagaattgtctgatccagtccggaacagtggtaggcgcagacggctttggttatgccaacgatcgtggtaactgggtgaagatcccacagattggtcgcgtaattattggcgatcgcgtggagatcggtgcctgcactaccattgatcgtggcgcgctggatgacactgttattggcaatggtgtgatcattgataaccagtgccagattgcacataacgtcgtgattggcgacaatacggcagttgccggtggcgtcattatggcgggcagcctgaaaattggtcgttactgcatgatcggcggagccagcgtaatcaacgggcatatggaaatatgcgacaaagtgacggttacgggcatgggtatggtgatgcgtcccatcactgaaccaggcgtctattcctcaggcattccgctgcaacccaacaaagtctggcgcaaaaccgctgcactggtgatgaacattgatgacatgagcaagcgtctgaaatcgcttgagcgcaaggttaatcaacaagactaacgttccatcttttgttcgccaaactttacggcctgtctcattcttacgattgcggcaggccgtgttattattgtcgtttcttatattttgacaggaagagtatcttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgacggtaaagtagtttgcgaagcaacgatgatgtgtgctcgtagccgggaggcctgatacgtgattgataaatccgcctttgtgcatccaaccgccattgtggaagagggcgcgtcgattggcgcgaacgctcacattggtcctttttgtatcgttggaccccatgtcgaaattggtgagggtaccgtactgaaatctcacgttgtcgtgaatggtcatactaaaattggccgcgataatgagatttatcagttcgcctccatcggcgaagttaaccaggatctgaaatatgctggcgaaccgacccgcgtggaaatcggcgatcgtaaccgcattcgcgaaagcgtcaccattcatcgtggcacagtccagggcggtggattgacgaaggtgggcagcgacaacttactgatgatcaatgcgcacattgcgcacgattgtacggtaggtaaccgctgcatcctcgccaacaacgcaacgctggcgggtcacgtatcggttgacgacttcgcgatcatcggcggcatgaccgcagtccatcagttctgcatcattggtgcgcatgtgatggttggcggctgctccggtgtggcgcaggacgtccctccttatgtcattgcgcagggtaaccacgcaacgccgttcggtgtcaatatcgaagggctgaagcgccgcggattcagccgtgaggcgattaccgctatccgcaatgcgtataagctgatttatcgtagcggtaaaacgctcgatgaagtgaaaccggaaattgctgaactggcggaaacatatccggaagtgaaagcctttaccgatttctttgcacgctcaacgcgcggtctgattcgttaatgactgaacagcgtccattaacgattgccctggtcgccggagaaacctccggcgatatcctgggggccggtttaatccgcgctctgaaagaacgtgtgcccaacgcccgctttgttggtgttgccgggccacgaatgcaggctgaaggctgcgaagcctggtacgaaatggaagaactggcagtgatgggcattgttgaagtgctcggtcgtctgcgtcgcttactacatattcgtgccgatctgacaaagcgttttggcgaactgaagccagatgtttttgttggtattgatgcgcctgacttcaatattactcttgaaggtaacctcaaaaagcagggtatcaaaaccattcattacgtcagtccgtccgtctgggcgtggcgacagaaacgcgttttcaaaataggcagagccaccgatctggtgctcgcatttctgcctttcgaaaaagcgttttatgacaaatacaacgtaccgtgccgctttatcggtcataccatggctgatgccatgccattagatccagataaaaatggtgcccgtgatgtgctggggatcccttacgatgcccactgtctggcattgttgccgggcagccgtggtgcagaagtcgaaatgcttagtgccgatttcctgaaaacggcccagcttttgcgccagacatatccggatctcgaaatcgtggtgccgctggtgaatgccaaacgccgcgagcagtttgaacgcatcaaagctgcagtcgcgccagacctgtcggttcatttgctggatggaatgggccgtgaggcgatggtcgccagtgatgcggcgctactggcgtcgggtacggcagcactggagtgtatgctggctaaatgcccgatggtagtgggatatcgcatgaagcctttcaccttctggctggcgaagcgactggtgaaaactgattatgtctcgctgccaaatctgctggcgggcagagagttagtcaaagagttattgcaggaagagtgtgagccgcaaaaattggctgcggcgctgttaccgctgttggcgaacgggaaaaccagccatgcgatgcacgacaccttccgcgagctgcatcagcagatccgctgcaatgccgatgagcaggcggcacaagccgttctggagttagcacaatgatcgaatttgtctatccgcacacgcagctggttgcgggtgtggatgaagtcggacgcgggccgttagttggcgcggtcgtcaccgctgcggtgatccttgacccggcgcgcccaattgccgggctgaatgattccaaaaagctgagcgaaaaacgccgtctggtgctctgtgaagagatcaaagagaaagcgttgagctggagtctgggccgcgcggaacctcacgaaatcgacgaactgaatattttacatgcgaccatgctggcgatgcagcgtgccgtcgctggactgcatattgcgccggaatatgtgttgattgatggtaaccgctgcccgaaattaccgatgccttcgatggctgtggtgaaaggcgatagccgcgtaccggaaatcagtgccgcgtctatcctggcgaaagtgacgcgtgacgccgaaatggcagcgctggatattgttttcccgcaatatggttttgcccaacacaaagggtatccaaccgcttttcatctggaaaaactggctgaacacggcgcgaccgaacaccatcggcgcagctttgggcctgtcaaacgcgcactgggacttgcgtcctgattcttgtgtcgagattaagtaaaccggaatctgaagatgtctgaaccacgtttcgtacacctgcgggtgcacagcgactactcgatgatcgatggcctggccaaaaccgcaccgctggtaaaaaaggcggcagcgttgggtatgccagcactggcgatcaccgatttcaccaacctttgcggtctggtgaagttctacggagcgggacatggcgcagggattaagcccatcgtcggggcggattttaacgtccagtgcgacctgctgggtgatgagttaactcacctgacggtgctggcggcgaacaataccggctatcagaatctgacgttgctgatctcaaaagcgtatcagcgcgggtacggtaccgccgggccgatcatcgatcgcgactggcttatcgaattaaatgaagggttgatccttctttccggcgggcgcatgggcgacgttggacgcagtcttttgcgtggtaacagcgcgctggtagatgagtgtgtcgcgttttatgaagaacacttcccggatcgctattttctcgagctgatccgcaccggcaggccggacgaagaaagctatctgcacgctgcggtggaactggcggaagcacgcggtttgcccgttgtggcgaccaacgacgtgcgctttatcgacagcagcgactttgacgcacacgaaatccgcgtcgcgattcacgacggctttaccctagacgatcctaaacgcccgcgtaactattcgccgcagcaatatatgcgtagcgaagaggagatgtgcgagctttttgccgacattcccgaagcccttgccaacaccgttgagatagccaaacgttgtaacgtaactgtgcgtctgggtgaatacttcttgccgcaattcccgaccggggacatgagtaccgaagattatctggtcaagcgtgcaaaagaaggcctggaagagcgtctggcatttttattccctgacgaggaagaacgtcttaagcgtcgtccggagtatgacgaacgtctggatactgaacttcaggttatcaaccagatgggcttcccgggttacttcctcatcgttatggaatttatccagtggtcgaaagataacggtgtaccggtagggccaggccgtggttctggtgcagggtcactggtggcctacgcgttaaaaatcaccgatctcgatccgctggaatttgacctgctgttcgaacgtttccttaacccggaacgtgtctccatgcctgacttcgacgttgacttctgtatggagaaacgtgaccaggttatcgaacatgtggcggacatgtacggtcgcgatgcggtatcgcagattatcaccttcggtacgatggcggcgaaagcggtgatccgcgacgtaggccgtgtattggggcatccgtacggatttgtcgatcgtatctcgaaactgatcccgcccgatccgggtatgacgctggcgaaagcgtttgaagccgagccgcagctgccggaaatctacgaagcggatgaagaagttaaggcgctgatcgacatggcgcgcaaactggaaggggtcacccgtaacgccggtaagcacgccggtggggtggttatcgcgccgaccaaaattactgattttgcgccgctttattgcgatgaagagggcaaacatccggtcacccagtttgataaaagcgacgttgaatacgccgggctggtgaagttcgacttcctcggtttgcgtacgctcaccatcatcaactgggcgctggagatgatcaacaagcggcgggcgaagaatggcgagccgccgctggatatcgccgcgatcccgctggatgacaagaaaagcttcgacatgctgcaacgctcggaaaccacggcggtattccagcttgaatcgcgcggcatgaaggacctgatcaagcgtctgcaacctgactgcttcgaagatatgatcgcactggtggcactgttccgccccggtccgttgcaatcagggatggtggataactttatcgaccgtaaacatggtcgcgaagagatctcctatccggacgtgcagtggcagcatgaaagcctgaaaccggtactggagccaacctacggcatcatcctgtatcaggaacaggtcatgcagattgcccaggtgctttctggttataccctcggtggcgcggatatgctgcgtcgtgcgatgggtaagaaaaagccggaagagatggctaagcagcgttctgtatttgctgaaggtgcagaaaagaacggaatcaacgccgaactggcgatgaaaatcttcgacctggtggagaaattcgctggttacggatttaacaaatcgcactctgcggcctatgctttggtgtcatatcaaactttatggctgaaagcgcactatccggcggagtttatggcggcggtaatgaccgccgatatggacaacaccgagaaggtggtgggcctggtggatgagtgctggcggatggggctgaaaatcctgccaccagatataaactccggtctttaccatttccacgtcaacgacgacggcgaaatcgtgtatggtattggcgcgatcaaaggggtaggtgaaggcccgattgaggccatcatcgaagcccgtaataaaggcggctacttccgcgaactgtttgatctctgcgcccgtaccgacaccaaaaagttaaaccggcgagtgctggaaaaactgatcatgtctggggcgtttgaccgtcttgggccacaccgcgcggcgctgatgaactcgctgggtgatgcgttaaaagcggcagatcaacacgcgaaagcggaagctatcggtcaggccgatatgttcggcgtgctggccgaagagccggaacaaattgaacaatcctacgccagctgccaaccgtggccggagcaggtggtattagatggggaacgtgaaacgttaggtctgtacctgacgggacaccctatcaaccagtatttaaaagagattgagcgttatgtcggaggcgtaaggctgaaagacatgcacccgacagaacgtggtaaagtcatcacggctgcggggctcgttgttgccgcgcgggttatggtcaccaagcgcggcaatcgtatcggtatctgcacgctggatgaccgttccgggcggctggaagtgatgttgtttactgacgccctggataaataccagcaattgctggaaaaagaccgcatacttatcgtcagcggacaggtcagctttgatgacttcagcggtgggcttaaaatgaccgctcgcgaagtgatggatattgacgaagcccgggaaaaatatgctcgcgggcttgctatctcgctgacggacaggcaaattgatgaccagcttttaaaccgactccgtcagtctctggaaccccaccgctctgggacaattccagtacatctctactatcagagggcggatgcacgcgcgcgattgcgttttggcgcgacgtggcgtgtctctccgagcgatcgtttattaaacgatctccgtggcctcattggttcggagcaggtggaactggagtttgactaatacaggaatactatgagtctgaatttccttgattttgaacagccgattgcagagctggaagcgaaaatcgattctctgaccgcggttagccgtcaggatgagaaactggatattaacatcgatgaagaagtgcatcgtttgcgtgaaaaaagcgtagaactgacgcgtaaaatcttcgccgatctcggtgcatggcagattgcgcaactggcacgccatccacagcgtccttataccctggattacgttcgcctggcatttgatgaatttgacgaactggctggcgaccgcgcgtatgcagacgataaagctatcgtcggtggtatcgcccgtctcgatggtcgtccggtgatgatcattggtcatcaaaaaggtcgtgaaaccaaagaaaaaattcgccgtaactttggtatgccagcgccagaaggttaccgcaaagcactgcgtctgatgcaaatggctgaacgttttaagatgcctatcatcacctttatcgacaccccgggggcttatccgggcgtgggcgcagaagaacgtggtcagtctgaagccattgcacgcaacctgcgtgaaatgtctcgcctcggcgtaccggtagtttgtacggttatcggtgaaggtggttctggtggtgcgctggcgattggcgtgggcgataaagtgaatatgctgcaatacagcacctattccgttatctcgccggaaggttgtgcgtccattctgtggaagagcgctgacaaagcgccgctggcggctgaagcgatgggtatcatcgctccgcgtctgaaagagctgaaactgatcgactccatcatcccggaaccgctgggcggtgctcaccgtaacccggaagcgatggcggcgtctctgaaagcgcagctgctgacggatctggccgatctcgacgtgttaagcactgaagatttaaaaaatcgtcgttatcagcgcctgatgagctacggctacgcgtaatcggcaaatgttctgaaaagggtcacttcggtggcccttttttatcgccacggtttgagcaggctatgattaaggaaggattttccaggaggaacacatgaacatcattgccattatgggaccgcatggcgtcttttataaagatgagcccatcaaagaactggagtcggcgctggtggcgcaaggctttcagattatctggccacaaaacagcgttgatttgctgaagtttatcgaacataacccacgaatttgcggcgtgatttttgactgggatgagtacagtctcgatttatgtagcgatatcaatcaacttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccaacgaatatcttgataacattacgccgccgttcacgaaagccttgtttacctacgtcaaagagcggaagtacaccttttgtacgccggggcatatgggcggcaccgcatatcaaaaaagcccggttggctgtctgttttatgattttttcggcgggaataccctcaaggcggacgtctctatttcggtcaccgagcttggttcgttgctcgaccacaccgggccacacctggaagcggaagagtacatcgcgcggacgtttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattctgggtgggatcccgcgcggtgaatttactcgcgacagcatcgaagagaaagtcgctgccaccacgcaggcacaatggccggttcatgcggtgatcaccaactccacctatgatggcttgctctacaacaccgactggatcaaacagacgctggatgtcccgtcgattcacttcgattctgcctgggtgccgtacacccattttcatccaatctactagggtaaaagtggtatgagcggcgagcgtgttgcaggaaaagtgatcttcgaaacgcagtcgacccacaaaatgctggcggcgttatcgcaggcgtcgctgatccacattaaaggtgagtatgacgaagaggcgtttaacgaagcctttatgatgcataccaccacctcgcccagttatcccattgttgcttctgttgagacggcggcggcgatgctgcgtggtaatccgggcaaacggctgattaaccgttcagtagaacgagctctgcattttcgcaaagaggtccagcggctgcgggaagagtctgacggctggtttttcgatatctggcaaccgccgcaggtggatgaagccgaatgctggcccgttgcgcctggcgaacagtggcacggctttagcgatgcggatgccaatcacatgtttctcgatccggttaaagtcactattttgacaccggggatggacgagcatggcaatatgagcgaggaggggatcccggcggcgctggtggcaaaattcctcgacgaacgtgggatcgtagtagagaaaaccggcccttataacctgctgtttctctttagtattggcatcgataaaaccaaagcaatgggattattgcgtgggttgacggaatttaagcgctcttacgatctcaacctgcggatcaaaaatatgctgcccgatctctatgcagaagatcccgatttctaccgcaatatgcgtattcaggatctggcgcaagggatccataagctgattcgtaaacacgatcttcccggtttgatgttgcgggcatttgataccttgccggagatgatcatgacgccacatcaggcatggcagagacagattaaaggcgaagtagaaaccattgcgctggaacaactggtcggtagagtatcggcaaatatgatcctgccttatccacccggcgtaccgctgctgatgccgggagaaatgcttaccgaagagagccgcacggtactcgattttctactgatgctttgttccgtagggcaacattaccccggttttgaaacggatattcacggcgcgaaacaggacgaagacggtgtttaccgcgtacgagtcctaaaaatggcaggataacttgccagagcggcttccgggcgagtaacgtgctgttaacaaataaaggagacgttatgctgggtttaaaacaggttcaccatattgcgattattgcgacggattatgcgatgagcaaagctttctactgcgatattcttggtttcacgctgcaaagcgaagtctatcgcgaagcgcgcgactcgtggaaaggggatttggcgcttaatgggcaatatgtgattgagcttttctcatttccgttcccgccggagcgccccagccgaccggaagcctgcggcctgcgtcatctggcttttagcgttgatgatatcgatgcggcagtggcgcaccttgaaagccataacgtgaagtgtgaagccatccgtgtcgatccctacacgcaaaaacgcttcacgttctttaacgatccggacgggctgccgttggaactgtatgagcagtaaggcttgtcatcgccgcatttgcccggtaacgtgcccggcattgctactgtaaaatcgcaccatcatgacactcacgctcaatagacaacttctctcctcacgccagattctggtggcctttagcggcggccttgattctactgtcttactgcatcaactggtgcagtggcggacggaaaatccgggcgtcactctgcgcgctatccatgtgcatcacggtttaagcgccaatgctgatgcctgggtgaaacattgtgaaaacatctgccaacagtggcaggtgccgctggtggtcgaacgtgtgcagcttgcgcaagaggggctaggtattgaggctcaggctcggcaggcgcgttatcaggcatttgcccgcaccttgttgcccggtgaagtgctggttacagcgcaacatctcgacgatcaatgtgaaacctttctgctggcgctaaaacgcggtagcggccctgccgggctttcggctatggcggaagtttcggagtttgccggaacacagcttatccgcccgttgcttgcccgcacgcggggggaactggtgcagtgggcgttggcgcatggtttacgctggattgaagacgaaagtaatcaggatgatagctacgatcgtaactttctgcgcctgcgcgtagtgccgttattgcagcagcgttggccgcattttgccgaagcaacagcccgcagcgccgcactttgcgctgaacaagagagcctgttagatgaactgctggcggatgatttagcgcactgtcaaactccgcaggggacgctgcagattgcgccaatgctggcgatgagtgatgcccgtcgcgcggcgattatccgccgctggctggcagggcagaatgcaccgatgccttcccgcgacgcgttggtgaggatctggcaggaagtggcgctggcgcgggaagatgcctccccctgtttacgtttgggtgcgtttgaaatccgccgctatcaatcgcaactgtggtggattaaattcgtcactgggcaaagcgaaaccattgtgccgtggcagacgtggctacaaccgctggaattaccggcggggctgggaagtgtacagcttactgcgggaggcgatattcgccctccgcgtgcagacgaagcggtcagcgtgcgtttcaaagcgccaggactgctgcatattgtcgggcgcaacggcggacgtaagctgaagaaaatctggcaagagttaggcgttccgccgtggctacgtgacaccacgccactgctgttttatggcgaaacgctgattgcggcggcaggggtatttgtgacgcaagaaggtgtggctgtaggtgagaatggcgtcagttttgtctggaagaaaacgcttagttaagtgaaagccggataagacgcaacaaacgtcgcatccggcgaagtcaatcaggactcgctcaccaccaccgtaccgatttccgggtggctaaagctggtaattttatccagacgcagctcgcgggttgcaccagcggcttcgacgaccagatattccacatttttgcgggagactaaatcgctggccttcgcctgcaatttttcgccatctttcagctcaagtgtcagcattaaatgatgctggcaggcgagctcaagattatcgtaatcatcacaattgattggttgatacgtatcatttattgacataatcgctcaccagtaagtttgccgcagcgtatgctgctttttccctgacagcctcagaaagggcgtcgtcggcagccatttcattcagcactttcaaaacgcagcccagcgcgtccggaacgtatcctaagtctccgctggcgatttccgcgtaccgcttgcgtattaactcacaatatttttccacatgccctcctgtcagcactctgacttaaccgtggatgcaagtctaagcctacgaagataaactctgtttcgcaaggtgactataccacactcatttctgcaatatcagcgccgcaactgcacgtattccgttacaatggcctcctgattcgaaaggagttttcttatggcgcttaaagcgacaatttataaagcgacggttaatgtggccgatctcgaccgcaaccagtttctcgatgcctctctgacgctggcgcgccatccttcagaaacccaggagcgcatgatgctgcgcctgctggcgtggctaaaatatgccgatgaacgtctgcaatttacccgtggtttgtgtgccgatgatgagccggaagcgtggctgcgtaacgatcatttgggtattgatttgtggattgagctggggctgccggatgagcgacggattaagaaagcctgcacccaggccgcagaagtggcgctgtttgcctataatagtcgggcggcgcaaatctggtggcagcaaaatcagagcaaatgtgcgcagtttgccaatctttccgtctggtatctggacgacgagcagctggcgaaagtgagcgcctttgccgatcgtactatgacgctgcaggcaacgattcaggatggtgttatctggttatcggatgataagaataatctggaagtgaacttaaccgtctggcaacaaccttcatgattgtgatttcccgacatgttgctatccctgatggcgagtttgagatcaccgccattcgtgcgcagggcgcgggcgggcagcatgttaataagacctcaacggctattcatctgcgttttgacattcgggcgtccagcctgccagagtattacaaagaacgtctgctcgccgccagccatcacttgatcagcagtgatggggtgattgtcattaaggcacaggaataccgcaatcaggagctcaaccgcgaagcggcgctggcccggctggtggcagtgattaaagatttaacaacagaacaaaaagcccgacgacccacgcggcccacccgcgcatcaaaagagcgcaggctggcatcgaaagcacaaaaatcaagcgtgaaggcgatgcgcggcaaagtgcgcagcggtcgggaataaaaagaaggaatggatggtgaaaaaagcgatagtgacagcgatggctgtaatcagcctctttactctgatgggatgtaataatcgggccgaagtcgatacgctttctccggcacaggctgccgaactgaaaccgatgccgcaaagttggcgcggcgtgctgccgtgtgctgattgcgaaggaatcgaaacctctctgttcctcgaaaaagacggaacctgggtgatgaatgagcgttatctgggggctcgtgaagaaccttcctccttcgcttcctacggtacatgggcgcgaaccgctgacaagctggtattaaccgatagcaaaggtgaaaagtcatattatcgcgcgaaaggagatgcgctggagatgctcgatcgtgaaggtaatccgattgaatcgcagttcaactatacgctggaaccggcacaatccagcttacccatgacaccgatgaccctgcggggcatgtatttttatatggctgatgcggcgaccttcactgattgcgcgaccggaaaacgtttcatggtggcgaataacgcagagctggagcgtggctacctggctgcgcgcggtaacagtgaaaaaccggtgttactgtcagtagaaggtcactttacgcttgaggctaatccggataccggtgcgccgaccaaagtattagcgcccgatacggcaggtaaattttacccaaaccaggattgcagtagtttggggctgtaacccgtcttgagacagaaacaaatgaaatattgcctcatgcgctgcgcttatcagtcctaaagcatacaatgcaatattttgaattagcacaattttgtaggccggataaggcgttcacgccgcatccggcattttgcgcacgaggctggcttttatcactgagtcagtccaacaaagcgacttgctttaatataaatccctggcttcaggtgcccaatatactgtaactgcgtttctggtttaaatgcagagacatcaccactacgcatatgcatcagatcggcagggctaatccagcctgattgcgccagcgtaagcggatgcccggctttggcaaatgcatcagtgacaaattccgaacaaaaccacgactttttgtctccttcgcccacactgcttaactgcgctttcgccaggccgctgacgcactgttgacgaaaatcctcggagaacggatttagtgagcacatctggcgagtcaccataaatggaataaattcgacaatgccgcgatagttataaccgctatctttaattttgttggcgaacgcggtgatttctgtggcttgttgcggggtaagatccgggactcgtaagacgaaaagcttatcactatgctttatggcttttttaagggaaacaatctggacgccagcgcctgtcgcttcggcaacgttattatctcccaaatagattgcaacgtgactcacagaggaagtgctgaatacgcggataccaaatgaggttaccccaaggcttgaggagaaaagcaaatcgccgggtttgagatctggttccgttatttcttttattgattgttcggtgaaagagctttgatgctggaatttaacagcccatgttttcgcctcggcatttaccactgtggctgatgagtctggctggctgatatcaacggtacaggccgaaagtaaaagaaagcaggggagaagcaggcggcagtacgcctttggtttatccattttatacaatccatgtaaaaaagggccccgaaattcaggaccctttctggcatcagcctttaatctgtttcaccagataatcgacgatgtcaccagtcttaattaactgtttctcgccgttacgacgatatttatattcgatatcatcgttgtcgaggttacggtcgcccagcacaatagtgtgcggaataccgatcagttccatatcagcaaacatcacgcccgggcgctctttgcggtcatccagcagcacttcgataccttgtgcgcgcagttcgctgtacagtttctcagcaagttcctgtacgcggaaggatttgtgcatgttcattggcagaatcgccacctggaacggcgcgatagcgtcaggccatacgatgccgcgttcgtcgtagttctgctcaatcgccgcagctaccacacgcgttacgccgataccgtagcaacccatcgtcaggatttggttacggccatcttcaccctgtacggaggctttcagtgcttcggagtacttggtacccagctggaagatgtgaccgacttcgataccacgtttgatcagcagcgtaccctgaccatccgggcttggatcgccagccaccacgttgcggatatcagcaatttccggagtagcgacatcgcgatcccagttgataccgaagtagtgtttaccatcgatgttagcaccagcagcgaaatcactcatcgccgcaacggtacggtcaatcaccaccggaatcggcatgtttaccggacccagtgaacccggaccggctttaaccacggcacgaatttcttcttcggtcgcaaaagtcagcgggctggcaacctgcggcagtttttctgctttaacttcgttcagctcgtggtcaccgcgcaccagcagcgcaaccagcgggaagctactgccttcaacggctttaaccagcagagtcttaaccgttttctcaatcggcagattgaactgttcaaccagttccgcgatggttttcgcgttcggcgtatcaaccagcgtcatttcctgggtagcagcagcgcgcggttctttcggcgcgatagcttctgccagttcaatgttcgctgcatagtcagaagtatcggagaagaccacatcgtcttctccgctctgcgccagcacctgaaattcgtgagaggcgctaccgccgatagaaccggtatcggcctgtacggcgcggaaatccagccccatgcggctgaagattttgctgtaggccgcatacattgcatcgtaggtttcctgcagggattcctgagaagtatggaaagagtaagcatctttcatcaggaattcgcgggaacgcatgacgccgaaacgcggacgcacttcgtcgcggaacttggtctggatctgatagaagttcagcggcagctgtttgtaagagctcagctcgttacgaatcaggtctgtaatcacttcttcatgagttgggccgagtacgaacggacggtcaccacggtcagcaatacgcagcaattccgggccatactgttcccaacgaccactctcttgccacagttcagatggctgaaccaccggcattaacacctcgatcgcaccggcgttgttcatctcttcacgcacgatgttttcgacttttttcagaacgcgcacgccggtcggcagccaggtatataacccggaggccagcttgcggatcatcccggcgcgcagcatcagctgatggctgatcacctcggcgtcggcaggtgtctccttgagagtggagagcaggtattggctagtacgcatgttgttacggttccagttggaaggtagaacaggctcaaggcgagcctgggacaaaaaaagtgatttagtttaccagtgcaaaagaaatgtcaaaagagaagggcgtgaatttaacgcggttccagcgcaaagacttcaaaacctgcgtcggtgacgcgccagcgaacgttaaaatcatgcagccagacggcataggttttgcccgtttcctcacctttacgataggccgggcgcgggtcctgcgccagtacttcgcggataaacagcgttaactgcggataacgcttctccagcgtcaaaagctgcttttcgacctctgcggtaaaacacaccgccatttctgccgctggcgcactttgcgcatagctggcactggcatcgggaagcgattcagcaaaggggagatacggtttgatatccactaccggcgtaccatcgacgagatccagactgccgagcttcagaatcacgctatctttatggcaaacaacctctttcagctctaccagcgacataccaattgggttagggcgaaaagtggagcgcgtagcgaaaacacccattctggcattaccgccgagacgaggcggacgcacagtcggacgccagccgccttccatcgtttgatgaaagacgaaaaggatccataaatggctgaatgcttccaggccgcgaacggcgtcggcctggttgtagggagcaatgagatgtagttcgccgttggcgctttttaccagacctggctggcgcggaacggcgaatttttctttatagggcgagcgaataacgcctatttgctcgaactggaaactgctcatttcgccgtgatgttaagcgcagaacctatacatacagcctgacgatagcaacctggcgtaccgctggtgacttcgcagctatgcagtaataccgcattggctttcattttcgaggcgttgatttgcatccgcttacgtgcggttggaatgctcggcggagagtcctgattagaggcctggcaagagtcgccactgacttcaccgagatcgcggaacggtttgccgactaattcttctgcattggtataaattcggaccggcgtggcgcgcggcgctttcggttttgcaggctccgctttcggctggggtgcagtgctttgaacgggttcgacaggggatctgcttaacatggaacagccgcttagcatgagtgctactaaacagatcggtaaagcacgcatagtatttcctcaatgtatgatcaaaacgtcaatattgaatcaggcgcttgtaaaaatgacaagacgggcaagcgcccgtcctgaatgatattacaaattgtggaaacagcctaaatattaccagcctttaacagcgccgccgttaaacactttgtttgctgcttcgtaaacttcgtcagactgataagcctgaacgaatttcttcacgttttcggcgtctttgttgtcttcacgcgttacgatcaggtttacgtacggggactctttatcttcgacaaagataccgtctttcgctggagtcaggccaatctggctggcataggtggtattgataactgccagagcgatttgcgcgtcgtccagagagcgcggcagctgcggtgcttccagttcaacaattttcagattttttgggttctcaacaacatcaagaacggtcggcagcaggccaacgccatctttcagtttgatcaagcccactttttgcagcagcagcagtgaacgaccaaggttagttgggtcgtttggcacggcaacctgcgaaccatcctgcagttcatccagtgatttgattttcttggagtaaccagcaatcggataaacaaatgtgttgcctactgcgaccagtttgtagccacgatctttcagttgctgatcaaggtacggtttatgctggaaggcgttggcgtcgatatcgcctttgctcaatgcttcgtttggcagaacatagtcgttgaaggttaccagctcaacgtccaggccatatttgtctttcgcaactttctgcgcgacttctgcaacctgctgttcggcaccaacaatcacgccgactttaatgtggtttggatctttttcatcctgaccgcagcctaccagtgccagtgatccaatcagggctcccactgccgcaaaggttttgaatttgaacgccataccttattccttcttcaattatttatgttgtgttgaacgttacttgcgagtgacagcccggacgatgcggtcgcctgcgaactgaattaaataaaccagaatgaccagcaataccagtaccgtattcatcaccgtcgcgttgtagccgatgtagccatactgatagccaatctgacctaaaccaccggcaccgactgcaccacccatcgcggaataaccaaccagggtaatcagggtgatagttgccgcattcaccagacccggcaacgcttccggtaacagcactttacggacgatctgcattggcgtggcccccattgcgcgggaagcttcaattaacccggttgggatctccagcagagcgttctcgaccatacgggcaataaacggtgctgcaccaacggttaacggaacaatcgctgcctgcaatccaatcgatgtaccgacaataacgcgggtaaacggaatcatccataccagcaagataatgaacgggatggaacggaaaatgttcacaatcgcagaaatggtacgatacaacttcgcgttagcaataatttgccccggacgcgtgacataaagcagaacgccaaccggcagaccaatcacaaagccaaaaaaaccggatacgaaggtcattgccagtgtttcccatacgccacgaaccagcagccatatcatcggctcagacataacccagtacctctacttttacatggtgttcctgaagccaggcaatggcggcttgcgtatcttgttgtgtgccgtgcatttcagtcagcataatgccgaacttaacgccaccggcgtaatccatctgcgcgctaataatgttgttgttgacgttgaaacgacgcgcggtttcagaaagcagtggggcatcgaccgattgaccggtaaactccagacgcagcatcggcacgcagtcagtaaatggctccgcttgcagacgttcctggtaatcttccgggatatccagatgcagggtcgactgaataaacttctgcgccagcggcgttttcggatgcgagaacacttcacttaccgtgtcctgctcgatcagttcgccattgctgatgaccgccacgcaatcacaaatgcgcttcacaacgtccatttcgtgagtgatcaacagaatcgtcaaacccagacggcggttgatgtctttcagcagttcgagaatagaacgtgtcgttgccgggtccagcgcgctggtggcttcatcacacagcaatactttgggattgctggctaatgcacgggcaatcgccacacgttgtttctgcccaccggaaagattcgacgggtagctatcatgcttatcgccaagaccaaccaatgacagcaattccgtcacgcgacgtttgatctcgtctttcggtgtgttgtccagctccagcggcagagccacgttgccaaaaacagtacgcgaagagagcaggttaaaatgctggaaaatcataccaatctggcgacgagctttggtcaactcggattctgacagcgtggtcagttcctggccatcgaccagcacgctaccctcggttgggcgctccagcaggtttacacaacgtataagcgtactcttacccgcgcctgaggcaccgataacgccataaatttgtccagctggcacatgcaggctgacgttgttcaacgcctggatggtgcgggtgccctggtggaacactttggtgatattcgaaagttttatcattgattatttattatcgtcattaagttagtcgtggcatttcgaatgcctggaacgggcaacgccgtcaatgaaatggatgttaaggcatccagacgtctaaatcaatcaggtttatgcgaagagcactttcttgcaggtcgaaacatgcgatactagcgtcacatgccttattaaggagctataaaaggtggcgaagagcgtacccgcaatttttcttgaccgtgatggcaccattaatgtcgatcacggttatgtccatgagatcgacaactttgaatttatcgacggtgttattgacgccatgcgcgagctaaaaaaaatgnnnnncattccattcattaattaattaatgaatgaatgnnnnngctcagattgaacgctggcggcaggcctaacacatgcaagtcgaacggtaacaggaagcagcttgctgctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcannnnncattccattcattaattaattaatgaatgaatgnnnnnaggaagcgtaatatacgccacctcgcgacagtgagctgaaagccgcgtcgcaactgctctttaacaatttatcagacaatctgtgtgggcactcgaagatacggattcttaacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgccygatggagggggataactactggaaacggtagctaataccgcataacgtcgcaagaccaaagagggggaccttmgggcctcttgccatcggatgtgcccagatgggattagctagtaggtggggtaamggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgaagtgctcacacagattgtctgatgaaaatgagcagtaaaacctctacaggcttgtagctcaggtggttagagcgcacccctgataagggtgaggtcggtggttcaagtccactcaggcctaccaaatttgcaccgcaaatttgaagaggttttaactacatgttatggggctatagctcagctgggagagcgcctgctttgcacgcaggaggtctgcggttcgatcccgcatagctccaccatctctgtagtgattaaataaaaaatacttcagagtgtacctgcaaaggttcactgcgaagttttgctctttaaaaatctggatcaagctgaaaattgaaacactgaacaatgaaagttgttcgtgagtctctcaaattttcgcaactctgaagtgaaacatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctctttatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggtaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagctgttttggcggattgagagaagattttcagcctgatacagattaaatcgacaggtcagaacaggacgtgttgataaaacagaatttgcctggcggccgtagcgcggtggtcccacctgaccccatgccgaactcagaagtgaaacgccgtagcgccgatggtagtgtggggtctccccatgcgagagtagggaactgccaggcatcaaatttagcagtaagccggttataaaccggtggttgtaaaagaattcggtggagcggtagttcagtcggttagaatacctgcctgtcacgcagggggtcgcgggttcgagtcccgtccgttccgccacttattaagaagcctcgagttaacgctcgaggttttttttcgtttgtatttctattattgccaaaatcgcaaaaatcctctgcgttttacgccatttttccacaactgtctgaagcccataatcacctcagttaacgaaaatagcattaaaagaggcatattatggctatccctgcatttggtttaggcactttccgtctgaaagacgacgttgttatttcatctgtgaaaacggcgcttgaacttgattatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccgagtctgaaagagagcctgcaaaaattgcgtaccgattatgttgatctgacgctaatccactggccgtcaccaagcgatgaagtctctgctgaagagtttatgcaggcgctgctggaagccaaaaaacaagggctgacgcgtgagatcggtatttccaacttcacgatcccattgatggaaaaagcgattgctgctgttggcgctgaaaacatcgctactaaccagattgaactctctccttatctgcaaaaccgtaaagtggtcgcttgggctaaacagcacggtatccatattacttcctatatgactctggcgtatggcaatgcactgaaagataaggttattgctcgtattgcagctaaacacaatgcgactccggctcaagtgattctggcgtgggctatgggggaaggttactcagtaattccttcttctactaaacgtgaaaacctggagagtaatcttaaggcacaaaatttacagcttgatgccgaagataaaaaagcgatcgccgcactggattgcaacgaccgcctggttagcccggaaggtctggctcctgaatgggattaagcctctctgacagctcctccgggagctgtttttacatgtccgctaaggaaatcgataaaagcccggatgcgcgtacttaccgcacggtcgctgtaatagactgcactgaatggcatttccactggcaacactttatctgccattaactccaccaattctccgcgagcgatttctttgtcgatcatgtagtcggacaaacacgcaatcccgttgccactcaggcaaagctgtttcagtgtttccccactattggatgacaaaccgtacttcacctcatgtaattgtccatcgctacaggctatcggccaggtattgagggaagcgggttcagtgaatctcaggcaaatatgttgctttaaatcgtcgatcgtttctggcttcccgtagcaggaaatataatcgggggaggcgataatttttcgataactgttaaataacggcctggcacgtaagctggaatccgttaacgtaccggcgcgtatcgcgacatccacttttctttcgatcaaattaataatcgtttcggaggagactagcgataaagtgacttccggatagcgttcacgaaaaggcttaatcaacggcatcagaaagtgcagcaccactggagttgcggcatcgatccgtaacagtccacgcggtgtattacgcgtctccataatttctgattctgccgctgccatctcctgcaaaattgactgtacgcgatgaaaataacgctcgccttcttccgtcaggctaagttgccgcgtggtccgattaagcaggctaacgccaagtttcatctccagctttttcaccgcccggcttaccgctgagtttgcttgccctaattgttccgctgcccggctaaagctgccgctttcgacgactgaaacaaaaatggcgagttcttccgacgtggctttcatttttgctcctgttgcaaaatagaagagatattttgaatttatttgtcattaaaccatcaggatgcgagatatgccatccgatttaatgttctcaataatgagcaaaatcctgaccggtgtaagcacttgcttacataacaatatacaattgctcgttgaaagagtgagctaaaatccctataacagtagaaccctcccgagtgcggaagggttgacgtgatagaggtttcaaagtcaaaagtgcgaaaaaacacctatgccatgcgctatgttgccggacaacctgcggaaaggatcttaccgccggggtcttttgcgagcatcggccaggcattaccacctggagaaccgttaagtaccgaagagcgtattcggatcctggtgtggaacatatacaaacagcaacgcgctgaatggttgtcggtattaaagaactacggcaaagatgcacatctggtgttattgcaggaagcgcagacaacgccagagttagtacagtttgcgactgctaactatcttgccgccgatcaggtacccgctttcgtgctgccacaacatccttctggcgtaatgaccctttcggcggcacatccagtgtattgctgcccgttacgtgaacgagaacccattttgcgtctggcgaaatcggcactggtgacggtctatcccttacctgacacccgcctgttgatggtggttaatatacacgccgtcaacttcagtctgggcgtggatgtctatagtaagcagttacttcctattggcgatcagatagctcaccacagtggcccggtcattatggcgggagatttcaatgcctggagccgtagaaggatgaacgcgttatatcgctttgcgcgggaaatgtcgctacgccaggtgcgttttaccgatgatcagcgccgtcgggcgtttggtcgcccgctcgattttgttttctaccgtggtctgaacgtcagcgaagcttctgtactggttacgcgcgcttccgatcacaatccgctactcgttgaattcagtcccggcaagcctgataaataaggtatgtcaggtctgccacagggcagaccaacgtttggcgctgcccttttatactcaaacaacaaaaggacagcgcaatgacaacacaatcccaccatgaccacgtagaaaagcagtttagctctcaagccagcgaatatctgaccagtaccgtacatgcatccggacgagatttacagcgcctggcggtgcgtctggctgattatcctgatgcaagtgtacttgatatgggctgcggagcagggcatgccagctttgttgctgcgcaaaacgtgagcgcggtggtagcgtatgacttatctgcccaaatgctggatgtcgtggcacaagctgccgaagcccggcaactgaaaaatatcaccacccgccagggttatgccgaaagtctgccatttgccgataacgcatttgatattgttatcagccgttattctgcccatcactggcatgatgttggtgcagcactgcgtgaagtgaaccggatattgaaacctggcggtaggctgattgtgatggacgtaatgtctccgggccacccagtgcgcgacatctggttacagacggtagaagcattacgcgatacctctcacgtacgaaactacgccagcggtgagtggttgaggttaatcaatgaagccaatctgatagttgataatttaattacagataagttaccgctggaattttcttcatgggtcgcgagaatgcgtacgccagaagcgttagtagacgctattcgcatttaccaacagagcgcatcgacagaggtgaaaacgtattttgccttgcagaatgatggctctttcaccagtgatatcatcatggtagaagcacataaagcagcataaataaaaaaggcaccgggggaatcggtgcctttcattatctggtttgtcaggaatctggcatgttgttgtttttcacaaacaacgtcagcttatcgcctggttgcagattcgcagtatcgctgttccagcgcatcacatctttgatgttcacgccgtggcgtttagcaatgcttgaaagcgaatcgcctttgcgcacacgatacgtaatgctatcgctgttgtttgccaaccgctgtgcgctactacctgcgccaatcgtcaagctttggcctggcttcagcttagatccgcgcagtttgttccactgctgcaaatctttggtgctaacgccgagacgtgaagcgatacttgaaagcgtgtcgccagagcgtacggtgtaaacacggctgttaagcggcgtattgtcggcaaccagcgtcgactgtacagcagcaatttcgcccgaagccagagattcacgcagttgatctgcatgcttctttggcaccatcacgtactgcggaccacttgcgcccagcgtggagcctttcacgccagcgttgaatgtcttcagcttgctgacggaaatccccgccatatctgcaaccttcgccatttcaaccgggctgctcaggtgcacacgcgccagagcacggctttcatcggtcgttggcagacgtacgccataacgcttgctgtttttgagaatatcactcaatgccagcattttaggcacgtactgcttcgtttcctgcggcaacggtaacgaccagaagtccgtggatttcccacgcgctttgttcgttttaattgccttcatgacccgaccttcgccgctgttataagccgctacggtcagaagccagtcgccgtcaaacatcttgttcagacgctgcatcatgttcagcgcggcagttgttgaagcaacaacatcgcgacgcgcgtcataattgcgtgtctgtttcaaaccataattgcgccccgtgctcggaatgatctgccagatgcccgcggcattggcgccagacgttgcgtgaggatcaaaagcgctctccactatgggtagtagtaccagttccataggcatgttacgttttttaacttgcccggctatccagtacatatacggctctgcccgtaaagttacatcgtggagatagctcttattgcgtaaatatttctgtttctgttcgcgaatccggtcgttttccggaattcccatctttagctcgtcgccaatgaaagcccacaagtcaccatctggcgcgatagacgtcccatcgtccatccatcgtgcctgacttgtaaactttgctgcttccccttgaccagctgcagaaaggctctgtgcgtgctgttgaacgttgccggtgctctggcaacccacgagcaggacagaggcgagtaatatcgcttttgccttcatgtgtgtgtcaatagttgcttaaaagacgaccgatcataacggcgaacggagccgatgacaagaaagttttatcagaacctatctttctttgaccttaaccatgcaaaacgttcttcaggttgttgcaataatgtttcttcattaattacattaattaaatcaatatcttccgttcttaaaaaaacattaatttgccgctcatttttcagaattacgggtagtgttatttgattttttgcccgtaactccttaactttacgataataatcatttatggacaaatcgtgcggaagaatactcaaagcaaacttcatatttgataaggtatattcatgagcacaacataccaatgtatcgtcaggtaacgcacttaactttttaattgattgatacatttgtgatggtgtcccttcaaacaaccgaccacacccaccagaaaacagcgtgtcgccgcaaaatagataaggtttactgaagtaacagatatgtcctaaagtgtgacccggtgtggcaattacactaaattcatgccccaaaacgaaggcagtttcgccatctttgactacctgtgttgttcccttatcttgtgtctcttgtggtccatacaccacaatttgcggaaacttttccaccagttcttttacgcctccaacgtgatcgtggtgatggtgggtgagaaatatggcctccggttgccagttattggcggaaatggcgtttaatactggctctgcgtccccgggatcgacaatcagacagcgacctgcttcatcattcaaaacccagatgtaattgtcatcaaaggcgggaatactgttaagattcatagattacctctcagtgtgaaacggaaggttgtgatgaaaccggcaagagtccctcaaactgtcgtggctcctgattgctggggcgatttgccctggggagagctttatcgcaaggcgctggagcgtcagctcaacccgtggttcactaaaatgtatggttttcatctgcttaagattggcaatttaagcgcagaaatcaattgcgaagcgtgcgcggtttctcatcaagtgaatgtttctgcgcaaggaatgcccgtccaggtgcaggcggacccacttcatcttccttttgccgataaatccgttgatgtttgtctactggcacatacattgccgtggtgcactgatccgcatcgtttattgcgtgaagccgatcgggtactgattgatgatggctggctggtgattagtggcttcaatcccatcagtttaatgggattacgcaaacttgtgccggtattgcgcaaaacatcgccctataacagccggatgttcactctgatgcggcagctggactggctctctttgttgaattttgaagtgctacacgccagccgtttccacgttctcccgtggaacaaacacggaggaaaactattgaatgcgcatattcctgcgcttggttgcttacaacttattgttgcccggaaacggactattcctttaacgctaaatccgatgaaacagagcaagaacaaaccgcgaattcgccaggcggttggtgccacccggcaatgtcgtaaaccacaggcttaaacttcgacttgatagcctgtatcttccagtgtgggattcattgccgcagcacgagccagttcatcacagcgttcgttttccgggtgtccggcatggcctttaacccattcccatttgatttgatgctgccccagagcagcatcaagacgttgccagagatcgacattttttactggttttttgtctgctgttttccaaccacgttttttccagttatggatccactgggtgataccctggcggacatactggctgtcggtactcaaaatgacttcgcaatgttcttttaacgcctccagcgcgacaatagcggccatcaactccatacggttgttggtggtgcgggtgtagccagcgctaaaggttttctcgcgtccgcgatagcgtaaaatagcgccgtaacccccaggtccaggattacccagacacgaaccatcggtgaaaatttctacctgtttaagcatctctggtagacttcctgtaattgaatcgaactgtaaaacgataagtctgacataaatgaccgctatgagcactgcaattacacgccagatcgttctcgataccgaaaccaccggtatgaaccagattggtgcgcactatgaaggccacaagatcattgagattggtgccgttgaagtggtgaaccgtcgcctgacgggcaataacttccatgtttatctcaaacccgatcggctggtggatccggaagcctttggcgtacatggtattgccgatgaatttttgctcgataagcccacgtttgccgaggtagccgatgagttcatggactatatccgcggcgcggagctggtgatccataacgcagcgttcgatatcggctttatggactacgagttttcgttgcttaagcgcgatattccgaagaccaataccttctgtaaggtcaccgatagccttgcggtggcgaggaaaatgtttcccggtaagcgcaacagcctcgatgcgttatgtgcccgctacgaaatagataacagtaaacgaacgctgcacggggcattactcgatgcccagatccttgcggaagtttatctggcgatgactggtgggcaaacgtcgatggcttttgcgatggaaggagagacacaacagcaacaaggtgaaacaacaattcagcgcattgtgcgtcaggcaagtaagttacgcgttgtttttgcgacagatgaagagcttgcagcacatgaagcccgtctcgatctggtgcagaagaaaggcggaagctgcctctggcgggcataaatacctgtaaaaggcgctaaaaatagcgacttgggcgatttttgcagcaaacgattcaaaagatgagaaaaaccgttgacgaagggtgaggcaatccgtaatattcgcctcgttcccaacggaacacaacgcggagcggtagttcagtcggttagaatacctgcctgtcacgcagggggtcgcgggttcgagtcccgtccgttccgccaaattcactcatgaaaatgagttcagagagccgcaagatttttaattttgcggttttttcatctaaatcccgctatttcttcggtctatgattttgttatgctgtaaatgtgttaatcacatatgatagaccatgtcattaatatttaatcatgctatcgaatcattcaatttaaatatatttgcacgttatgattttcatttttctattgatttaatgaatttatatttgctgttattttttgtttgttctgattcaagtggagtatataattaaaaatcgttagctaaacattaccatgattatgacaggcgagggagtgtccgattatgaatttaaaaaaggtttgttgtatatgtgtattattctcgctgcttgcaggatgtgcctctgaatctcctattgatgaaaaaaagaaaaaaactcaaaccacacaaatttctattaataaaaacgttccccagcaactaacagacaaagatttatatggtaatgaaaccacactggctgtatccgaggaggatattcaagctgcgcttgaaggagatgagtttcgtgtgcctcttaattctcctgtaatacttgttcagtctggcagtcgcgcaccggaaaccattatgcaggaggagatgagaaaatattatacagttgccacattttctggcattcctgacaggaaaaaaactgtaacctgtaataaagacaaaaacaaagatgaaagcctggatattgtagatgccgaaaatatgaactggatgcaggcattgcgttttgttgcagcaaaaggccatcagaaagcgattattgttttccaggatacgttgcagacaggaaaatatgactctggattgaaatcaatagtttggacagattataaaaatcaaaaattgactgacacgatgtcactgcgttatttggttcgattcacgttggtggatgtggctacaggtgagtgggctacctggtcgcctgtgaattatgaatcgaaagtgatttttccgcagatagggaataaaaattctgacagccttgatgtggcagaacagcagatttcacaacttaagcagaaaacgtatgcagcagtggttaaagacctggtgaatcgatatcagtagtgaggttttataccagacgttttagtggtacttagcaagaaagagcatttctcttttctattttacactatggaacaagtctgctaattaattttacatatatcttttaggagtggtaaaaactttcctaaagttatttattgtcctctcaacatataagctgtaattcgagttttcggttgaactgtcaaaaatacatcatatacatctataaaacagcaggtacggttaattaagaatttttattcgtgattaaccgtactttgtcattttatcctataatgttaaattgcctttttaaaatataacaataatgcagatgaaagactccctggtaacttagaaaatccgttcactccaaaggctgtatgcactggttccggcgacgctgtgctcccaattgatgctctcataggtaaatgacacagactcttccgcctgccctggactgtcgttaatggtatggggaacggtaaggccgatgtttgagagccgggcgttagccagtttcagcttgtagtacggttcattaattccaaagcggttggtgcggtagaatacaaaatcacaggtcagacattcattctctgaaatggccttgcccagcagaggggaggatttgtccaccggtttcgtgatggtcaactcctgatggttgacattctgcgcacggctcagaccatgggacagtgacgtcaccatgatctgatcctgatgtgcaatctgggctttgttaccgatggacggcattgacgagcatccggatgaaatcagcccctgaagttctccgttcagtgtcagatagacgggatttgccattgttattctccttaatctcaatgagttggatggacaggttcggttctgttatccgttgccatatcctgtccggtatttttcagcagcagccagcggcttaacagcccgtccagccgttcgttgatctctttttccaacgcctgtgtgtcctgcttctgtgtacgggtctcctggtactgcgtcagcaggtactccagtggtgtttcttgattcagtaaccgttcggcctgccaggtcaccgttttgatatacgatagggtgaaaccctgtttctccgtctccttcttcatcatcaaatctgcaaaatcccgcaaattctgccgcgcttgttgccagcccttcatctgcggactggcttgcgcccggtttctcagcgtgttgctccacatcctgctggcttcctgctgttgcaggctttccggccagagggtgtctgcggtgcgcatcatctgcattccggtttccagcggctgtagtggcggggcattcagaagctgttgcaggtactgttcatattctttcagtaccggggatgccaaccagacggtggcggctccctgtgtggtatccctgacctgtgtaagctgctgctgcatcggatacgcctgccaccaccagagtgcagatgcgataacggcagtacaggcggcaccggcaacaaaaccttttaccgtgtcgccctgttttgctttgtcggcgttatctgccacaccgcgcacccccacccgcatttccggcaggtcgggtagggggggcatggtttccgctgtggcggaagccgtgccttcaggcgcatagaccagcgttctgaccatggtctgtgccgccgtatcagtacggtttctgggctgcggctcaaaccgcttgcgtgtgttctgcacaaaataaagcagattttccacgcgcggctggcgcttcagttccacttgctggagtttgtcgcagataagctgcaaagcccgttccgtgcggtagagcaacgaaagatcattttcggaaaaggaaacctgctggcgcaggatattcccggtgcgggtgttgaaccagtccagcatctcagtccgcgccggaccactctgcggccagaatttatcccattcgtggatgatcatcgcagccagcagttccgcgccttcacagaaccctgccagtccctgattacgtgtacgtgccagcgtatagtaggtggcggtatgcaaatccaccccgttggccttaaaaatcgacagcgccagcgattccaccagtttccagttcagctccggctgtgacgggtggttagctttgttaatttcttcgcggatggcgctgaactccggcagggcgcgcggatcgctgccggtaacgatagtttgtgtcagtgcgtaattgctcatcactatccccttaatacaacgtatccggtaaacggaacaggctgaacagaccgccggtgaacgggttatcttcggtatccacatgcacctggtaaaccattgcgccgccgtccacgttaaagcgcacgttaaaggtgtcactggtcacattggtcaactggcccgcgccgaacaggcggaactgcgcccacggtccactgaacgcgatactgcgcggtgctctgccgctggtgccaatcagcgtcagcttgctttcattgccttcacgcatgttgttcggccagaccagatgggcggtgtagttgcgtccctggctgtagtccactaactggccgtccaggttaagtacgctgcgccgcttattgccggaaagcgatacggtttccacggcaaactgtgcgcccagcccgttctgctggctgaagaagatgtcgcggattttctgcgcggtatccagttgctgccggatatcttcacggattaacactctgccgtcgtcgccaaaggtcagatcgttttcaaggaacaggcgcaggttgttcttgtagaaattgtccagaatgccatccggtttaaagaaacgttcaaacgaatccagtgaggcatcctgtgtggcgcgcggattaaacggatagttatcggcaagctgctcgttgaagggtttcactacattgtcgcgccagtccacttccatgtaacgaacggcttccaccatcaccacatgccaggcctgatccgcgagcttacctacccagcggttaagaggcgcaggcagggtttttgccatctgacgggtggcgaagattggatcgctgctgttttgatccagccgtagctgtactgctttcagcgccgatttccccggcactggcgagttctggatcgccagcaggtaacggtgcagctcggtcagttgctggtacacggcctgtagcgtactcgccttgtccttttgctcctccagtgcgctgttttccggtgcgaactcatgccccagccgggataacaggcggtaatccatctcatttatcgccgcttccctcgccttatcatccagtttgccggagagcgtcagcgcgtgggtattatcgcgcagcgccgtcagcgcacgctggaatggctgatcgccgctgataatctgctccagcgcgtcggtcagcgccgacatggcctcatagtcacggacgttgaggttatccattccggcacgccaggtggcggtatagtcactgatgtactgttcggtgatatggcgctggatctcttcacggtcggcctcgctgtaggcgacgctttgcgtcaggttcagtacccacgaatccagcgcggtcagctcaacgaggccctcacgctgtttgacaaaatagctttgcagtccatagcgggtgaggaactgcgggatcaccagtttttcatcattaccggcgacgaacacgttgtcgaaggtgggaccaacctggtcgcgcaaattcaaatcggcgggcaacacgcttaatgctttggtgcgcagggtctggtagacacgctggtatatgggcagcttgctcagttcctgctgcgcattaatgatcggtttatcatagggggtccagcggctgacagcatcgctgtcgctgctttggcgctgcgcgtgccagtcggtgtgctccagcgcatagtccagatgcaccatcagttgcgcctgaatatcgcgctggccgtgaaattcattgctccagcgccgtgccatgtactgttttaccgcctcgttgttgcgcccacttttgtcttccatcatgcgcactacgcgcagcacagcgagcttttcttcgctctctggcggggcaatgtttagatcccggatcaggccgttcattaacgaggggagataacgctgctcaagaagctgaatgtaggtttgctccacatacggccctacgcgggcgccctggtacaatcccatatccgccagaaaaccgtgatcgcgataatcaccataggccagggtggcatcgcgtaccgggttaagcaatggcaattgcagattgccgaattcatccgttccctgcggtggtggtacgtccataaaggctttagcttgtgccagtacgttaacgccagactgccagttctgattgtaataatggtgccagcttccgaccatcaatgccgccagtgccgcgccacaggtggaaaaggcggtcagcctgcgccgggagctgttcagccagacgctgttttcacccgccaggttcggctcagccagcaggacttccgggaagaggcggcgagtaaaatacggcgtcgtctccaccagaggccaggttgccagcgagctgttacccagtccgtactggcgggcggcggactgcgtgaaaatatcatccacctggccacgctgtagcgaggatgtgagccagacgccacgcagcattacatccatgttctcaccgtccagcaatgcggcgagcagtgcggtgacgatttctcctgttccctgcatctgacgggagaagctgaacacagcgctgcggggagcagcaccggtttgtgcgagcaccagatccgacagcgccaggttcacctgttgtacccacgtctgccagaaagcccccagttcgctgcgccagccgtcactttcatgggcgcggcgggtaaatgtgacgccgaggatcgcatcgcggtcttttttatccagtgaatggaacagcgcggcaaagccgttcagcagatccagccgtgtcagcaccacgtaaacgggcagacggcagtgcaggctctgacggatctcctgaagttgctggcgcaaattttgtaccagtgtctcacggcgggatttatccgccgtcagcagatcgggaagatcgagcgtcaggataagaccgttgagcggctggcgagcgcgcgtttgcatcagccagcccagccagtgttcgcgcaggcggcggcggagcagatcatccccgccgggagtggtcagtacgccgtcaacatcgaaaattaccgcctggttgcccactcgcggtgtgatcagcgggtggtattccacaccccggatgctttccggcgtgtaaacaatgtcagacggaaagccctcgcgcagcagcgtgcttttgccgctacccgcaggaccaatgaccatataccacggcaactgccacagataacggcggttatccagatggcggcgcaggcgcagcagccagtgatccagatattgctgctggcggtggagttccacggtcaacggatctttttcttcctcccgctgctgtttctgctgtttttccagcttttgcagacgcttcatcacccgccaggtgagccagaccagagcgataagtccccagacggcggtcgccagccagcggtttgccagcggagccagccagtgctgctcatagagcgtccattttggaccctgccaccagatccacaccagcagaaaaatccatgccagcgtcagtagccaggtggcggaaactttaaaccgcggcatcgctggcctgagcgcagatttcaacgtgctgaacagtcgggatgtgggaaatttgaacacagtaactccttgttatcttttactgttctgccgtgagtttttgttccagtgctttcagcagggaaggctcccattcggatagcatcatgtgtaatcctgttctgaagagcatccggtactgctgttgtgcaagctgaaccataccggcctcttccagtaactgcgcgccgaaaaactggcggtgaaactggtggcggggatcaccttcgggcaggttttccaggtaccgcagcgcggcttccagcccgttttcatcgaagcacgccttggccgcctgtaattcttcatcggtctgtacaaccgggacggtctggttgactgagccggatgatgccagccactgtttcgtctgttcggacacaaacggagtgcggtcgttaaacaacaggttgatcagtgcgggcaggcgggccagaaaatcggtaacttcatcacggatagcatccgccacctgtttataaccgaggcgcagcgcggtctgtgctgagaggtaatgaccgtccagccagtacggggccagcagcaggcttttttccacctgctgccacagcgccatgtcggcattgttcagccgcgccaggtaatcatccatcatatcgacagggaaggctgccagtggggtccggccatcgctttctgcctgcggggtactggtgatggtttgccacagcgcatggcggcgcagtcggtaaccctgcggtgactccggctggcgctcacagagaatggcggccacctttagcagggtgtcgcgccatgctttatcgtcgtggttttcaacggtgacctgcgggattggagtggctgcaacaggaggctgagcggcaaccgtgtgcggtgacatatccggtacatatccggtcgtggcctgcggcgcaatggcggcgcttcgtgcagatgatgtcatttcaggcgctacatcacgaaacgcgcgctgaaacagggaaaataaatcgtctgtcgcctttgccagctcagacgcgttgtgcgcctgccagcactgtgccagttttgccagctctcccagcaaagcatcgcgctgtattgtcgcagcattcccggcaaagtcctgaacggcagactcaaagcgttttatcacctgggcggcaaagcgttttttgtgggccatgttctgcggtgcggcgcatgtccagtagtgctctgtatattgtgccagcatcctggaggccagcagaatatcaccggcatgttgcagggtacgcagcaagtgggccagcaggcgaaaatctttggtttctgaggccagaagcatcaggccccggcgctgaagttccgggatatcaagctggctgtgcgccagtgaaccgagcttgacgatttcgctgtcgacaaactcccagtctgcattgccatcatcaagcgcggcggacagcttatcttctggcaggttttccagcaggtgtgcaagccatacatcgggattacgtaagtccattgccatattcttattctcccgcccagtggcaggcgtcgcgtagcggcgcaataacccgtgccagcccgtcaatgttaaaggtcagctttccggcggcgttgtctgtgccggtatccaccgtcagcgtttttgcgccgaacagttgcttaatttcatcgataccggataacccccggctggactccagcagggtgccgttctcgcgcacaaaccagtggctgcgcaatgcccggctgtcggcattcagggtgacggcgatatcatggacatccagagggtgcatcagcgccacctgcatccgggtgatattgtccacgcaactgaacatcagcaccgggcgtggcggaacatggccgatagccggggtggttatcaccaccgtcgggcgttcacccggtacttgcgttaccagcagctccgtggtgttgccctggcggcgtttttcctgttctgtcgcgcgggcccaggcttcaccttggtaacgagctttcaccagtgcggcaccaccaaagccagcctgttccggcgcaagaatgcggtcataacagtcaagccgctccagcgccgccgtctcctggcggcaggactgcatggcctgtaacgtggctgtcgcatccggcggtgtcgctgtggcgacagctaccgccacaccggccactgacgatgtttctgtgggcgcggcactggcgggtaagcccgccatcaggcccgcgataaaccatcctgtctgccggaaaacgcacaacctgctcataaaaccgtttcgtcctctgtttgcggtgtcacggcatcatcaggcagcgcatcttccacatctgccgtgaacgcaccgtctgccgccgacaggcgaatccgggcaatcgccgtgttggccgccattttctgcaacagcagcagcgagagcggcggcagcatgtcgccgtcgataaccgattccagcatcctcgcgccgttttccgcgcgggtgacgcggctcatgatttcgtccgtcacttccggcccaataatcacgtccgcgccaaagcggctgcgcagcacgttatccaggcgggccagtttcccggcaataatggtagcgagcgtctctttcgacagcggtaggtaaggcaccacttccatgcgcgccagcagagcaggtttaaagaagtccgccagcaccggatagagggcttcctgcatggtttccgggtcatcggcgtgttcgacaatcacctggtagccaaggttggaggtcaggaagaaaacgatatttttacagtcaatcaggcggccttcaccgtctgccatctcgcccttgtcaaacgcctggtagaacaggttgagtacatccgggtgcgctttttctacttcatcgagcagcaccaccgagtacggtttctggcgaatcgcttcggtcagtacgccgccttcaccgtagccgacataacccggaggagagccaatcagccgcgaaacggtgtgtttctcctggaactcagacatattgatggtggtcaggtattgacgtccgccatagagcagttccgccagttgcaggacggtttcggttttacccacgccgctggggccagccagcaggaacgcaccaagcgggcgtcccggacggcgcaggtcggcgcgtgcggtcagcaggtgtttatgcaggctggcaatcgccaggtcctggcccttgatggtgccgccgagccataccggcaggtcggtgatgaccgacatctcattctgtgacaggcggttaagcggcacgccggtccattcagcaatcaccgctgcaatctgttttttatcgacatgcggggaaaccagcaactggtcgttatgcagggcgtccagttcggcagtgagttgtgccagccgttgtaccggggaaactgtttcagcggtctcttccggctgtacgctgcctgcatcatcagccgattcggcatcggtactatcctgttctgcctctggcggcgtatcctccacggcatctgcgtccggcaacgacgcaacgtcgtcttctgccacgcccagtaactgctggcgcagcgcgataatttcctgtaccagcgtctgctgctgccaggcgacttccagttcgtccagcgccgacagcgtttcatcatactgctccaacacctcagtcattcgtgaggtgtcggtacgcagcccgatgcgaagctcgcgctcaagctggcgaatttctgcctcctgctggtggctcagggtggtcagtgccgagatttgttttggcggcgatgacaggttgatggccacacgggcgcaggcggtgtccagcacatcaatggctttgtccggcaactgacgcccggagagataacgctcgctcagtgtcgcagcggcctgcaaggcgtcatcatcaatcagcacgccgtgagattgttcatagaccgccgacaaaccgcgcagaataatggtggcttcggcagcgttgggttcgctgaccttcactaactggaagcggcgcgacaaagctgcatctttctcgaaatattttttgtactcgctccaggtggtggcggcgatggttttcagctcgccgcgcgccagcgctggtttgagcaggttggatatatccagcccgccctgctggttgcccgcgccaatcagggtatgtgcttcgtcgataaacagaatgaccggcaccggggagaaaatgacctccgccatcagccccttgaagcgtttttcaaactcacctttcaccgacgcaccggcctgcaatgcgcccaggtcaagggtcatgatatcggtgtttttcagcttgtccggcacctggcctgccacgatgcgcagcgccagcccttcaatcagcgcgcttttacccacgcctgcttcgcccactaccaccggattgtttttacggcggcggcagagaatgtcgatcatcaggtcgatttcatagttgcggcacagtaccgggtcaagcctgccgttacgggcgtctgcggtcatgtttttggcgtagcgggcaagcagggtgtcgccggtttccgttgcgcggggcgtttgcccgccagccagatccacggattcggcggattcttttgtccatgctgcgaaatcctgctgtaactggtcgcggtttatggccgtcagcagacgggcagcagcgggtggaatatagcgcagcggtgaatgcagcagagtaagcagcaggacgccgctgcgcagttcgctgtgctgcatctgggctgaggccagcagccatgactccttgagccattcgatcagcatcggggagaagctgggatagccttcggcggaacgtccaccgggataactctccacggtcagcgcctggcgtaaatcctccgcactgatgcctgtgcgttcggcaatcacccttacgtcgttgcgcgggattgccagcatctgtaacagcacatgggcaacggtgatctcactggcctgctggctcatacactccgaggcagccatttccagcgcctgttttgcaaaggggttaagccgctttacgagcgtggctaaatcaatctggatcataagatgtccttatcggagtaatttattgagctgatgcagaatatcctgtgtctggctgtccagacgcagcagataaaacagataaaatacggtcagcacaacaagaccgccgcacagtacatgcttgatggtcagtcgtcggattaactgataacgcccaccctgtatgttgttcttctgatgaagtagcggaaatggcgcgtcaccgcgcagtttgtgcagggcatggtgcaggcgctggtagatccgctcaaattcatcctgttgctgaatggcaaccttgtagcgcccgcgaaagccgagcgaaaaacagaggtataaaaattccagcagatcctggtaacgtaccggctcccggatcaggcgttcgagcaggataaacactttctcgccgccccaggcttcgttatgaaaatgaaccagcagcgactgtttgatccattcgtttttgttggaccagccgttgcccagcgccgcttcatcaataaacgtgcagagaatgtaacggaacgaaacaatgacgcccggttcgtatccctgttcctggagtagttgctctacggcctggacatcggttactacctgggtaaacagatgttccggcatggcctgactgttcatagtggacagacgcatcaccatgccgagcaacggcgtggcggcgtcaatcattggattcaggctgttgccgcgaagggcgagacggtactggcgtcctggtgttccgctctccggctccacgggaaaaaccgacgcttcactcatatcgctcattcacttatccccttatagcccagagctggaggttcagatcggggaagctgccggagatatgcagcgccagtgcgcccgcttttatcacgtcctgccaggccggggtgcctttttccagttcgaagtaaacataaccttcgtggtatggcaactgacgtggcgcagcggtaagcgtgtgcagcggaatacccggcacctgcacgctgaccacgctgcggattttgtcggtagcggccactttcgactgctggatgaactggcgttgtacctggtcgtagggcatcctggcgcgcactgccagtaccagcttgcaggactgcaacaatgtgggatcgttgatggtggcgatccaggtcccctctgaaaagaacaacggcagattctgcgcacgcggcaccagtacggtattgagcgcgcgccgcagttccgggatcacggttctggtgaaggtcgcggtaagatcccggtgattatacggctccacggtgcagggcaggcgattaccttcggtaaaggtcatcagttctcccagcagccccaccagatcccggtagaaggcttccggatgcagcgtgtgcagttgggaacgatgcgtgaactgcatttgatagcggttaagcatctgcaacatcataaattcggccacatcggcgatcccgctctgttcaggcgaaccaatgcgcccggccaggtcagcggcgcgggtggcaagcagtccctgcacctcgccggagaatgccccgagcaacccgctgacacggacggcctgaatggtgggaataaaggtgttgtccagcaccagcgcgccggtggcatttttattgaggatacggcacagggggagagtcaccatcgcgctgagatcatctgcgccgctgactatcctggggatcaactgccccagaccgactggctgttcgtcgccttcgtcagtgtgaaaatcacggacgcgggtatgggtgaggcggtaacgctccgtaccctgaccggcgctgtgcaacccctggatttcattgatcacgtcgcttatcaccggcagcgccagataaatattgtggctctctttcgatgaaagggttcccggctggaaaggttccggcagcagatcctggtcgggaatgctgaatacggtgccgtcaggcatacagcccgccgcacggtcaatcatgattttgccctgggcaagcagttctgtattgatggagagttccgtaaaaccccagaaaaaatcacccagtgcatccagacgacgggtcagcaggtactcgcagtgacgctgctgttgctgaaaatgctgcggcagggcaaacagcccttcctgccagatcactttgtttttcattgttgccatcgtcagttttcctcttttttcatctcaatcgcactggcgcggatatgcaccagcaggcgatagtggtggccgatactttctaccgactcaatttgtttccattctgtggcctggtcgtctgaaaaataggcaatgacaccgatataaccggttttctcatccaacttgatcggcggcagtgtttttacggtatccggcaacaggttgaagtcctggtgatcgatatagtttttccccagcacgtcgggcagcgcggtggtggcaacctggtcgtagtcggcggcatggaattttgagtcgtcgctcagataaaccaactggacatccaccggcgcggcttcgccatccgccgtcaggttgctgtccggctcggtcagcagcgtgacggtcagctcggttgactgatccatcagctttccgacctgaatatccggattgcggatcacctggctgatttttttcgctgtttcacagccagttaatacgacgctcatcagaacgcaggccagaaacgctttgccgttcatgcttccggctcccgctgtgtttcgcgcagcacccggtcatagacctgggcataaacttcattgaacagcatttcaaatccctgctgtcggctggaggccagctcatcgtaatagttgctgtacatctgccatgcccaggcgtcgtccattttctggcgcagttcatggctgcggcggtattgcgcaaagcggcgcatcaggttgcccggcgaaaaggcgtccagcatgacacgcaacgcttccacaatcgccgcccggttagcctcttcatgatgccggatgttgcgcaggctttcggcgatggccgcaggtgctgcgagatgtaccgggcttttaccctcggcgaacatgacgttcagcgcggtggcatagtccatatcaaggcgcaacgggttgtcttctagtggacgcaggtgtttatccgacaggctgttctgttgttgttgcagactcagcaatcccttaatggcggcctgcaacgcccgtccggcctcttcgagaaactcatccgcatcctgagaattgtgcagcgtcagcggacactccataccgcgcagcagcggggttacggccaggtggtactgcgccatggcagaaaattcatcgccgtcctcatgacgggcattgccgggcggcagatccataaacggcgtgttgatcccgtttgcacctgtcagatcggatgcgggggctacgggccgggaaacgcgtggggcgatcggatcatctgccaccatcaggctttccgtctggagtgcctggagcggatcgctggaaaaaccgtgcgccaccgtgggggcaagctgatgctggaacggcattcccggatacgccggttgtccctcggtggtcagcagggtgtccgccagactgtcgcggttcattacaatcgtttccggggtcgccatccgctcgtcataggtaacagctgcaccgtcatgcagaaacactttcagcgccagtgcgccgagctggatctcatccccctggcgcaggcggatgagcgcatcggaagaggccggggccagattaatcatcagtcccggcgtcaggcaccgcaggcaataggctccgtcgtgccggataacggtacaggcacgcgcagcaatgcttcccgcccggtcctgtacctgccagtgacattccggcgtatggccaatatcaccgccgttttcgctgaacaggcattttgcggcgcgtccgctttccagttcgttgccattcatcacctgtaaagtcagtgaggcctggcgggattgctgtttttcctcagccataagtggttccatagaattattccctgattcggattgtgatggcgggcggtactttcggctgaccaataaagctggttctgccgaggcgggagctggccggatcgctaaggcgcatccctttagcctgctgtggcgccaggcacagccgtaaatcccaggcaaactggtcgcgcagaataaaggaaaggaacatggtcagcggcaggtgattttcgccatcgggtaaaaatgagagataacgctcccgcgacaggccgccaatctgcaacaggaattttccgctgcgatccggcacccgtgcgccgagggtaaaattaacgccgagtatggagcgtcccggaatatgtccagccgtttttcctttcggattacgtacacccagccggttctggtgtgccggatcaatggcgactttacgcagttgccagcgttcaatggtgacatccggcaaatcaaaacagtgcgacaccagattacagataacctccggcgcgcggcctggtgttgccagaattccggcgtaggccagcattttgctgtggttaatggcaagcctgtcacgcacgctctgattacccagcccgaccagtgcgtacatgcgctgtgaaaaggtgtcagtaccgccgctacgaaagcagatgtagtagcggtatttgcgccaggcatgataggcaaactgtgtccagcggtggctgaatagatcgagaaattctttcaggccgtcttcgttctgtgcggactcctgcgccatctgatccagataatagcccggtagcggcgactggctgccggaaaaacccaggaaccgggtttgcagtacatactgtccgttctggctacgggaaagcgcactcaggtccgtacccggaaaactgatactggcgtcagagctgaaacgcacgatctcccgggcaggctcggtacgcagggaaatgtcctggcccggcgcgccatgccgacggtacagcgcctccatcagcacatagaaattgcagttgcgcacatccgccggtaacggcggttttgtcgctatatcagggcgtgctggcccattttctcctgccattcccaggactcctgactttccgtgttaatgattttcagacagtggtacgaattgatgctggcgtagagggcaaagaagtgcgagagcacggtacccagaagataaatttcaccttcgcagataaacggatcgggacgtatccacagcgtggtcgccagcccgcgaaccggtacgcctttaaacaacctgtcaacaggtttggtttcgagtttttctatggcatccagtttctggcgtgacagtctggcccgctgcggatggtgagcacctggcaggtcgaaggtccgcaggatctggatcagtgtctccctgtccagcagggagaggtagttcaggttcatcgcggaaatcagcgaccagtgcatgtcgccgtccgtgactggccagagcggcagtgtcgggcgcgtgacattacgaaatgaggccactgccggatttttgttgacggccacgcagatatcaccggtatgcagccgggcagggatcatacggttggtacagattaatgacgtggtgatcacgtcatcgttaaaccgtgagctgcccggaatgctaccgtctgcatggacaaaggcgatagagtgttcaagcccgtggtgaagcagggacgttttagtccggtgatgccagtagacgacttctcgctggcggctgtactccatctggtgctggaagctttcaaattcgggccagacacgcgcctggctacctgggctgatttcagtacctgaaactttgactttactggtgactgtgctgacctgaaaaatgtcataggcgtccggatgcttatggctggcgcgcagcgggtattccgccatccgcccatccggcctgacgggttccgcataatgcgtaaacaggttaatggctggcgtacagtgcagacgcagcgaatcctggcgcagcttgatgtcggcaggtaacgggcggttaaagtgcaggcgcagcgtaaacgcattgatcgggaaatcgtctggtagcggcgcaacatcgcgcagatggaaaaagaagaaggcttcgggatagcagaaatactcctgaagcacgcggtagccgctgtggacatttttcggccacggcagcagagcatcccggttgtcaaaacccgccgcctccagccacagatccggcagcggcaggcggtactctccggcaatcagttccgcatccatcaggcattcgcaaaaccacagataaagctggtgtcgggtataatcgtcttcattacccagccagaacgtgattttgttcaggtcaagcatggcgggggagacattgttatctgcggtaaaactgatatctatgatgccttctttcaggctgctggcgttgcgggtatcgagaatgcgcagtggttgcagccagatatcgcgcgccagcgtgaaatggcaggctacggaagaaacgattttatcatgattgtcaggcagcaccttctgagcagtcagggaggacttttctgagcggcttctgatcagttcattacgacagacctgaacagggacttttaactgatcggttttgggttcataggcaataaccgtcatggccggaaccgggcgtaaatagtttgcccacagcatacggatcagcccatgggtgaactcggggaattcgtcctcaagtttctggcgcaggctaccggacataaaggcaaaggcttccatcagacgctccacgtccggatcaccctctttctcggccagaaagtgggccagatgtggtttttcctgcgccagcagtttgcctagctggcgaagataatccagctcttcgcggtagtaacgttcttcaaaagccacagagatcactccacacaatagcgttgatggttgtccagcaaaatgtcaaattcaaacactcccctggtttcgctgacatcgaccgtagccacaatatgaaaacacagttccacaggggcgtattcatccggtgcagcagccgtaacaacaacatcggtaatacgaggttcgtaatgtaaaatgcactggctaatggacttacggatttctcgtctgaaatcgctggaggccagcgattcatcatttaaatcagtaatccccagctccggtgaaccataacaactgccggagcgggtattcaggacctgtcgcaggttacgtctgatggaacgtatcagtgcttcttttggattctgatatgaaggcggatttgccgcctcacggatacgttcaaaaagactgccggttggtcctgaatcccgtcttagcatcggattattccttatccagtcgtccgaccaggctcaggtcgaaactggcacccatgtatttaaaatgcggtctgacagaaatcgcgacctggtaccagcccggctcaccatccacatccagtacctcgatcttagcctgacgcaaaggccggtggctgcggacttcggcaggcggattttcctggtcagcaacatactggcgaatccaggtgttcagctcacgctccaggtcactacgttctttccatgagccaagctgttcgcgctgaattaccttgatgtaatgcgctaacctgctgataacaaacaagtatggcagctgggtgccgagtttatagttggtctccgcagccttgccttcgggggttttggggaatgttttgggtttctgcaccgagttggccgagaaaaagcacgcattatcagaccctttacgcatggtcagtgtgataaagccctcttccgccagctcatactctctccggtcagtgatcaacacttcagtcggaatttttgcctgcatttgccccatggattcatacagatgcaccgggaggtctttgactgcgccgccgctggaagggccaataatatttgggcaccagcgatacttagcaaaactttccgccaggttggcggccagtaaaaacgaggtattcccccacagataagactcatgactctggctgacatcttcatggtaacggaaggttttgacagggttttcatccggtgagtaagggtggcgcagcaggaaccggggggcggtcaggcccaggtaacgggaatcttccgattcacgcagggcgcgccagcgggagtaggccgggccttcaaagatggcacccggttctttgatccccggtaactctgtccatgaatccagaccgaaaaattcggatgatactgacgacaggaacgggctgtgcgccatcgcgctgacctggctgatatatttcagcagcttcatatccggcgtggtgttcttaaaggcaaagttgccgattaccgccgccactggctcaccgccaaattgtccgtaaccgcttgaatatacatgcttgtaatacgcagactgcgtgatttcaggtgcaaattcgaaatcatccagcagttcttcctgagtgacattcaggaaatggactttgatgttttcccgtgtatccgcgcgttcaaccagcagcttcagcgagcgcagcagggattccagttcctgaaactccggggcatgaataatggcatccatctgcctgctggttcgggcatcaatatcagcaatcatggcgtcaacggccaggatattgataggttcagcgctactgtcgccctgtaacatggcggcaataaaggcgctcacgccctggcgggtgatatcgtagctttctgatttaggctggacgcgggtttgcgccatgatttcatcaagcagagatgggggcgcggcggtttgagacgcgctgacgggagcaatttcttcctttactgacatactgaatatccttctgtgaaaattatttctgaacggcgatacccagttcctggatcagctgctcgcgggtgtcttcgttttccagtagcgcctgaagttgtgcgcggaaggctggaatattgcctagtggagacttaagtgcgactagggcttcacgcaattcgagcagacgttttatttctggtacctggctggcaatatggtcaggagaaaggtcatccatagatttgactttcaggttgacgtacatttgctcattgggagcgtcactgagttcagccggaacaacaaactcccgttcaatgtcagcttctgaaatgactgcgttgaggttatagcggttgatagcaatggcagttcgctcatccaacggcgtgttatctggtttccctttcagattgccggtgatcaataaattcagcggcaattcgatatcagcagccaccccatcaacttttggtgtataccgaacgctgattctttctttcggcgcgacactgccgccattgttgttcattttgctcataaaaatgttcccgttcaggccatgagcacagcattttcgtactgcatacaaataccgacaataccgtttcagtggcagttagataatgtaaccttccttctgttgtgatcggtattctactcatgaaataaaacattaaaagaactatttatatttttgaaagagatgtatccttcattattaatacataagagttaaatcaatttggtatttatagacttagtgaatatgattttacggctaataaagttacataatgcattgatttatatgtgtttattaaattgattaataagttttatgtatggttttataaataaattaattaattgctagaaatacatcataagaaattcctttaaggaatatcttaattgcgtgccggaacgattgtgaagtaagtgttgtaatgattgatttttgaagaaattgtaggtttttatgggggtaaggatacgttatggataattctactgttgatgttgatatatttttagcttatgtaatcgtgttctgaaattgactaaaaatatatttaaacaccataaaagagtttttcggtaggtgctaattacgtgtgcctgtaactcgaataaagaaaagggtgtggttcctgatgtgagccgcatcacactctaacctgtcggggattaacgacgggttgttcgtaaaacagcagttgataatttcacaaggagttcataaatgccaaccccatgttacatttcaattacaggtcagacccaggggaacatcactgccggtgctttcaccgcagattctgtcggcaatatctacgtgcagggacacgaagatgaaatgctggtgcaggagtttctgcataacgttactgttccaaccgatccgcagtctggtcagccttccgggcagcgtgctcacaaaccgttcattttcaccgtggcgctgaacaaagccgttccgctgctgtacaacgcgctggcctccggtgaaatgctgccgaaagtggagctgcactggtggcgtacctctgttgaaggcaagcaggagcactacttcaccacacgtcttactgacgcgacgattgtggacatgaacctgcatatgccgcactgccaggaccctgcacagcgtgagtttacgcaattgctcgcagtatcactggcctaccgtaaggttgagtgggagcacatcaaatccggtacttctggtgccgatgactggcgtgcaccgctggaagcataaatctgagtcaacaacatcctgcctccgtgcaggatgttgtttttgtacgtgtaaaaaatgagtgtcagtaaggagttacgctttcatgagggagatggtggatgccggaaacccgggcggtagcgtacctgaaaatgtaaagatgagtgtaacgctgcactggcaccctttgctgcatggtgggaatcatttggtccgtgaatgaatcagggaggtcattatgtccttaaaaggtcttcgctttacgctggaggttgacggccaggagccggacacctttgcagtggtgaatttccggttaatccagaaccagtcttatccgtttgtgatgagtgtggatgtcgccagcgattcttttatgcagacggcggagatgctgctggagaagaacgcaacgctgactatctggcagggtgtcatcccgctgcgttatgtcaccggcgtggtggcgggctttggcatgcaggagaacaacggctggcagatgcgttatcacctgcgtattgagccgccgttatggcggtgcgggctgcggcggaacttccgtatcttccagcagcaggatatccggacgatatcggccacattactgaacgagaacggcgtcacagagtggacgccgctgttttatgaggaccatccggcgcgggagttctgtgtgcagtacggggagtcggacctggcgtttctggcgcggctgtgggcggaggaggggattttcttctttgagcggtttgcggcggacagtccggagcagaagctgacgctgtgcgacgatgtggcggggctgtcacaggcgggggagcttccgtttaacccggacacatcggcaggagcggagacggagtgtgtcagtatgttccgttatgaggcgcatgtccgcccgtcatcggtgcagagccaggattacacgtttaaggtgccggactggccggggatgtatgagcagcagggtgagagcctgaacggacagcttgaacagtatgaaatatttgattatccgggaaggtacaaggatgaacagcacggcaaggatttcacgctgtaccggatggagagcctgcgcagtgatgcggaaaaggccacagggcagagtaattcgccgaagctgtggccggggacgtggtttacgctgacggggcatccgcagaagatgctgaaccgtgaatggcaggtggtacagagcattctgtcaggagaccagccgcaggcgcttcacggcagccaggggagaggaaccacgctgggaaatcagttagaggtgataccggcggaccggacgtggcgtccacggctgcaaagcaaaccgaaggtggacgggccacagagcgccattgtcaccgggcctgcgggagaggaaatcttctgtgatgaacatggccgggtacgggtgaagtttcactgggacaggtataacccggcaacggaggcgagttcgtgctgggtgagggtgtcacaggcgtgggcggggccggggtttggtaacctggcgataccgcgcgtgggccaggaggtgattgttgacttcctgaacggggacccggaccagccgataatcatggggcggacgtaccatgaggacaaccgttcgccggggagcctgccggggacgaagacgcagatgacgatacggtcgaagacctataaaggaagcggctttaatgaactgcggtttgaagacgccacgggcggtgaacaggtctatatccacgcgcagaagaacatggatacggaggtgctgaataatcggacgacggatgtgaaggctgaccacacggagaccattggtaacgaccagaagataacggtggggttgggccagacggtgaatgtggggagcaaaaaggaaggtggtcatgaccagaaagtgacggtagcgaacgatcagcatctcacgataaaaaatgaccggcacaaggttgtaaataacaaccagacaagcaaggtgacgggaactgataccgaagaagtcgtcaaaaaacagagtattaaaataggtgataattacgaactgaaagttgagcatggtacaaatatcatatctggggacagtattgagctaatttgtgggcagggagagagcgggacttgttccataaaactggagaaaacaggaaagataataatacgggggacggagtttctatttgaggctaccggtcctgtagatattaaaggaaaagatattcatctgaacggatagtgcaggatataaaacatggtgattgtatttgctttatacgcctgtgaatcaccatttgtgattgtttaaattaatcatagcatgacttattcaggaatcaataagcatgatagaaatgaaaaataacacgccatttcctttgttgtcatttgaaaaatatggtcgttatggtcttttgtttgatgttattgctattaaaatgtcattgcgaattaaaaatggattttatgctgatcttgctgagtttcaaaaagaattgtccatgtctgatgaatactatggggagtctgaaacaagtagtctaaaatctgaaacagacttagttctttgtaaaagaaatacagatattcacgtgacaggtagtgctcatgccccttcaggggataagtctcagtggaaggcttgtgtgagggttaatagtttttctaaagaactgagtttatctggtgtccgctacttacaatatgagcgaaatcgttggcagatgagcttaccagataaaattattaatgttcctctacgctatgagcttgcttacggtggtatttggcaaccagatggtatggagaaattggttttttcagcaaaccctgtaggttgtggatattatcctgatatttctcaacttaatacaagttgtcaatataaactcccacaaataaccagctctgctttgtcagaaaacgctaccatttttaatggggaatctgacttttttcaaggtgttggccctgtatctcgatggtggaaaagtcgcctccagtatgcaggaacctacaatgaagtatggcgtgaaaagcgctatccctatttgccggatgattttgatgagcggttctacaatagtgctcatccggatatgatatacacggggtttctctctggcgatgaaaacatctctcttgaaggtttttttaaatttgaacaggttgttaagacaaaattgccaggtatacgacctgtacttatattaaaaaccaagcataatacatcacatatgttcttacctgttgcggatacaatggttatcgatttaagtcgacaggaaatataccttacctggagattaacaatacctgatttttttggaatgaaagaaggagtgctgagttgtattattcctgaatgtatagggaaaaaatattatgggtaactatcatatcggggatggtgaatgtagatttagagtcgtgtgttcttcaccagatgtatgtgaagtaggaggttacaaggttccttttgacagttaccagactttagatagtgaaagacagtacagttcaacggtatgggcgcgtggatgcagagctttaaatgttggttcagtgattgctggaactcaaagtaatgccggtaaaggtgtcatatccggtacatctcaaggaacgggtgactgtgttattttaacgggaagtccgactgtaacaatagaagggaaacctgttgcttatcatggttcagttgttgggattaataaccacaactgccttggtaaattgtataccaaaataaaatcaccaatgatttctgtcattgatagaacttttaattatgaaaggactgctgaagtaatacacgatttactgcttctgaaggatctcctctctgttggtaatatttttgacggagatatttcacctgaggttaaaaatgatttatttcaaataaaagatcctgaccaatcatggggggagtttttttcaataaagaatatcagagaatctctcaggaatggtattgaaggagataaatctcagatcagagaatggtttggagagaacacacttactcaaatggggaatggagcaatcaccactttacatggtgtggcggatttagccttagttacattcgatgctctgttagatacggcaacggcaacggttgcttgcccgataggcgaagatgggttatgtgaacaggcaaatataaatttaaatgaaaaagaacaggctttatttaatattagtaattcattgataaatgggcaagcatgggatgcacttaaaaaaatgataatggatacaaataatggtgatcagattgctctggagcattttgccagctttttatggggctttatgatacccgcaaaaataccagaagaaaatatctctgggaaagtatttgtagagccagtagttttagaaggtggtgctggtggcaattggacagtatttgatgaggttttagattcaaatgtaataaagcaattgactttaacaggctgtggagcggcctgtggggaaatgttgcttagggataggtatatttttgtcacgcaaaatgtaattggaacagaattaacatctatgacgtcgctggcaaacaagcttaataaatttgatgtcggctgggaagggaatgcagtgagcgaatctagtttatatgccctcagtaatactggttcatggggagcaatgatgtgggattctggaagtaaagtagggcattgggtacttgttaagggtgttgatgatgctgggaatgtgataatatatgatccatatcaagggagtcgatatctgatgactgaacaggaatttaaggaggtatggaatgggcatagtgtttacaaaccataatattgatttgttatcggttgaatttgatgagattacaaaaaattgtaattacacttttagtgtagatggagagacggctatctttactgctagaatatcaataataagaaatataaagggaattaaatatagcgaagaacttgataaatttataatgtcaataatgccattgcagcctaaagtatcaaaaattttgggaggtgttacttgggattgtatttgtggtaaggaagttggatttcctgtgagattaattggtaagtgaagggtggtgaggtatttctatatttttttcgtgaaagtctttaaaactgaaattatcttgttgggagcccaaggtgagatcataaaacgtattattttataaatattgttatgcagggaaaggtcaagtaatgctgcttttttgtactaaataattcgcattttatgttcaataattgaggtgttccttattacctaaagctgtttttcattgcttatacatgatcaaatactcattgcctaattaagggggacaaaatggaacttaaaaaattgatggaacatatttctattattcccgattacaggcaagcctggaaagtggaacataaattgccagatattctatctgttaactatttgcgccgttatttctggtgcataatgctgggaagatatagaggatttggggaaacacatctcgattttttgaagtgatatggtgattttgaaaatggtattcctgttcacgatatcattgccagagttgtatcctgtatcagtcctgcaaaatttcatgagtgctttattaactggatgcgtgactgccattcctcagatgataaagatgtcattgcaattgatggaaaaacgcttcggcactcttatgacaagagtcgccgcaagggagcgatttatgtcattaaaatccgtcttcatattatttgcgatgtccctgatgaacttattgatttcacgtttgaatggaaagagctgaagaaattatgcatggcagtctcctttcgttcaataataacagaacaaaagaaagagccagaaatgacggacagatattatagcatttctgctgatttaaccgcagagaagttcgccacagcgaaccgaaatcactggtacgtggagaataagctgcactggcatctggacgtggtaatgaataaagacgactgcaaaataagaagaggaaatgcagcagaattattttcagggatacggaagatcgctattaatattttaacgaaagataagatactcaaggcaggggcaagatgtaagatgtgaaaagcagctgcggacagagactacctcgcgtcagtccttgcgggggcgggctttcgtattcttgctctgcaagggatgataaaaagtgcaactttattccacgcagctatttagacagcgtacagtaaacaaacgaaagttgttatttcaatggtcagggcaagagcatgaagtgtttactacacactatgctcttgtcctggagtcaggtcttgtttggagggataaatggtagatattgtcgaggccgataaaacggatatttatttcattcaggagagtgtttatggcaaaatcgggttgccagcttttggtaatacaataggaccatccgcacagcaagttgttaaaaaggtattcgctgtcgttaaagaacgagataagacacatgcaaaacagagattattgttggaatataatggtaacaaactctggatgaatgctattgatggcagtgaagctatcctaccaacagaattttctaagcgatacgaactttcattattcaatactactaattttggagaagatccttttcctgatgttaatttatataataatatgaaatcaagtttttttgtaaggtttggtggaacatcccatcccgaggcttgggctatttataatgcaagtacgaaagaggttaaatatatagaaactgcaagagaaattgataaaatattcagtgattttaacttgagtggtacattgccaattcacattggtcaatgattttttaaattgtgtgattaaataattgaacattaatgatgatttatagcatcattattattctataacatgaataaacggattgaatgtgttatgttaaaaatgagtttatacgtaataatattgttattttcccttcagtttagtgcagccattactggcaaggaaagtgaggttgtttcaccattattaatggatgttaatccttcactaacaatggaaaatatttctgaattatccacatcatcggaaccatcgcaacagggggtatttcctgtaatatgtactcgacttcatcctggctccgtaatgaaacgtcagttattaaccggctgggggcctgtttttataattggtgatgatcctttttctctgcgctggatgagtgaacatctggagatccttaaatcgctaaatgcccttggtttggttgttaatgttgaatcagtagaacgaatggaggtattacagcagcgggctgatgggttattgttattgccagttatctgcgataattttgtgcaagctctgcaattaaatgcttatccggtattaatcacagagatggaaatatcacaatgattaataacataattactgctaataatatggtgattttgaaaatggtaatcctgttcacgacaccataatcagagttatgtcctgtatccgttcagtaaaatttcacgaatgctttattaaccggatgcgtgaatgtcattcttcagacgacatagacgtcattgcgattgatggaaaagcacttccacactcctgtgataaaagtcgtcgcaggagagcgggctttcgtagtcttccccgactctccccggccctaaacacaacccccactcaccacaacctaaactcatccgcatcccgccatgccggaaacttttctctatattcccgcaatgccatcatcgacagctccgcatcaatgcgcgttgcctgatgcgcgtcggcagtagcgataatctcgccttgcggattaatcacccggctgtcaccgcgataatggcagccgttgccatcgctgccgacgcgattgcatcccgccacatacgcttgattctcaatcgcgcgggctgtcagcaatgcctgccagtgcagagagcgcggagcaggccagttggcgacgtacagggcgaggtcataatcgttgagattgcgcgaccacaccggaaaacgtaagtcgtagcacaccagcggcaaaatacgccagccgcgccattccacaatcactcgcgcattgcccgctttataatgtagatgctcatctgccatgcggaacagatgacgcttatcataaaaatgtaccgtgccgcccggctcaaccagcaaaaagcggttaaccgaaccagactccgtttgtaatgcaacactgcctgcaatcagcgcattgcactgctgcgctttagcggtcatccagttcactacgtcatcttgtgctagcgacgaagctgccgcttccatggcaaagccgctggtaaacatctccggtagaacgatcacatcgcgcccggtaataccttccagttgacgatcaaaatggcgcaggttggcaggaccatccatccacaccagtggttgctgcaaaagcgtaatcttcaaaccaggcacggtgtacaactcctttatgcgaagggttttataactctaacaccttatcaggcagttgccttagcgcagaataaattgataacaaatgctgatattggaaatatctgatttgcaaattatcgtgttatcgccaggctttagggagttaatcacatgggcaggataagcccgggaggaatgatgtttaaggcaataacgacagtcgccgctctggtcatcgccaccagtgcaatggcgcaggatgatttaaccattagcagtcttgcaaagggcgaaaccaccaaagcggcgtttaatcagatggtgcaagggcataagctgcctgcctgggtgatgaaaggcggtacttatactcccgcacaaaccgtgactttgggagatgagacgtatcaggtgatgagcgcgtgcaaaccgcatgactgtggctcgcaacgtatcgctgtgatgtggtccgagaaatctaatcagatgacggggctgttctcgactattgatgagaaaacgtcgcaagagaaactcacctggttgaatgtgaacgatgcgctttcgattgatggcaaaacggtgctgttcgcggcgttgaccggcagcctggaaaaccatccggatggctttaattttaaataattagccgataaaaaaacggagccgaaaggctccgttattcaattacgcggcttcaactttccgcactttctccggcaactttaccggcttcgtcgccagctcttctggatcaaagtcatcaacgttaatactgcgtaaacggctttcttcagcttttaccagaatagcggcttcatctttatcaatcagccccttcgccagcgcgttgtgcgccagttcatccagacgggtaaacggcaggtttttacccaactctttacagatccgctgatgaatcgggtcggcggcaatcacatccaccagcgcctcttccagtaaaccaaccgggttatgctcgcttggcgtcaggtactgaccgcgaccaatacgtgaacgagtggcgttcggtacttgtaaaatcttcgccactttatgatccagcttgtcagacggtgccaggtaatgacgtccggtcgggaagatcaccacattcagcagcccggcaaccacacggttcgggaagttttgcagtaaatcgtccatcgcctgttctgcctgatacagcgcatcctgtacgccccagtgcaccagcggcagatcggcttcattacggccttcgtcgtcataacgcttcagaacggcagaggcgaggtaaagctggcttaaaatatcccccagacgggccgagatacgctcacgacgtttcaggctgccgcccagcaccgccatcgagacatcagaaagcagggcgaggttggcgctcaggcggttcaggtgctgatagtagcgtttagtggcatcgccggttggtgtgctgctggttaaaccgcgcgtcaggcccagccagaagctgcgaactttgttgctaccgacgtgaccgatatgtttgaacagcagtttatcgaacgcatttacgtcattgttcttcgccgcttccatctcttccagcacgtacggatggcaacgaattgctccttgtccgaagatcatcatgctgcgggtcagaatgttagccccttcaacggtgatggcaatcggtgcgccctggtaagcacgggccaggaagttgctttgcccgagcataatgcctttgcccccggtgatatccatcgcatcaataatcgactgctgcccgcggtgggtacagtgatacttaacgatagccgacagcacggcaggtttttcaccgagcataatgccgtaggtaatcagcgatgccgcagcatccattacataagcgttcccggcaatacgcgccagcggctcttcaatcccttccatcttaccgatagagattttgaactgccgacgaatgtacgcatacgcgcccgttgccagcgctaccgatttcacgccgccggttgagttggaaggcagggtgatgccgcggcctaccgagaggcactccaccagcatccgccagccttgcccggccattttcggcccgccgatgatgtaatcgatcggcacgaacacatctttaccgcgcgtcggtccgttctggaacggtacgttcagcgggaagtggcgacgaccaatttccacgcccggcgtggtggtcgggatcagcgcacaggtaatacctaaatcttctgcaccgccgagtaatttctccgggtcggagagtttaaacgccagaccaagcacggtcgcaatcggtgccagcgtaatgtagcgtttgttccaggtcagacgcatccccatcacctgctggccctgccattcgcccatgcagacaatcccggtatccggaatcgcgcccgcatcggaacccgcttccgggctggtcagtgcaaagcaagggatctcctgaccacgcgccagacgcggcagatagtgatttttctgctcgtcagtgccgtaatgttgcagcagctcgcccgggcctaatgagttcggcacgccgacggtaatcgccaggatcccgctcacgccggagagtttttgcagcacgcgagactgggcataagccgagaactccagcccgccgtactcttttttgatgatcatcgcgaagaaacgatgctctttaaggtacgcccataactccggcggcaggtccgccagctcatgagtaatctggaaatcattcgccatccggcaggcttcttctaccgggccgtcgagaaacgcttgctcttctgcggtcaggcgcggctgcggatagttatgcagctttttccagtccggcttgccctggaacaagtcgccctcccaccaggtggtgcccgcatcaatcgcttctttctcagtgcgcgacatcggcggcattaccttacggaaaccgcgaaataccggcgcggaaatcatcgacttacgcataggcgcaaagttaaatggcacgaggataatggccagaggcaccagtacccacgccgaccacagaccagcaacgccgagtgcggctgtccaggcgagcaaaatcagactgctgataaataagctcacgcggtgatagaacaatgcgctgagcaggacaaccgtagcgagaatactcaaaatcatcataacgaaaagccccttacttgtaggaggtctgaccacttgtgatgatatggttgtagtggatgtaaaaacatttagcaatgtgtttacaatataattacaacaaagctcacattgttgctgtttttatccgcacttcaggtcaaaaagtcctggtcatagcacctgcccgtacttctcgcttttggtggtatccggtacactgcattttgtctattacttttatgctgaaggatatcctcatgtaccaggatcttattcgtaatgaactgaacgaagcggcggaaacgctggctaactttttaaaagatgacgccaatattcacgccattcagcgcgcggcggtcctgttagcagacagctttaaagccggtggcaaagtgctttcctgtggcaacggcggctcccattgcgacgccatgcactttgccgaagagttgaccggtcgctaccgtgaaaaccgtccgggctacccggcgattgccatttctgacgttagtcatatttcctgcgtcggtaacgattttggtttcaatgatattttctcccgttacgttgaagcggtaggtcgcgaaggcgatgtactgctggggatctccacttccggtaactctgcaaacgtgatcaaagcgatcgcggcggcgcgtgagaaggggatgaaagtgatcaccctgaccggtaaagacggcggcaaaatggctggcacggcggatattgaaattcgcgttccgcactttggttatgccgaccgcattcaggagatccacattaaagtgatccatatcctgatccagttaattgaaaaagagatggttaagtaagtctggcgtaggccggataaggcgtttacgccgcatccggcatttgtgctctgatgcctgatgcgacgctgacgcgtcttatcatgcctacaatctgcacccgaaccgtaggccgaataatgcgttcacgccacatccgatctgaaaattcttaaatcaatcttcgccgggggccatgcgctcccgctgttgtggaggttacccatgtgcgaattgctcgggatgagcgccaacgtccctaccgatatctgctttagtttcaccggacttgtacagcgtggtggtggaaccgggccacataaagatggctggggcattaccttttacgaaggtaaaggctgtcgcacatttaaagatccgcaacccagctttaattcccccatcgccaaacttgtccaggactacccgataaaatcctgttcggtgttggctcatattcgccaggctaatcggggcgaggtggcgctggaaaatactcacccgtttacccgcgagttatgggggcgtaactggacttatgcccataatgggcaactgacgggctacaaatcactggaaaccggcaacttccgcccggtcggtgaaaccgatagcgaaaaagccttttgctggctcctgcataaattaacgcagcgttacccgcgcacaccgggcaacatggcggcagtgtttaaatatatcgcctcactggcggatgaactgcggcagaagggcgttttcaacatgctactttcggatgggcgctatgtaatggcgtattgctcgactaatttacactggatcacccgccgcgcgccgtttggcgtggcaacgttgctggatcaggatgtggaaatcgacttcagctcgcagaccacaccgaatgatgtggtcacggtgattgcgacacagccgttgacgggcaatgaaacctggcaaaagattatgccaggtgaatggcgcttattttgcctcggggagtgtgtagtttgatgccagttgtggctgcacaacttcgtggcttaacggcttgctgaccacgtaacggccattgaccacagaaacggtcggtggcttacgggtttgctcaaagtagtcgtagcccggcttcagttgctcccagaagtccttaaagttggaatatttatggcgcttcatattggcgtcggtcatgcggaacggataaatactcacttgcacgctcggctgaccaaacaccagcgcaccagtaacgaactggaagatctcatcaataccctgattggtcatcgcgtagcagccgatggaaacacaatcgccgtgaatcatcaggtatttcccttcataaccatgcgcacggtcataggcgtttgggaatccaatattaatcgctttgtagtaacggctgtctggttttaactgattacgctggacgctataaaacccttccgggcttttgaaatcgccctgacgctgttttggccctaagccgccggaatatttacagattttatagctgtcgagcagttgatattgctcgcccattttgacgtagagatcgagcgtacgttcttccttgaagatctggatgtagacaggggatcccatcaactgctgcttatactctttgctcactggcgtggtcgagctactgctgcccagcaaaccggcaaacgaaacgcacgggatcaacaacatcgcaagaattaatgcgattttacgcatactgcttattccttgataaaacggttacacacgccaggacggcaaaatgaatcccaaatcggaatagtctggatttggaaggctcacattatcaccaaaagagttttacgcaagcctgtcggcgcagggtttacaaatttagcacaggggcagttttcaagagtccgaaaagcgcatggattgtagatttatttcttatttcctaagattatgaaaccgcaatagtaatatgcaaataagcaattaataatcccgtttactcctccggtcttttaaaattctcaccttcattcagctggtttatgtccttcatgtcttcgttcttgcacggcagatttctgcatccaggcgtgttttcgttatgcgttttgctccctttactcgccagcgccaccacatcacatatctcttttagctacgccgcccgccagcggatgcaaaaccgtgcgcgtttattaaaacagtaccaaacccatctgaaaaagcaggccagctatattgtggaaggcaatgccaaaagcagaagggcgctgcgccagcataatcgggagcagataaaacagcatccagaatggtttcctgcgccgctcaaggcgagtgacagacgctggcaggcgttggtggagaataatcatttcttaagcagcgaccatctacataacatcaccgaagtggcgattcaccgcctggagcagcagctaggtaagccttatatctgggggggcacgcggcctgataaaggcttcgactgtagcgggttggttttttatgcctacaacaagatccttgaggctaagctcccgcgcacggccaatgagatgtaccactaccgtcgggcaacgattgtggcgaataacgacctgcgccggggagatttgctgtttttccatatccacagtcgtgagatagccgaccatatgggcgtatatcttggagacggtcagtttatcgagtcaccgcgcaccggggaaaccattcgggtaagtcggttagccgaacctttctggcaggaccattttttaggcgcgcgacggattttgacggaagagacgattttgtaggccggataaggcgttcacgccgcatccggcggttgtgcgccggtgtctgatgcgacgctacgcgtcttatcatgcctacaaatctgtgcattttttgcgagccgctttcccgatttaacacaacatcattgccgacttttccttttcttcttaccgttgagaaaaaggagtcgttatgtctgaatatcgtcgttattacatcaaggggggaacctggtttttcacggtaaatttacagaatcgtcgaaaccaacttttgaccacccagtttcagacgctccgtaacgttattattaaagttaagcgagacagaccttttgaaattaacgcttgggtagttttgccggagcatatgcattgcatatggacattacctgaaggcgatgatgatttttcctcgcgctggcgggaaattaaaaagcaatttacccatgcttgtggattgaaaaatatctggcaaccacgtttttgggaacatgctatccgcaataccaaagactatcgccatcatgttgattatatttatataaatccagtaaaacatggttgggtaaaacaagtgagtgattggccattctcaacgtttcaccgcgatgttgcgaaagggttatatcccatcgattgggcgggagacgtaacggattttagtgctggggagcgtatcattttatagctgtgcgccgatgcctgatgcgacgcagacgcgtcttatcatgcctacaaaaccgcgctcacccgtaggccggataaggcgttcacgccgcatccggcggttgtgcaccggtgcctgatgcgacgcagatgcgtcttatcatgccgacaaaaccgcactcacccgtaggccggataaggcgttcacgccgcatccggcggttgtgcaccggtgccagatgcgccgctacgcgtcttatcatgccgacaaaaccgcactcacccgtaggccggataaggcgttcacgccgcatccggcaatatgcaccgatgccggatgcctacatcaacgcccccattatcttcaactccagctcatccagcacttcgttatacgacagcacatgcagccctggtgcaaacaaccttgcgtagcgcgccagcaaagggcgcagctgcggcggcaccagcagcaccggatctttccccgccgctttcatctgctccttcacctgcggcatcgtgatctgaaactggttgagcatattcgggtccaccggcacgctatcgagcatcactttgccggcctgttgcgcctgattcaccacgttggtcagcagattttccagctcattattcagcgtatacaccgtcagctcctgcttgcgaacgaacggatgggtaatgctgcgccgcagcaccaggcgcacatcggccgccagcagaatatgatctttagtcaccgcactactggcgaccaacacggtggcgatggtgacgatatcgcgcagggaaacgccttcagtcagtagtgtgcggtacactttcagcaactggctgtaattgagcgccgcgctcaaatcttccgccagtcgcggtgccatcgacgacaaacggttatgcagctgagtaatatcgtcatagttaaacaaatcaggaatatagctgcgcacaatcttattcacatgggtggcaattacgctggcgctgtcgatcacctgataccccatattcagcgccttcgctttctgcgcgggctgaatccaggtgaccggcatcccgtacgccgggtcgttccccagcacgccgtctatctcgccgtaggtttcgctggagggcagggccatcagtttatccgccggaatatccgcttcatcagccttaatgccgttgatgaaaatagcgtactggctgggcttgaggcggaagttttcccgaatacggatctccggcagcagcacgccgttgccgtcggaaatcacctgacgtacgccgcgaatacgctgggtgagcgggttgccctgcgctttatccaccagcgccaccagtttgtagccgaggcttaaactgataggttcgatcagcggaatagtttcccaactgacctgttgctcgctggtttctgtcatcgtacgggttagcgtttcgaggcttttctcttccgcctccgccgcttgcgggcgcttgctcatccgccagccggtaaaaccaagcagggcgctgaacatcaggaacgggaaatgcggcattcccggcaccaccgccagcacgaacataattccagtggcggtgtagagaaccgacgggcttgccagcaactgattacgcacgtcatgggcgatatcaccgttatcgctgacgcgggtgacgataatcgccgccgcggtggagagcagcagggaagggatttgcgccaccagcccatcgccgatagtcatcagcacatattgctggaaggcggcgtcggcgctcaggttgtatttgaagatcccgatacagacgccgccgatcaggttgatcgccagaatcatcatcccggcgatggcatccccgcgcacaaattttgatgccccgtccattgcgccgtagaaatcggcctcgctggcaacatctttacgccgggtttgcgcctgcgtctggttgatcaacccggcgttaagatcggcgtcaatcgccatctgtttgccgggcatcgcgtccagggtaaagcgggcagaaacctcggaaatacgctcggcccccttggtgacgacgataaagttgattgtcaacagcgtcagtaaatccgagcgtgaaagcattatcgccgcgctgcacgggcagtcgatttttaacggtggtgggttgtcgccgttaaataaaatcagcccgtctcatctgccaaaacctgccaccgtggcggtgccggaagagacggagaaaaaagcgcgcgacgtcaacgagaaaacggcgctgttgaagaagaaatccgccaccgagcttggcgagctggcgaccagtatcaataccatcgcccgtgatgcgcatatggaagcgaatctggagatggagattgttccccagggattacgcgtgctgattaaagacgaccagaaccgcaatatgtttgaacgcggcagcgcgaagattatgccgttctttaaaactttgctggtggagcttgcgccagtgttagactcgctcgataacaaaattattattaccgggcataccgatgcgatggcctacaaaaacaatatctacaacaactggaacctttcgggcgatcgcgcgctttcggctcgtcgggtgctggaagaggccggaatgccggaaaataaagtgatgcaggtaagcgcaatggcggaccagatgctgctggatgccaaaaatccgcaaagcgcgggcaaccggcgcattgagattatggtgctgaccaaaagtgcgtccgatacgctgtatcaatactttggtcagcatggggataaagtggtgcagccgctggtgcaaaagctggataagcagcaggtgctttcgcagcgagcgcgttaaatgctgaatctttacgcatttctcaaaccctgaaatcactgtatactttaccagtgttgagaggtgagcaatgcgtaaaatcattcatgtggatatggactgctttttcgcagcggtggagatgcgcgacaatcccgccctgcgcgatatccctattgctattggcggcagccgcgaacgacggggggtaatcagcaccgccaattatcccgcgcgtaaatttggcgtacgtagcgctatgccgacagggatggcgctcaaattatgcccgcatctcaccttgcttccagggcgctttgacgcctacaaagaagcctcaaatcatatccgcgaaattttctcgcgctatacctcgcgcattgaaccgttatcactggatgaagcctatctcgatgtcaccgatagcgtccattgccacggttctgcgaccctcatcgcccaggaaatccgccagacgatcttcaacgagctgcaactgacggcgtctgcgggcgttgcgccggtcaagtttctcgccaaaatcgcctccgacatgaataaacccaacggtcagtttgtgattactccggctgaggttccggcatttctgcaaaccttaccgctggcaaaaattcccggcgtcggcaaagtctcagcggctaaactggaagcgatggggctacgaacctgcggtgatgtgcaaaagtgtgatctggtgactctgctcaaacgttttggcaaatttggccgcattttgtgggagcgtagtcagggcattgacgagcgcgacgttaacagcgaaaggttgcgaaaatccgtcggtgtagaacgtacgatggcggaagatattcatcactggtctgaatgtgaagcgatcatcgagcggctttaccctgaactggagcgtcgtttggcaaaggtaaaacctgatttgctgattgcccgccagggggtgaaattaaagttcgacgattttcagcaaaccacccaggaacacgtctggccgcggctgaataaatctgatctaatcgccaccgcgcgtaaaacctgggatgaacgccgcggcgggcgcggtgtgcgactggtggggctgcatgtgacgttgcttgacccgcaaatggaaagacaactggtgctgggattatgatgtatactattttgtatattctggtgtgcattattatgaggagatcactgtatgcatcgaattctcgctgaaaaatcggtcaatatcactgagttacgtaaaaacccagctaaatactttattgatcaacctgttgcggttctttctaataatcgccccgcaggatatctcttaagtgccagcgcatttgaagcattaatggacatgcttgcagaacaagaggagaaaaagcccataaaggcgcgcttccgtccgagtgctgcaagattagaggaaattacacgccgcgctgaacaatatcttaatgatatgacggatgatgatttcaatgactttaaggaataaggatgcgggtattcaaaacaaaacttattcgcctgcaacttacagcagaggaacttgaagcgttaacggcggattttatttcctataagcgtgacggtgttttgccagatatatttggtcgtgatgcactctacgacgactcgtttacctggccattaatcaaatttgagcgagttgctcatattcatctggcaaatgtgaataatccatttccgccacagttgcgccaattcagcagaacgaatgacgcagcgcatttggtatattgtcagggcgcgtttgatgagcaagcatggttgctcattgccattctgaaacctgaacctcataaactggctcgagataacaaccaaatgcataaaattgggaaaatggcagaagcgtttcgcatgcgtttttgaatttatattatgaataacatacaaataagaaactatcagcctggtgattttcagcaactatgcgctattttccttcgagctgttacgatgacggcgagtcagcactattctccacagcaaattgccgcctgggcgcagattgacgaatctcgctggaaggagaaactcgcgaaatcacaagtgcgggttgcagttattaatgcacaaccggttggttttattacctgcattggacattatatcgatatgttatttgttgaaccggaatacacccgacgcggggttgccagcgctttgttaaaaccattgattaagtctgaatccgaacttacggtggacgccagcataaccgcaaaacccttttttgaacgttatggttttcagacagttaagcagcagcgcgttgaatgccggggaacgtggtttactaatttttatatgcgatataaaccgcaacattaaatccagcttgcaatgaaaataacgcccgtctagtatgtgcgcgttttcttattccacaaactgcaaggaggtaaatcatgacaaatcctttatcaatgactctttgcagacctttccaggattaattcttttttcttgccctggattcgtctgccatttcctgatttttattcataaatggaatggtacatgggcaaatatattcgtcccttatccgatgcggtatttaccatcgcatctgatgacctgtggatcgaaagttcagcgatccaacaattacacaccacggcaaatttacccaacatgcagcgcgttgtggggatgccagatttacatcccggacgcggctacccgattggcgcagcgttcttctctgttggtcgtttttacccggcactggtcggcaatgatatcggctgcggcatggcgctatggcaaacagatattctcgctcgcaaatacaacgccgataagtttgaaaagcgattatcagatctggatgacgttgctgaagaaagctggctggaggaaaacctgccgtcagcatttgcacagcatccgtggcgcaactcgcttggctccatcggtggcggtaaccacttcgcagaactgcaacagattgatcaaattatcgacgcggaactgtttgcactggctggtctggatgcgcagcatctgcaactgctggttcatagcggctcgaggggattggggcagtctattttacagcggcatattgcctcgttttcgcatcatggtttgcctgaaggcagtgacgacgcgctacggtatattgcggaacatgacgatgcgctggcgtttgcgcgtattaatcgccagctgatcgctttgcgcataatgcaacaagttaaggccaccggaagtccggttctggatgtggcgcataactttgttagcgcgtgccaaatcggcgatcaacagggctggttgcatcgtaaaggcgccacgccggatgacaacggtctggtgattattcccggttcacgcggcgattactcctggctggttaaacctgttgcgaacgaaaaaacgctccactcgctggcgcatggggcggggcgtaaatgggggcgcaccgagtgtaaagggcgtctggcagcgaaatacacggcgacgcaactctcgcggactgaacttggcagtcgggtaatttgtcgcgataaacaactcatctttgaagaagcgccacaagcctataaatcggctgaaagcgtggtgcaatgtctggtgctggctgggttaattattcctgtcgcgcgactgcgcccggtgctgacgctcaaaaacagtggagggaaaaaaggatgatcttgctacaactctcctctgctcaggggccggaagaatgttgtctcgcagtgaaaaaagcactggacaggctgattaaagaagctacccgacaggacgtcgcggtaacggtgctggaaacagaaacgggtcgctactctgacacactgcgttcggcgctgatttctctggatggcgataacgcatgggctctaagcgaaagctggtgcggcactatccagtggatttgtccgagtccgtatcggcctcatcatgggcgcaaaaactggtttctgggcattgggcgttttaccgctgatgagcaggaacaatcggatgcaatccgttatgagacgctgcgttcgtcggggccgggcggtcaacatgtcaataaaaccgactcggcggtacgcgccacgcatctggcatccggtattagcgtgaaggttcagtcagagcgcagtcagcatgctaacaaacggctggcgcgattactgattgcctggaagctggaacaacagcaacaggaaaatagcgcggcgctgaaatcgcagcggcgaatgttccatcaccagattgaacgtggcaacccgcgacgaacgtttacagggatggcttttatcgaagggtaatgaaggatgatactgccggaaggcgattaaacgccatccggcagcaaatcaaataattacttcgccggaatttctttcagcagttcagtcagcagtgtccagtaatggccaacgctttcgatatgaacttgctcatccggggagtgtggaccggtgatggttggcccgatagacaccatgtccatttccggatacggttttttgaacaggccacattcgaggcccgcgtggataatctggatgttcggcgttttgttgaacagacgctgataggtttcacgtaccagatgcattaccggagagttagcgtccggctgccagccaggatatgcgccttttgcttcggttttcgcacctgccagtttacccagcgaatccagcatgctcactacgtagtctttaccgctgtcgatcagagaacggatcaggcagtgaatttctacgttattgtcggtcatggtcaccacaccgacgttcagggaggtttcgaccacaccttttgccacgtcggagttgcggatcacaccgttcggggtggcgttcagcagacgaataaaggtatcgcgagatttcgcaatcagggcagctttatcgttcgcaacagagtccagcagcaatgccagatttttctctttctctgccagttcgtttttcaggatctcctgataggtatccaccagagatttcagggcgtcgactttatcagctgcgacagcaatggtcgcaaaggcttcacgcgggatggcgttacgcagtgtgccgccgttgaaatcaataagacgcaggtccagttcttctgcatgacccgccaggaagcgcaccaacagtttgttggcattacccaggccaacgtggatttcaccgccggagtgaccgcctttcagaccttttaaggttaacttgaaggtttcaaaaccagctggaaccgcttcacgatctaaatgcaggttggaggtgaagtcgatacctcccgcacaacccatgtagatttcaccttcttcttcggagtcggtgttaatcagaatatcagcctgcaaccagttgctctgtaagccaaaagcaccgtccataccggcttcttcggtcatggtcagcagcacttccagcgggccgtgaaccacgttttcgtcagccagaaccgccagtgcagaggccataccaatgccgttatccgcacccagcgtggtgccgcgtgctttaacccattcgccatcaatataaggctggataggatctttagtgaagtcatgcacggtgtcgttatttttttgcggcaccatatcgaggtgggcctgcaagacgaccggtttacgattttccatacctgcggtagcaggtttacgaatcaggatattacctacctgatcgcgttcgacatggaaacctttctcttttgcccaaccaacaatgtattcagcgagttgctcttcatgataggacgggtgaggaatagaacagattttggcaaaaatatcccacagcggctgtggagataattgagacagttcagacacgttaagtctccttgtcgatcacccgcaaaacagtattgcaggtcacagggttagcagaaaatgttgtcaacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtagataccggtggtactgcggttgcgattcgtgaaatgtatccaaaagcgcactttatcaccatcttcgcaaaaccggccggtcgtccgctggttgatgattatgttgttgatattccgcaaaatacctggatcgaacagccgtgggatatgggcgtcgtattcgtcccgccaatctccggtcgctaatcttttcaacgcctggcactgccgggcgttgttctttttaacttcaggcaggttacaatagtttccagtaagtattctggaggctgcatccatgacacaggcaaacctgagcgaaaccctgttcaaaccccgctttaaacatcctgaaacctcgacgctagtccgccgctttagtcacggcgcacaaccgcctgtgcagtcggcccttgatggtaaaaccatccctcactggtatcgcatgattaaccgtctgatgtggatctggcgcggcattgacccccgtgaaatcctcgatgtccaagcgcgtattgtgatgagcgatgccgaacgtaccgacgatgatttatacgatacggtgattggctaccgcggcggcaactggatttatgagtgggctacccaggcgatggtgtggcaacaaaaagcctgtgcggaagaagatccgcaactcagcggtcgacactggctgcatgcggctacgttgtacaacattgctgcctatcctcatctgaaaggagatgacctggccgagcaagcgcaggctttgtcaaaccgcgcctatgaagaggccgctcagcgtctgccgggcacgatgcggcagatggagtttaccgtacccggcggtgcgcccatcaccggctttttgcatatgccgaaaggcgatggcccgttcccgacagtattaatgtgtggtggtctggatgcgatgcagacggactattacagcctgtatgaacgttattttgcgccgcgcggcattgctatgctgactattgatatgccgtcggtgggcttttcttcaaaatggaagctcacccaggactccagcctgttgcatcagcacgttttaaaggcgctgcctaacgtaccgtgggtggatcacactcgcgtcgcggcctttggtttccgtttcggcgctaacgttgccgtgcgtctggcataccttgaatcgccacgtctgaaagcggttgcttgtcttggtccggtagttcataccctgttgagtgattttaagtgccagcaacaggtgccggaaatgtatcttgacgttctggccagtcgtttagggatgcatgatgcttccgatgaagcgttgcgcgtggagttgaatcgctattcattaaaagtgcaaggattgctgggacgtcgctgcccaacgccaatgttatcaggctactggaagaacgatccgttcagcccggaagaggactcacgcttaatcacgtcgtcatctgctgacggtaaattattagagatcccatttaacccggtgtatcggaattttgacaaaggccttcaggaaatcacagactggatcgaaaaacgtttgtgttaaaaatttgctaaattttaccaatttggtaaaacagttgcatcacaacaggagattgcaatgacgttaccgagtggacacccgaagagcagattagtcaaaaaatttaccgcactaggcccgtatattcgtgaaggtaagtgcgaagataatcgattctttttcgattgtctggctgtatgcgtcaacgtgaaaccggcaccggaagtgcgtgagttctggggctggtggatggaactggaagcgcaggaatcccgttttacctacagttaccagtttggtctgttcgataaagcaggcgactggacgagtgttcagataaaagatgccgaagtggttgaacgactggagcacaccctgcgtgaatttcacgagaagctgcgtgagctgctggcgacgctgaatctgaagctggaaccggcagatgattttcgtgatgaaccggtgaagttaacggcgtgaatgaaatgtgccggatgcgatgttagagcatctcttccggcctgaaatattggttttcgtagttttcgtaggccggataaggcgttcacgccgcatccggcaatattcattaaaactgatacgtcatcccaaccgcgacaatatcatcattgttgatattcagcttattatcgctatccagctgattaattttataatcaacaaacgctgacatatttttgttgaaataatacgtagcaccaacatcgacataattgaccagatcttcatcaccgatgccctcaatatctttccctttcgataagacataacccagcgatggacgcagaccaaagtcaaactggtattgagcgaccgcttcaaagttctgcgtcttattggcaaaaccgccagagattggcgtcattttacgtgtttcagaatagaaagttgccagataaatattattggcatcgtatttcagacctgttgcccatgcttctgcacgcttgcctgtgccacggctttgcaggttctgctcgttggtgcgatcagagttggtataggctccactgatggcgaaatcgctgccaccaaagtcatatgtcaatgacgtgccgaagccatcgccgttttgctttttaacgtcgcggttttcgtttttcccttgatattgcagggttaagttcaggccatcgataacgccgaagaagtcggtgttccgatacgtcgccagaccgctggcgcgtttggtcataaagttgtcggtctgcgccgaggagtcgccaccaaattccgggaacatatcggtccaggcttccacgtcatacaacgcgcccaggttacgaccataatcgaaagaacccaaatctttatatttcaacccggcaaaagcgagacgcgttttttgctgtgcagtatcactctccgctttattaccggcaaactcagcttcccaacgaccataaccagtcagttgaacgttaatttgtgtttcgcctttaaaaccaaaacggatataactctggtcgccatctttactgtcattatcactcatataatgcatggctttaactttgccatagacatccagtttattaccgtctttgttatatatttctgcggcctgtacggatacagatgccacaatgcccatcaccactaatgccagagtgctctttttcattttcattcctgattttaattaacgcgcgaatattcagcgggagagtcccgttgaaaacaggaaagtttttaacctgagattgttaaagatatattacagattaataatattcttaaaatgtggtaatttattaaatctgtaataaaagcgtaaacaactgccgctacgcttgctgatcccgcgcaacaaaacgccatgctttgctcgcagatggttggcaaccgacgacagtcctgctaaaacgttcgtttgatatcattttttcctaaaattgaatggcagagaatcatgagtgacagccagacgctggtggtaaaactcggcaccagtgtgctaacaggcggatcgcgccgcctgaaccgtgcccatatcgttgaacttgttcgccagtgcgcgcagttacatgccgccgggcatcggattgttattgtgacgtcaggtgcgattgccgccggacgtgagcacctggggtacccggaattgccagcgactatcgcttcaaaacagctgctggcggcggtagggcagagtcgactgattcaactgtgggaacagctgttttcaatttacggcattcatgtcgggcagatgttgctgacccgtgctgatatggaagatcgtgaacgcttcctgaacgcccgcgataccctgcgtgcgttgctcgataacaatatcgttccggtaattaatgagaacgatgctgtcgctactgcagagattaaggtcggtgataacgataacctttctgcgctggcggcgattctggcgggtgccgataaactgttgctgctgaccgatcaaaaaggtttgtataccgctgacccgcgcagcaatccgcaggcagaactgattaaagatgtgtacggcattgatgacgcactgcgcgcgattgccggtgatagcgtttcaggcctcggaactggcggtatgagcaccaaattgcaggccgctgacgtggcttgccgtgcgggtatcgacaccattattgccgcgggcagcaagccgggcgttattggtgatgtgatggaaggcatttccgtcggtacgctgttccatgcccaggcgactccgcttgaaaaccgtaaacgctggattttcggtgcgccgcctgcgggtgaaatcacggtagatgaaggggcaactgccgccattctggaacgcggcagctccctgttgccgaaaggcattaaaagcgtgactggcaatttctcgcgtggtgaagtcatccgtatttgcaacctcgaaggtcgcgatatcgcccacggcgtcagtcgttacaacagcgatgcattacgccgtattgccggacaccactcgcaagaaattgatgcaatactgggatatgaatacggcccggttgccgttcaccgtgatgacatgattacccgttaaggagctggccgatgctggaacaaatgggcattgccgcgaagcaagcctcgtataaattagcgcaactctccagccgcgaaaaaaatcgtgtgctggaaaaaatcgccgatgaactggaagcacaaagcgaaagtatcctcaacgctaacgcacaggatgttgcagacgcgcgtgccaatggccttagcgaagcgatgcttgaccgtctggcactgacgcccgcacggctgaaaggcattgccgacgatgtgcgccaggtgtgcaatctcgccgatcctgtggggcaggtaatcgatggcggcgtactggacagcggcctgcgtcttgagcgtcgtcgcgtaccgctgggggtgattggcgtgatttatgaagcgcgcccgaacgtgacggttgatgttgcttccctgtgcctgaaaaccggtaacgcggtgatcctgcgcggcggcaaagaaacctgtcgcactaacgctgcaacggtagcggtgattcaggacgccctgaaatcctgcggcttaccggcgggtgccgtgcaggcaattgataatcctgaccgtgcgctggtcagtgaaatgctgcgtatggataaatacatcgacatgctgatcccgcgcggtggggctggtttgcataaactgtgccgcgagcagtcgacaatcccggtgatcacaggcggtataggcgtatgccatatttacgttgatgaaagtgcagagatcgctgaagccctgaaagtaattgtcaacgcgaaaactcagcgaccgagcacatgtaatacggtagaaacgttgctggtaaataaaaacatcgcagatagcttcctgcccgcattaagcaaacaaatggcggaaagcggcgtgacgttacacgctgatgcagccgcgctggcgcagttgcaggcaggccccgcgaaggtggtggctgttaaagccgaagagtatgacgatgagtttctgtcattagatttgaacgtcaaaatcgttagcgatctggatgacgccattgcccatattcgtgaacacggcacgcaacactccgatgcgatcctgacccgcgatatgcgcaacgcccagcgttttgttaacgaagtggattcctccgctgtttacgttaacgcctctacgcgttttaccgacggcggccagtttggtctgggggcggaagttgcggtaagcacacaaaaactccacgcgcgcggcccaatggggctggaagctctgaccacttacaagtggatcggcattggtgattacaccattcgtgcgtaaataaaaccgggtgatgcaaaagtagccatttgattcacaaggccattgacgcatcgcccggttagttttaaccttgtccaccgtgattcacgttcgtgaacatgtcctttcagggccgatatagctcagttggtagagcagcgcattcgtaatgcgaaggtcgtaggttcgactcctattatcggcaccattctaacgtctccccaagtctactcaagtatttaaaaacctcttataatcagtatattaatgccccttttagtcttttgacgtctatttaagtaccccaaactctacaagcaattgaggggatttgctgttcagtttagtggagatacccccaagtgaaactcaatgcccgtcaaatagacactgccaagccaaaagagaaggcttacaagttggctgatggtggtggtctgtacctcctggtaaaacctggtggaggagaatattggcgtctcaagtatcgtgtagctggtaaagagaagctgttagcactaggtgtgtatcctgaggtcaccttagctgatgctcctgcaaaacttgaagaagctaaaagaggtatctctgggggaatcgatctgatggaagtgaagcgagaggaaaagattgcccgggaaacgcagttaaacaacaccttcaaagatattgcccttgagtggcacagtaacaaattataatcacaataatagtgtatataattatacattgtatgcttggtaatcatataatgataaaagcttccgataatcagtatgagatttgtccttaaactcctggacatgcttttctaaatcttccaatggtatatgtccatttatacaaataaaattctagtgataaataccttcaggtatgattagacaacatctttattcgatgggggttaatctatatttgatatctttcttttaaataacaacgccattaaaaacgctttgtttaatgacgtttttttattgtttcctatataaagcctaaccagcataaacattggtggctcttatgctcattgtaattaaatgagagtgtgattaatgtctttatatattctggtagttattctctccagaagaatacattgtaagaagatgactgttagtatgttttaacatcaattaacattaaggtttgataataattttttgttggcgagttcaaatgttttcatttcatcatctgatagcccgctccagattttctttagcattacattttgagtgtttattagtttttgagcaagtgtaactccgtcaggggttaagcaaatacttttgcttcgacgatcgtttttattattaattcttttggcaatattctttttttctaatttgtctatgatgtgtgtgatgtttgttttggagaattgtaactccttgtaaatatcagaaggggactgacaataatcatcagacatatataatgaaactaacaccataaatgttgaagtgtttattctatactcgctcaattcattttctataatactctggattttgtcatttactctaatatataagtgtattaacagactctcctgagccgggtatgccggatttttgatttttttgtagtttgttatagtttttaataaatctatattattcataattccaccacacggcaaaagaaaactcatgaagattactcaacctgagtgttacatgaagtatcgtgaacgccggaaaatctaagttccagcctgtaccgtaatcagataatcgcagcaaagggacaaagcaatagtccctttgctgcacagcatcagaatgaataacgaatattagcgtttatcgcatcatctgtgttgtatttaccgaatgcagagcgttcaacttccagccccagacgcgtattgtcgccaaaccgggcatttaaccccacaccgtaaagcatacgaccgtcttttctgccattaatctgatgttctcccgctgcatccttcaggtgaacgtcagcactgtccgtcagatcgaactcataatgcaggccggcacggcctgtcagactccagtccttaccactgaaggttttaccggaaacaacgccggttctgcctaccagaggattaacgctgttacgacgcattgagacatccattccactgtcgttccagttaaatgtttggccctgcagtcttccccagaccagttccgcctgaggttcaacaaacgtcgtatctgtcagatgataacggtatccgacttctgcacctgcatacagtgaatggctgcggaagttctgtttaccagctccggcaaagttcaggtcatatttgttttcattgtgaatatatttggcaatcaaatcaaagtaagcgccggaccggaacagaccactggcatagaaaccaccaccccatgattttgttttaccgctgtacaggcctgctgacgcatctgtgtcagtgtaggtggccatcacgccggtaaacaggtccatacttcccagttcgtgcttacggtcagcccccatctgcagcagggtatagtggtcagtgaaaccgccatcagcagagccggaaccgttcagcagacgcacccacgtaccggcttcgccgttaatatccctcaaatcgcccatgcgtttgttcaggttgttaacttcagtgatgaagttgttatagctgatgtgcatgaatgtggcggcagccttaccctggccgtcgttacgtgcaacctggtaaccatcgaggacccactcttttttcccgtcctcttttctgacactaagggtgggggtgacatcactgaatcccacaacccgtgttgatgccctgaacagattatcagctgtcgcttcaggtgcgctgaccagtggaatatcaagcgtgtccttgtcagagggttttttcaggaagttaacccagatgctgttgtcatgacctgttgccgacttgtttatcaccagtttgtctgccttgttaaggtctgtacgcatgacaaatgctgactgaaccgcgtccagattatctgttgtcagtgtcgtgaacgatgatgttcccccgttaaaaccgactattgtccggttaagtttcatatttcctgccgtggagtttccgttcatcgaccactgggtgtctgtcatgctgacggtggcatccggtgcattcaggctcccgctccaggtattgcggtacccgttaaacaggctgtacaacatctgattctgaagagtcaggtcaggactcagttccccttcccctccgagggtgacagtccctttatcctgaacattgatattacctgacaacatactgtacggccccacgttcaggcgggcatcgtctcccttcaggttccatgaaccggcataatcgtatacaggtaaaagtgtgtgagatacctcatcaggacggctgttcagactcagggtggcatcagaaatattcaccggaccgtcagaaacaaaactctgactggccagaacatttgctcccttgttcagattcagggcggtactggtcagcgttgagttctccagaacggcactgtctgaggagatattcacggtactgttgttcgcctgtattccgccattgaatatctcattgatattcagcactgactgattatccaggttgacggtgccgttgaagacgcttttatctgcatctttagttgcaacagatgtgccttcttcaagggtaaatgctgttccctggccatcttttttgtcgataaatacccgactgtcgcccagcgtgacgctggagttatctgcctggatggttgtgttcagtgtggcattgcggcccagaccaaagtctgtatcttttaacacgagcgaaccaaagctgaacgtcctgttctcccagtcatcctgtgtaaatgaggtgggctgtgtcagaacggaattgtcgcccagagacgagactgtatttgcaatactctgagacgttgaagcatggataaccgggtggccctgaatggtcagacgaccgttttcctgagtaaatgtaccggacatattcgctgagccgtccataaccaatgcgccggttgtacccggggttgctttatttgagaaattaatatttcccagcaacttgccatgatacagataccctttattattaattctgtttgcaagcagcgcctgtgcactgttctggtcatgtccgacatattcccagtgctcgttactgacctgaccggtagggaaccagccataactacttgttttcaggataaaataatcgacggtatgagtatagggattattataaatatataatgaacctactgttcccctgtttgatgatgaccattcattaacttttacgtctgccggacgcgtctgataatccagagtgatattagccgttttatcactgctgttaccgagagttgcgccataatcggcggcattcagcttatgaaatgtcaggtcattcccgttaacatccagaacccccccccggtagccccaggatatattgtccggattaacctgctggttgtctgccagcacgactgtcgggcggccgctggcaatattcacgctactgaatgcctgaacgtgtcctgaactgtcagcctgctgattgaggacaacggtcccatccccgactttcaggccgccctcattaacaccggttccctgtacaaccagggttccttcgccgattttatgcaggttgtcacctttcacaccattaacctgccagtttacggaggcatccttgtccacaataataccggccccggtccaggtacttccgtttgaagtggtgacagtgtagtcatcagtaaatgtcagtgaaccggcaccctgcgtgacagagttttccaggtcaatctgaccattatgtcccaggaatgtcagatttttacctgcgttcaggtcagaacctttttgcccgtgcatggcatattcatcggaaccctgtttcagagagccagtgccggtgctgctgtcaaatttccattgcaggggggcgccggatgaggcattaaaaaagacgggagcgtcattatcctctgaatagatctgtgagagaaaactctgaggaataagagaatatatcaaattggtcccccctcctactcccgagtaaacaccgaccagttcccactgccctttggccgtattccagccaaataatggagaaccactgtcgccggcctctccaaaagagggcaggatgctatgatcatgtatgttgccccccatatacagctgaatgccgtctgagccgtgataaaagaatgatgtcgggagtattcctcctgtcagataaccatacccacctgttacccaatgtcgcttaccctgactatcctgaatatactgacttcccgaaccagccctgtagaatgccgagtattttgaagggttcaatatatcagctgttgatgagctggttacggtagccggagcaacctcagttacgagcttatcaagtcttggtgtgtggagatcagatgaactgtgttcattacgatccacaatatggtaactgttctgaccatcaccgaagctgacgctctgatatcctttattatgttttacactggctatatattgcgggttaattaatgttgcaacgccgggatttgagcttacattcacactgctaaaatcaaccatgggcgctttatcaagatgtcctactaattcccctttattattaaaaataggaatgtttgttgcgccagcctgaaactgccctttgttttctgcaaagtcgcggtatgtctggtaaggattgttgccaccaaccgttgatgcaccagcaacggttgggagtaatgcagatagtgccagagaggtaagtactgaaagtctttttcctctgcgggtactccctttacatacccttcgggctagttcagagacaacctttactgtgttagtaatataacaatattttagagcgtatattttattcatagtaaatgattccggaacgtatattccaaagttacattaataaccatagacaatttcaaacgaaagcattgttgaattgcgcgctaattattaattagctatataattataaatgtgacatatgtcacatttatttttgcttaaaactacaatattttgtagttgcacgcattctttgtctgtggttttcattggtggtaatgaaaatgttgtttgctttttctcaggtgttttgacttatgacttaaagtcataaaatatgcgacgctaatacaactacagaaaaatggtatatatggatatcgacgatatttgttgatttttattttaaattgcgtggcggttcagagcggatatatatatcaccataccatcatctgtttttctgaagttcagattagttttaacacactgttttccatcttcgttgattacaacagtctttttaatgtatttacgaatggcatcattcgacgttctaacggatttagtcgatggtggggtaattaataaaacatttgctgtaatcaaaaacggtaatgtcttcaattgatagaagtttctggtaatctactggtatttaaggttttccatggctaccgttactgttcatcgtccgcgctgtaattccgataaagtttatcgacatggtcgtagttgttcccagcatgagcgtttccgttgtcgttcatgtaaacgtgttttccagctcacttactcttatgaagccagaaaacccggctttaaggagctgatcgttgaaatggcgcataatggcacaggggccgtgatatcgccagaatactgaaaatcagcatcaataccgtcatacggacattaaaaagctctcgccccagcggataacatctgcgtcagtcagctcacgctgatgttgcccttatctgtgaacttgatgagctgtggagcttcgttggcaacaaggcgcaacaacactggctctggtatgcgtagaacactaaaactggcggtgtgttggcttacactttcgggccacggaatgatgaggcctgtcgggaattgttagccctgttgactccgttctgtatcggcatggtggccgcgatgactggggcagctacgccagagaagtgccgaaggagaaatacctgaccggcaaaatcttcacgcaacgtattgaacgtaacaacctgaccctccgcacccgcatcaagcggctggtaagtaaaacaatctgcttctcgcgttccgttgaaatccacgaaaaagtcatcggttccttcattgaaaagcacatgttctactgattggaagcactacccaacgttcaacttatcatcataagtataaaaatcacaaaatgggaggtaagagtctttacctggattgtctcgaaatgcaaagtgtgcttgctttacaactaaatctgggggtatctaatgattgcgtaatagtttttttatatacatatcaatgtcttgctttttacaatctgtttatattatccattttaaatcaataggttacacatcgttaataccttccttattttttgattgggacagatttgggaccgatgggttcaggatcgaatctatttaccgtgcgtgttcggtaaggtgattaggtgcgagatgagcatatcgacgaaccatttcgagagtttcctatccgctcatttttaagtgcaagcagggaaacaccggaccaaaccaatcagctgttcgaaaatggcaagcggattaatatgccatggcggctttaagccgcacgcatggggtgtggcaagcctgatggatgttactgtgcttgtggtggcgtctttgctggtctggttgttggttaatcgcgaaaatcattatgccagaggaataccacaggacgttcaggttttgcataaaaaagcccaccattaaggtgggcaaaaggaatgatttatattctctgagagaaacattacatttctccttgtcacttctaacatgaaaatatggagaaataatggagcttatattaattggcgattaggtaaccatgtggttatacaaaacaatacagttctttacatttgccttgttttatgaatactcctaaagaggtgtataacataatggtacaagcagggtagatatgaatatatttgaacaaactccaccaaaccgcagacgttatggtcttgctgcattcattgggctgattgctggcgttgtttccgcatttgttaagtggggggcagaagttccattgccaccacgtagtccggttgatatgtttaatgcagcgtgtggtccggaatcattaatcagggctgcaggccaaattgattgctcccgtaactttctcaatcctccgtacatttttcttcgggattggttgggactgacagatccaaattcggctgtttataccttcgccgggcatgtctttaactgggttggtgtaacgcacataatcttttcgatagtttttgccgttggttactgtgtggtcgccgaagtatttccgaaaattaaactttggcagggcttactggcaggtgctttagcgcaactttttgttcatatgatttcattccctctcatgggacttacgccacctctctttgatcttccgtggtatgagaatgtctctgaaatttttggacatttagtctggttctggtctattgaaattattcgcagagatttacgaaacagaattacccatgagccagatcctgagatccctttaggctcaaatagataatgctttgaatgataaaaatggcgcaaatatagcgccatttttataggttaaaaacgttgcttttcatattctgatgcggacagtcagtgatcatatcgcgctacttcaggatgatgtagatccggagaacgctacagaaaaagaggcattgttgctggaaaatggaagaagtttcaggttttgttgtccctgaaaaacgaagccccgctattacaactggcggggcaatgcaattaattattgtatatttataacggtgttagcccatatttagctcttgcacgattgcaagcctcattgacttctccgttctcaccagacatggcgaattctctgcatgtggacgatcgattttcatatatcgtgcagcaggcatttttgcccggtgttcctgcaagggcaatacatcggggatttttctgattagtaccgctcatgcatcggtgaaaaggggatatttgttcagtgagcctggcgggaatggtaccgccagcatcgtcggcttcggcccagtaaaaagagacgcggaaaaatgcacaacaggcaccacacgtcatgcatggattcagattgctcataattcaccagtacagctataaatcgtaaagagaactgcggtacgtcgtatgcagggacgtatcgcggttggctggtgtactttcgatagtgtgagtattgaatgatttccagccgttaccgattttacgtcctaattagtgaagaaaccactcgttagcaggccgcctggtacctttccgtgtctcctgaacactgtggtgtgcatatgagaaagctcatcggtgacattgacgatcgcttccacatcatttaaacgatttttgagtctctgaggtggaattcttccctcgtccgatggataagtcttagtccgccgaagggggcttagccggacaggaatcgctaatcttaatgaatttgtcgttatagaccagataatgattccccggctgacgtaactcaggctgatgaaccacgtctcccggacgtagataccaggcatcgccttcctcttcggtcgaatcacatcctggtttaatcagtagcttaaaccacgtgttgccggtgttacttaccgttccggtcacctgatcgaaggaccatttaaactgaacctgacgtggtcgtactaccagaatggtatccatcaccaccaccggctccgtgctgacctcaccgccgcttgggctgcgttttgtcaggttacgagtggggacctcgcgaaatgagacccggtagtagcgctcgcggttatcccgtgggccatgatagtaaaatttaaaatactcgctctcaccagcctgcaacgccagctggcggggggcgaaaagtagttcaccatccaccggtcgggtgcgcaattcactgctgcccgggctatcaatagcactgatggcaatacggtatatccgcgcgcttttgttgttattcacgacacgtttgctgacaaagtcagtctcggacggcagtgaaaaagtcagattgccgaccgaaatcgcctgtgtcaaaggtgccgccagcatacagaccactgtcagcagggccttagttaatgttacgccacgtcgcctgaacatgaatctctcctgaagcgctgacttcgccaaaccagccgttatcatctaccgtacgcagagaaatggcgttatccattggaatcgaaaatttgactgtggtcttatccatctgccccacttcgccagagatatcagtccacggtgtggtcaaccacagcgcatcggtcatatcccgccagctatcatcgcacccggcatcgtaggtttttgtagctccgttgcgggtaataaaggaaagcgtcgccgggaacggtactttcgccttaccgtcatcggagctgaagacacaataggagcgcccgccaatcacctgcgcgggtccggtcaccttgatcagcacttcgtcggcagctgttttaccgctggtggttacgatatacccgaaatcgagtgccgactcgccgctgccaacatatccctcccgcgacggtgtctgagtatattcatcggagataatactgatgctgaaatcacggggtttgataatcagcgtgttggaggtagaaaattcataccagccagactccggtgatgtggtgttctgaaagcgaaagttgaatagatctttggtgttgatatcgctgatcccgaggttcaccatctgtttaaagaagttgctcgagaagaaaacatagatcgagtctgcgctcttcatctcgttgaaggtgtagtaataggcagtattgctcaccggtttccatgaactgccattcagactgaactgcatatcgtacgccccgacggccgaggctaacgacgagttggcgatcgccgggaatatatggattgaggtgttgctgagtccgtttgtttgcagggtatagttaaccatcttacaacttaatcctgaacggctgccgatggtttgcgtccggcagtcggcgttcccttcgcccagagtcggtactccgtcgctgttgataaatacttccgccagcgagtgggtatttatcaaccgcagatttgctgctttcgtatgggtgacgttgcgaacataccagttgccggaggcctgatccttacagcgtgcgccgctgttggcgtcatagttcacagaggtctggcaggcattgatggtcattgtaaagctgctgccgacgggcatttgttgcagatactggtaaaacgcgtctgacaacatgccgtgcatccatttcgcgccgccgctggtcaccgtcgcgccataaaatccactggcgtcggtggtttgcggcaggataagactggtggtcatattacaccctgcgtaccagttgatgcagcgcaagccagttaaaggagatgaaactggtgaattttccagccacatatcaaacttccagttggtataaaggccggtgttgtaaccgttatcaatgtagccgaggctttgctgatagatggttcctgaaccattgtattttaaaccggtccagcggttggcaccggtcaggcgcggatccagcgccccgccaggagtgacgaaaaagttgtcgtctgagttgttttcgacaaacacaaactcgcgtgccggagcatccgcccaggttgttttgctcactgccgctctgagcgcggttgcaggccagattagcgcaaagattatcatcgctatcagtaggttaactctcattctcttctcctgtctgcgtcaccgccgcccacgatgagaggccgctgcagaccacatcaccgacccagacggcaccgcgcgcctggttgagttccagtgccacttcgcaggttttattgccactgtagcgaaaatcgatagtggggtatttcttatccacgtccatgacaaactcgccgttttcatcggttcgggttcggccgatatggttgttaatccgtgcgttagccagcagtgtgccgtcttccgcacggatacgaccggagacggtaaccatctgcttcacctctggctcaatgacagcgacattgcctggatagagagtcagatgacttttgcgaccgctgacgatatcgtaactgtcgagtgagtttttgctgttctgcaactccacctcatatcttccatagggagagagcgggagatagttacgcttgccgttaagcgggaaaatccgcccgttgattttggcgctgatctgaccatcgttctccaggccagtgtcgaatatcaccccagcgttgccatcggtccgcccgctggcagcgatgtttttaccctgccagccgacgctgccgttggcggtcaaattagtattgatgtagccgtccgccgcgctattgacgttcagcgttccgctggcgtaacgagcgtcgaactgtgcatacgccccaccgctgagggttttgtcatcaccggtatcgccggagatggctcgtgacagattggcaccaacagtgcgaatggttccttcatcaaactgtttgcgtgctgacaggtttgccatggtgtagccgttttgatgggtcatccctgcgctaaaccagttgcccagtggtagcgagagatcgagagcgatatatttccctgtattggcgctgctgtcgccgttgttatagcgctgaataccggcccgcaggccaagcgaaccaaaggtaccgctgtagacactttgatagtaatctgccgtgtaataatggctgttgtagcggcggtcatcattgtagctgatgctgaacgtacccagcttcgaccacagtgagttcaggttgagtgtgccgccgattgcacggttgtcggcatcgctacgtcgcaattgattgccaatgcgggttttttcctggttaacccacagcgaactgaagcctccaggtagagtggcgctgatgctggcgatgttgctccatgagctgtcactggccagcatgttttgcaggttaacgttgatcgcccccccaagcggcagcgtcagacgggtttcacccaccgcctgattatcgtatccatatcccgttgccgcccagctaaacgtactcagtgagccggaggtcgaggcacctgccagccaactctctttggctggtcgcgtctttttcccgttttccgaccagcgatccatatgaaagctaccgccccatatctgccacgccagcggtgcaccgacgccacgtccccggctaaacagcttattgacccgctgggtgcgtttgctgatcacgcgaccgttaacgattacctcaacttccacatcgtaaataccgtacggtagaccccgggtatccacttcatgattgcccatggtgaagttctgaacgcttagtagtcgcccatcacgggtgagatgtacttcgcccgccgccggtaaaaaggcgatcactggcgtggccgattggctgctgtcgaagatggtggagctggcctggtttccccaggaaaggccgtaaatcttccctgctgaaatggcggtcatcggccctaaggactgcaagttccaggtgtcgagcattccaccggcaaatcggtgaccagcaaaatcgcgttcatacatcgctttatataattcactgtcctgttgaccgctaccaatcccgtacagtgagccgtcgagcaccacgtgatgttcgcgcagcgcagtaacgttattcagcgacagatagctggaggtgttgctcccgccgttacgcaactggttgttatagacgccgaagttatagctcagattactgctgagggtgttaacactggactgcccgatgtcttcgctacgtgagcgtagtacggtgcccagcgcttcgcgcttgaccaccagctgcagcagcagttggcgcaagctgagatccaactgcgcgttgtcagtcagggggatggtaagggcctcattgaacggggcgttggccagagtcatcagttgctgtcgagtttgttcgctgacactggcgttatcttcactctcttccagctgtattttccggatgcgtaactgtccatcatccaaccagataaaagcgctgccgattcgctgatcgtcctggcgaccctggctaccggcgagatgaatatagagcgggacgctcatgccgtcctgaagcgcctgactgaaggcctgcggaataatcaccccacctatttgctgcgcacttatgtcagcagcgctggcatcgggctgaacgaacaaaaagaccatgccgaaggcaaactgggctttcagtcctggggagaaccgtcgtaaaggcattgtcgttatccatctgcacagctatctatttcacgggaatgaacttatcaccctgccaaagtgcaacccgtcctttgttatccgccgtgtccacgtgggtaaaacgacgcgacttgcccggcatcaggtagtaattctctttacactccttaccattggcggctttcaggcaggggccgtaggcgaggatccgcagcgtcgcatttcctgtatttgtcagggagccgttggcgtactgaaagtggtagtttgcctggcggggtgcgacgaccagaatggtgccgatgcgggcggaagcagtggccacagcgctacggttggcattatcgcgctgcgcatcactgagggcctgatcaaaccagacaatgcggtagtagcgctctttttcatctgctggtcccttatagaagaagcggatcacttcgctggcttgggcgggtagcagcaagctggcgggagtgagtagcaactcatccggcttgtccattgcgataacctgcccgtcgtcaagcggtgaagagagccgttcgagacggatattgatgaggcggccactgtcggtactgttttggatcgttttgcttagcgtgctgctgtcactgttcataaacgatgatatatcgccgacatccagcgcctgggccggtgatattccggaaaacagcagagcgagaggcagaaggtgctttttcataacaattccgtccaggaataaagcaggggggtacccctgctggtacatcagagagattaactggtccaggtagcgtcgaactgtacgctaacgtcgccgctccagatgccttccggtagagtgctgtaatcggttactgcggtggtaccattggtggtgccgctgatgatggagaaagtgaaaccatcctgtgcggtggtacgattgctggcattgtaaccgttagccagtgggctaaggttgccgcccagtacgccgttggcggtatcgatcatcacggtatcgccagttttttcgactgccgcgccgttataatccacgcccacattcagtgtggaacctgaggtatccaactgggttaaggtgttggtgataaggcgtgaggtcagtttaaaggcggtagccgttgagtcaccctcgatagccacgtcaaatagacctttttgtgagttaaaacctttaatgccttcggcatactggaacgccaggctaccgagtggcgtcacaaccagcttactggtggtgtcttttttggctgttgctgaccaggtcgctacagcctgagctgttacgtcagcagcctgcgctacacctgtaccggtaaacaccgttaccagagctattgccagaaccttttttttcattgcttttcttcccgagttgaattgaggacatgaagtcccggtgagtcatttttaaaactaacttgcctggagtttactgaaccaacttatataattttgagtacagcttggcctctgcattccgccgatgggtatacactgtcttcacactacaattttcaattctggcaatcgatttaggcagcattccctgagccgtcatgcggataatttccatttcccggtcagtgattttatctttcttaatatcttttctcaggaacctgccattaatcacataggccagttcttttctaatatcacgactcagtccagcgtataccacgcccctaatattgctgttgtaataccaataatttgctaaggcttctgactttctggccgcaatcaatacgacctgtttcccctttaccgcggataaccactcattatcacggtttataaactcagttaaagaatccgtattgagattgataaacacgaaatcttttctgattttctccagcgatagataaattaatctgtcgatatccacaatcagttcagatagtcctttatagaagtaggcgtcatggggagaccagatgtatttatcagaacggttttgacattccatatggtttttaacctcatagtccctgctgtaatcattttgccatgtcactactttccaaacctgtaatttttacaggtacattcagtttctttagtaaatcggaagtaaataagatacgtagcacatatcaatataggttaaacgagattaagttttaattatttcgattaggtttaaatttatgtttttttcctgatgagtgtcaatatgtgaacagaaaatgaattccatggttaagtcaatatttacaaaaaatgaaaatattgcttttttgataagaagaaaaagacattcagtttcataaggttattggcaatataacgttcaattcttacttgcattttatattagccaggaactttgccctgaggtgttaggaatagtcttaatgtgttgtgtaatggactagtaaaaaaacaagtttaaatgacaagaaatagaatataaaactatcataagtcataattaaagatgatttgccaatcagtaaggtgttttaatggattaacatgccgcacaaaatggttatgggtgttcatcccaataagtgatgaaaaattaaacaggtgtaagtacgtcatctgtccggtaagccccccaagagccaaattaagtgaagttaaacgaagactgccagttgtcacaggaacgatggcctctttgccagggcactgcattcagtcatctgtgcgcgttactctaactggcactcgaacgtcggcgatggggttaccgatggatctggccgttcctgtggcgtaaacgtttttatgtcagtaccaacagatttaccacatttatcatcttaacagtttgagtgtaaatgcaggctgcgtcgcaaagggaggaaactgagtggcgtgttcagtctaaaagagagttgatgccagcatacagggcgaaactggtcaacaagtcaacattaatataatggaatattcggagagaaacgtcaggcagttgaccttaaatgaacaggaagatacatccccaggaaaattaatgctggtgtaataaatacaccaacattaatccggtctgattattaatcagataaatatcgttaattcgtcgaattttaaatcaacgttttttcttacgaccctgaacggccttaaaacgtggattagatttacaaatcacatacagccgtccttttcgcttcacaatctgacagtctggatggcgttcttttgcggtacgcagagagttaaggactttcatcatgccccctttttcgtgctaacaaaannnnncattccattcattaattaattaatgaatgaatgnnnnnctgggcagaccagacgccaccatcacgcgatacgacaaaagcacgttcacctgctcatcggcctgtactgacgcggtgaatgcgccggaatggcggtattactggcaggtcaacatgccagccgccaccaacagcacctggatgacatgtggcgatccctgtgattccgcgctgcgtatctggggcgacaccgtcgtcgaatgtgtgcttaacaaactctgcccttcgcatacctacgtaatttttaaatatccggagtaatccatgcatcgtatagacacgaaaaccgcgcagaaggataagttcggcgcgggtaagaacggttttacccgtggtaacccccagacaggcacgcctgccaccgatctggatgatgactactttgacatgttgcaggaagaactctgcagcgtggtggaggcatccggtgccagtctggagaaggcgcggcacgaccagctgcttaccgcgcttcgtgcgctgctgttaagccgcaagaatccgtttagcgatatcaaatcggacggcacggtgaaaacggctctcgaaaaccttggtttgggagaagcggcaaaacggaatgtgggcaacggggaaaaccaaatccctgatatgtctttctggacggttactggtggcaatggaaattttgtgattcgtcaacctgacgggctaatcattcagatggttactgtaagtataagcggcccagtggcgatgaatggaatgactgataatgcttatgccatcacaggttctaataagtcttatattgccacagccacattgccctttgtatttcctaataaggtgctgggcgttatccctctggtatcaacaacagcttatggtggtgtatccagtaatattacaggttcatacgcgacggcggtttgttcttttgccgctgtcagggggaataatacgattgtgttcaaagtcgacaaaccactgaatgcagcctttccttcagataccagcgtctcagcgttaatcattggacggtaataatgaactcagtattcttttcacccggaagtaaaagtttttatctgcaagaattgtttccagaatatgaggatgcgggaacgcttcctgatgatgttattgaaattaccagagaaacatatgagcaatttcttggtctgcatccagaagggaaagaaattggcgctgacagttcaggacggccagtatggattaattccccacccccttcaaaagaggatgaggtgttgacggctgaaatgaaaaaaatatctttggtttcagaagtcaatacctacatcaatacccatcagtggcctggcaaagctgctattggtcgtctgaaaggcgaggaactggcgnnnnncattccattcattaattaattaatgaatgaatgnnnnnttaggaaatacaaagggcaatgtggctgtggcaatataagacttattagaacctgtgatggcataagcattatcagtcattccattcatcgccactgggccgcttatacttacagtaaccatctgaatgattagcccgtcaggttgacgaatcacaaaatttccattgccaccagtaaccgtccagaaagacatatcagggatttggttttccccgttgcccacattccgttttgccgcttctcccaaaccaacgtttatgaaaatgcagaaataacgagcaaatggcatcattcctgcttttgtcagggagatctaccatgcttattggctatgtacgtgtgtcaacaaatgaccagaacacagatctacaacgtaatgcgctgaactgtgcaggatgcgagctgatttttgaagacaagataagcggtacaaagtccgagacctagggctgacactgctgttcttgatgcaaattaaagtatttaatagtgagtagcggccttactaatgtaaggccactataatcattttattaattgcattaatcgtgttttggccatactttcaatgcaatttcccccaactttttaccccgctccaggatttcatcctcatcccatttatccttaactataagtggaatgttcagtcgtagattggtgtggacgatgagagcatcacgttttttcagaaatacagcattctgaacagaacggtttacgctaaggttaagcaaagttagatttcccaaagtagatatcgcttgttgccgtttccttaccagtagctgttcaggggtaagatcggttccagacagaacaatttggttcaataccgtagcatctgaatttgtcaccatacgaccattttcgagaggccaacaggaataccaactttgaggcataagatgatcgatatcgagattagaaagatttggaacatcaggcttttctgtctttacttggcgacaaagttctctttcaagttccgttaacattgagcgcattttcggtgcgtcgagcctgccaggataaagtggagcattgatgcaagcgttgagaaattctgagtcaccaggccaacgtgaggcttcgccatttaagttattgaggatattacgtaactcaacactgggaaatttccgttnnnnncattccattcattaattaattaatgaatgaatgnnnnnggcgacgctcccataaacgcctggatgagtgattgatgatggtttcgctgagagtatggatttttcgagaatggaggctatctccactttactggccgatgatttattgcagcatgattgattacctgacaatgtgtattcctctcccacggatataataattacttacaaaaaagggagaggatgcatattttaaatatcactgaagtgaacagtttattgccgttattaatagaaatggagaaataaataggcgtattctacaattgcgacaaaaacaacgatattaatcagtttatgactgatttgctgtactttattctttttcattggtacttcctcgctttaaaaaaagagtgcacttcgtaagtgcccttatataaataacgagtttggtcaaccaattttttgacatgtatcacaaatttgaatagatgtattacatcggctatcttttattgccccaacgtcattgatatatgtcgcctgaaatcagttacgggaatgagtctgatctcaagactggcccagtcctggcgttgattggcgctgaggagcatatcgcatctcatcgtaacgtcgtatctcctagggtgttatacaagatatcgttgtaggtaaccagggagaggaattgagttttattaaaccgtcaactatgccggatacatactggattacactgcaggcacgccttacgagagaacgtgccgcagtgacgggttaattatctgaaagaatttgcgaggctgtatcggttactcattgatttgatagttttactctcgggagagtaatcgatatttaatccattaacggaaaccagccagttcctttcgatgcctgaatttgatcccatagtttatccggaatggttaattcaggaacgcgttgtggattaagggctgtttgaatttcatgacttctacctgattcagctaaagtcacccattctggatttatcaccagccctttaccgatcgcaacaagtggcaggccagcggaaattgcttcttgagcctgagacggtgtgcgtattttacctgcggcgattaccggcactctgcctgcaatatgatttaaaatcaattcaatagttcgggggccatttggcgactcaacagggtagctatcgttaatactgaccagcgaggtatgtatatacgaaataccggatgaaatgagccgatcaaggagtttataagtatcctctatccgcagcccccctgttacagattcttcaggagatattctgtaaccgatagcaaagggctttgtcgcatattcatagactacattttttacttcctgtaatacggccagcgggaagcgcatacgtccttcaagatctcctccccatcggtcattacgctggttaaatagaggggagaagaaattctgcagaaggaatccgtgcgcaccatgaagttcaacgccatcaaaacctgctttaatcgccctttttgtgacatctccgaatgctctaatggtttcctgaatttcgttttcagtcatttccctgctttgtaccactctcttcataaagtcaccagattttacgcttgatgcgctggcactaataacatcgttatttggcacaagctctgggatggctttattaccggcgtggaaaatctgcaaaatagccggagcaccgccacttttggctgcagctgctaacttttcaaggctgttaatgaaacggtcgtcatacgcggcaaattcatgagtaaacccaatgccgcttggcgtgacataggtacatcctgttattactaaaccaacattttgtgagcgacgtttataaaattcgagttcttgctcagagatggttccatcaggattagctgaccaggttgtcataggagccataacgatacgattacgtagctttattttttctgtcagcataaaaggagaaaacaatgatgggtgtttatttgtcataacaatacctcaaatgtttatctgattttaatgcgtataatcttaataagttgagttgctactttttgatgcttttttctttaatagaattctttttgagtaatttcattattgtcgtgtagtcaataaaggataaatgtcagggagataatgaatctccctgcaaggttattacaaatgtgttttgtaaaaaggaattaatttatcgagcgcctgtttcacaggttctggcttatcatacaggtcgtaatgtgaataaccttcaaccacgaccagttctttatgttttgaggctgcacgaccaataatttcgcagccgtcacgataggcaccaaaagcgcccactctatcgcccactacaaccattagtggttgagttaacaggacttctgcaagatgaaaagcatcccagcccacggcaacagtctgatgtgaaaatagcgaacgatttaccccattaggcgcacagcctcgtggcgaacgataatattctgttgcttcaaaaaggtctatttctgttaatcccgcttcaagagctgcttccggagaagaagggagcaaatcatctacgcgaagttttgcgccgttagcttcgtctgttctttgttgcgccattgcttcgagtgctccgataggattaaacgctgtaaatccctcacgcataagacgcccgtagtttgcacccgtgacagtaccaatggctttaatccgacgttctgtcattgcggcattaatggcatatccacctccaccacaaatacccagtacaccaatacgcccggcatcaacgtaaggtaaggtggtaaggtaatcaacgacaatgctgaagtcttttactcgcattgttggatcttccagataacgcggttctccaccgctgcttccctgaaaactggcatcaaaagcaatgacgataaagccagcttttgccagggcggcaccatacacactacccgatgtctgttctttgcagcttccaattggatgggcactgataatggcaggatactttttttcactattaaaatcgtcagggaaatagatatcagcagctatatcccagtaagtgtgttttatcgaaacagttttcatttcaagctccagggatttgcctaaacagatttaaatatcatttctattatccgcaactggcattcgtgttcatatcgcgaacggcgtaatagtatgacttgtattggttatcatcaatggtctaatatctatcacagtgttaagttaaggtttacaatgatgaaaatagagccttcaattttgccttctcttgcctggtttgcgctgattgttcgtgccggcagtttttccagagcagcctctgaaatgggtattacgcgggccgcattgtcccagaatttaaaatctcttgaggaacgtcttaacaccaagctgatataccgtacgacccgcaatatgtcgcttactgaggaaggacagcatctgtatgaagtgctggtgtcggctttggggcaaattgatgatgcgttgaaagatgtcggtgatacccaacttgaacctacaggactgttgagaataaattcctcccgtgttgcagcaaggatgcttgttgagcctcatattggcgagtttcttactcgttaccctaaaacaaagatagaactcattatggatgacggtttatctaacattattgcggacggctgtgatgtgggcatacgtcttgagcaaggactggatgagcatatgactgccgttcctgtttctccgcttattaaactggttactgtggcatcgccagattatttaaaagaacacggtattcctgaaactcctcaggaattgagtaaccataattgtcttcggttgcggcataaaagtagcggtgcactctcagcatgggagttttcgaatgttgtggggggtaatgaagagttcgaaatagaggtgtcaggtaagtatatttctaatgatgacgaaagcatgatacgaatggcgctgaatggaacgggtatcattcaacatctggattttgcaatcgctgaacatatcaatgcgggcaagttacagccgattcttgaggattgggccgtttcatttcctggattttatatatatgtttcatcacgggtgagaatgccctctaaagttcgtgcttttattgattttatggtggagaaaagagtaaaaatagaaagttaatgatgtgtgtcagaatatcggtaagaagaatggcgcaatcgtgaggatacgtttattcataataaatctcctgaaagtttagaattattttcgatacagccagattatcattgttactaataatgtggttaaaataatagcatctatgccccccttcatgagtgtgtgtgaagaggatgcttctacaaggaaatcgccaatgctcaaagaaaacttcaacgaactgcaaatctttcttgtggtggcaagagagcgaagttttaccaaagcagcgggcaaactcggcgtctctcagtctgcacttagccatgcaatgaaggctctggaggaaaggctcaatatccgcctcctgacacggactacccgcagtgtggctcccacagaagcgggggagagaatcattgcctgccttgaaccgcgtattgacgagcttgaacaggaactggaatcacttattcaattgaacggcacgccctccgggaatattcggttatctgccggggaacatgccgcgcgaagtctggtctggccgaagctaaaaccttttctcagagagtatcccgaaatcaatgtcgaactggtggtggataacggttttgtcgatattgttgaaggccgttttgatgccgggatacgactgggtgaaaatgttgataaagatatggttgcagtcaggattggaccagatatgcggatggctgtggtgggagctccggcgtattttgctgcaaaccctgcgcctgaaacgcctcacgagctacaaaatcatcgctgcatcaacatgcgtttgccaactgccggtgggctttaccactgggagttcgagcgagaagggaaaccgcttcgcgttaaggttgatgggcaactgacgtgtagtccattgccagaaagaattgatgccgcgttatcagggtttgggatcgcttgtgtccctgaagacatggttcaggagtatatagagtcaggcaagcttattcaggtgttacaggagtggtgtccaacttttcctgggtattatctttactaccccagccgcaagcagcatccgccagcttttgcgttgttgatcgatgcgcttcgctacaccgaataacgggtcctttatcctggacccgtttgggtattagcggcctacgcgtgcctgatgttcaggcgagtaacgttcaccgacgattttaattgtttccagcgcctcgcttatctgctgcgtatctttctgcgaaagaacaatgtcagcagcggccaggttttcttccagccggtgcagtttagtggtgccagggatgggaacaatccacggcttttgtgctaatagccatgccagtgcaatttgtgcagacgttacccctttctccgcagccagttcacctaacaaggtgaccagtttttcattggcttcaatggcttgtgctgcgaaacgcggtacggtgctgcggtaatcatctttgccgaaagtggttcccggcttaatcgcccctgtcaggaaacctttacctagtgggctgaaggggacaaaaccaattcccagttcttcaagcaacggcagaatttcctgttcaggctcacgccaccacatggaatattcgctttgcagggcggtgacaggttgtaccgcatgtgcacgacgaatggtttgtgctcctgcttcagacaggccgaaatgtttgaccttaccttctgcgatgaggtctttcaccgttcctgcaacatcttcaataggaacatctggatcaacacggtgttgatacagcaggtcaataacatctgttttcagacgacgtaatgatccttcaacggcttcacggatatgttccggacggctgtttaaaatctgctgcttattatcatcgccgaaggtaaaaccgaatttagtggcaattaccacgcggtcacgaaacggttttaaggcttcgccgaccacttcttcattcagatacggaccatacacttcggcggtatcgaagaaggtgacaccacgttcaatcgcagcacgaataagttcgatagcctgacgggtatcggtcgccgggccgtagccgtggcttaagcccatgcaaccgagcccaagggcggagacttcgagtccggatttacccagataacgtttttgcattgaatgaatacctcttttatcgcggcttaaacatcaagtttgcggccagtcagccattccaccattgcgggatcgcggtgagagaagaacgcgctggttgcggtatccagggcggtaatttgcagcatatcttcagggctgagttcaaaatcgagaatgttgatgttctcttccatgcgttcttttcgcactgattttgccagtgaaacaatgcctcgttggtagatccagcgcagaactacctggcccacgcttttgccatacttctcgccaattgccgtgagaacaggatgctggaacagaccatttttcccttccgcaaacggtgcccaggcttctggctgaatgccacgactttgcatccagggaacggcctgtagctgctgattgaaagggttaacttcaacctggtttaccgccggaacgacgttattaaaagcgataaggtctgccagtcggtcaggatggaagttactgacgccaatagcgcgaattttaccggcctgttgcagctcttccatggcacgccaggccccgtggacatcgccatatggctggtgaatcaagtacaggtcaacgtaatcaagttgcagtcgattcagagagcgttcgaactgggctttggccccttcgtaactggtatcctgcaaccagagtttcgtggtgacaaagagttcgttacgggcgataccgctttgtttcagggcgttcccgacctggatttcattttgataagaggcggcggtgtcaatcagtcgataaccgctgttaatagcgtcaatgaccgctctttcgcattcggcggcatcggtcatctgaaatacaccaaagcccaacaggggcatttcaataccgttgttcagttttactttttgcatggtgttatccttccgttatcgttcatgagaagcataacgtaaagggaagagctcgattagacggcaggatttgtcaggggttatgaacaaaattcataaatctgtttgagggttgagattagtcgtgcaagttcgatatccccggaatttacagtccgatgaataaaaatgaatgtccataaaaaatatattggtttatcccggcgtatatacttacttcgacgtactcccaatagcagttaattaaaggcgggtcattattattcactctgaataatgaattattcactgcccgcagagtaagaaatataacttaagtatctatttaatgacttgcacaaaaagctaaatttttacccataaataaaaatataatcccgcgcccaaccacctgatgagtggctacagacactggatatattaggtggcggtgtactttcttacataaaggtatttccttttctgtggaaaaggaaaccgggaaatccccggtttttctgacaagcagacgccattatttgtgtctgcctatgttcgttaattcgttcatcaggaaattatctcaatgtcacgttataaaacagacaataaacagccacgatttcgttattcagttctggcccgctgcgtggcgtgggcaaatatctctgttcaggttctttttccactcgctgtcacctttacgccagtaatggcagcacgtgcgcagcatgcggttcagccacggttgagcatggaaaatactacggtaactgctgataataacgtggagaaaaatgtcgcgtcgcttgccgctaatgccgggacatttttaagcagtcagccagatagcgatgcgacacgtaactttattaccggaatggccaccgctaaagctaaccaggaaattcaggagtggctcgggaaatacggtactgcgcgcgtcaaactgaatgtcgataaaaatttctcgctgaaggactcttcgctggaaatgctttatccgatttatgatacaccgacaaatatgttgttcactcagggggcaatacatcgtaccgacgatcgtactcagtcaaatattggttttggctggcgtcatttttcagaaaatgactggatggcgggggtgaatacttttatcgatcatgatttatcccgtagtcatacccgcattggtgttggtgcggaatactggcgtgattatttgaaactgagcgccaatggttatatccgggcttctggctggaaaaaatcgccggatgttgaggattatcaggaacgcccggcgaatggctgggatattcgtgctgagggctatttacctgcctggccgcagcttggcgcaagcctgatgtatgaacagtattatggcgatgaagtcgggctgtttggtaaagataaacgccagaaagatccacatgcgattaccgctgaagtgaattacacgccagtgcctcttctgaccctgagtgccgggcataagcagggcaagagtggtgagaatgacactcgctttggcctggaagttaattatcggattggcgaacctctggaaaaacaactcgatacagacagcattcgcgagcgtcgaatgctggcaggcagccgctatgacctggttgagcgtaataacaatatcgttcttgagtatcgcaaatctgaagtgatccgtattgctctgcctgagcgtattgaaggcaagggcggccagacggtttccctggggcttgtggtcagcaaagcaactcacggtctgaaaaatgtgcaatgggaagcgccgtctttgctggccgcaggcggaaaaattacggggcagggcaatcagtggcaagtgacgctcccggcttatcaggcaggcaaagacaattattatgcgatttcagcgattgcctacgataacaaaggcaatgcctcgaaacgtgtgcagacagaagtagttattagcggagctggtatgagcgccgatcgtacggcgttaacgcttgacggtcagagccgtattcaaatgcttgctaacggtaatgagcaaaagccgctggtgctgtctctgcgcgacgccgagggccagccagtcacgggcatgaaagatcagatcaagactgaactaaccttcaaaccggctggaaatattgtgactcgtaccctgaaggccactaaatcacaggcaaagccaacactgggtgagttcaccgaaactgaagcaggggtgtatcagtctgtctttactaccggaacgcagtcaggtgaggcaacgattactgttagcgttgatgacatgagcaaaactgtcactgcagaactgcgggccacgatgatggatgtgtcaaactccaccctgagtgctaacgagccgtcaggtgatgtggttgctgatggtcagcaagcctacacgctgacactgacagcggtggactccgagggtaatccggtgacgggagaagccagccgcctgcgacttgttccgcaagacactaatggtgtaaccgttggtgccatttcggaaataaaaccaggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggcctcaatccggatgcaccgtcattatcgggcgcagctgctgctggttctacggcatcaggctggacggataatggcgacgggacctggactgcgcagatttctctcggcactacggcgggtgaattagacgttatgccgaagctcaatgggcaggacgcggcagcaaatgcggcaaaagtaaccgtggtggctgatgcattatcttcaaaccagtcgaaagtctctgtcgcagaagatcacgtaaaagccggtgaaagcacaaccgtaacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagcctgcagccaccgaagccgcgcagctgactgttattgccggagagatgtcatcagcgaactctacgcttgttgcggacaataaaactccaacggttaaaacgacgacggaactcaccttcaccatgaaggatgcgtacgggaatccggtcaccgggctgaagccagatgcaccagtgtttagtggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaatgttgcaggtgacgcatctaaggctgagattcgtgatatgacagtgaaggttaataaccaactggctaatggacagtctgctaaccagatcaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcaggggaacttgagatcgaggcctcggtgaaaaactctcagaagacggtcaaggtgaaattcaaggcggatttcagtaccggtcaggcgagcctggaggtagacgccgctgctcaaaaagtggcaaacggcaaagatgcctttacgctgacggcaacggttaaggatcaatacggcaaccttcttcctggcgctgtggtcgtctttaatctgcctcggggcgtcaaaccgcttgcagacggtaatatcatggtgaacgccgacaaggagggtaaagcggaactgaaagtggtttccgtgactgccggaacctatgagatcacggcgtcagcaggaaatgaccagccttcgaatgcgcagtctgtaacgtttgtggctgataagactacggcgaccatctccagtattgaggtgattggcaaccgtgcagtggcggacggcaaaaccaaacagacgtataaagttacggtgactgatgccaataacaacctgctgaaagatagcgaagtgacgctgactgccagcccggaaaatttagttctgactcccaatgggacggcgacaacgaatgagcaagggcaggctattttcaccgccacgaccactgtcgcagcgacatatacactcacggcgaaagtggaacaggccgacggtcaggaatcgacgaaaactgccgaatctaaattcgtcgcggatgataaaaacgcggtgctcgctgcatctccagagcgtgtagattctctggtggcggacgggaagactactgcaacactgacggttactctgatgtcgggtgtcaaccccgtaggaggaaccatgtgggtcgacattgaggctccggaaggggtgacagaggcggattatcagttcctgccgtcgaaaaatgaccatttcgcgagcgggaaaatcacgcgtacatttagtaccaacaagccaggtacatacacattcacattcaactctttgacatatggagggtatgaaatgaaaccagtgactgtgacaattaacgccgttcctgcagatactgaaggcgctgaggagaaataaaaacgacgatgtaataaataataatggcgttgacatgcgcagcgccattatttactgaatacctaccctggcaccgattagacggtggcagggtagggtaaatcttatgtgatggagttacaggctaaaccgggcgaacggggataaaaatttcgcaaacaatgttattgctatcaatttcgacgaagttttcattgtaataaaatcgctcaatatcactgccgttcactctggctaaccccctggcaggtaattccatcagatagaggtttcgcgcccattcagggtagtgctcccactcaccttcatagcggaaagaggcatacagtcctcggttaattgtccactctttcggcatctctgaatcggtttgtttgcataccgtaccggcaaaagtttcaactgtgagcaaatcgaccgattttgttgatggttcgaacgtggagacgaaatagatatccgtcttaaaattcttcatacatctgactaaatgatgacgtcgcagtttgacttcttcatccggtaatttattcgacacttcaatatcatatttaaatgaattgccaaaaataggtgtctcaggaaagttgactaatctacactccgtcttttgctgttgacgtattaaaaaagaagggaagatatttgcgagatcccaataatcacggtggcggtattcacggggagagcagccgaataactttttaaattcgcggctgaatgactgctgtgaatcaaaatgcaaagagagtgcaatatcaagcatagatttcgcggagagccggacaagaatggcggcacgacaaagccttcgtttgcgaatgtattctcccaaaggcacatgcatgaaatttcggaacagaagctggatgttgcgtctgctgtagccagatttctgtgcgatatcttcgattgaaatagggtgctcaagattgcactcaatccactccaggagctgctgtagaatcttctgcctgatcatcacatactccgttaattctttgtcatatcgcacattttcgttatgtcctgggccctaagtgtatcaaaaacagcaagtcccaaggcaaaagcactgatagcgtctgcttcattgccccaaaaatagagaggtttcagtcctacattattaatgaattttttgcataagtgatatcaaaatccacatactaatttgaggttacgttttaacgtagactcattgttcatacctaatggagggactgacagtggaattttccgtattaagtaacaatctgaaaatgccgatgatgggatttggtgtttttcaggttaccgataaagacgtgtgcaaacagtcagtgttgaatgctatccgcacgggttatcgactcatcgacactgcagcggtatacggtaatgaagatgccgtcggtgaagccgttcgtgaagccatatctgaaggtttatgtacccgagaagagttatttataacgtctaaattgtgggtgcaggatatgttgaatcaggatattgcagcagcaggtattgaagcatcattaaaaaaatcggggctagaatacttcgatctctatttattgcaccaggccatgcgcgattattttagtgcgtggcgtgcactcgaagatgcctatgaagagggcaaattaaaagcgattggggtttccaatttctaccctcatgttctggcgaacttttgtgaaacggtaagagttaaaccgatggtcaaccaggtcgagttgcatccctattttgcccaaccagaggcgctggcaaccatgaagtattataacgtgcagcctgaagcatgggctccgttaggtggtggacgacataaaccctttgaaaataatctgcttcagagtattgcagatgcccatcaaaaatcgatttctcaggtcattctgcgttggaatattcaacggggagtggtcgttattccgaaatcgacacatcaacagcgtatcgaagaaaattttgctatttgggatttctcactgacagagaaagaaatggcgcaaattagttcgcttgatttgggttatgttggggaatcggtaaaacattttaatcctgagtttgttcgtggttgtcttgctgtaaaaatacatgattgatattaatcacttattttacctgagacgacaagaatcttttaataggggagtgatattgaccttcactctgtcatatctccggtaatatggcgtcaggcttcatcatcagaaagggagcctgacgcctgaaaaagtgaacaacagacagtgttcggattatcaatattcagtttttaacgttgaactggattcattactgcgttgtttaagaatatcccgcgccgaatctgccattatcatgacagcacctgccagcatcagagtatctttcaataccagacgaccagcaccggataaataagggaaaccatgatgagcgtcacccaatgcgggtacccatgcctccggggtggtgattaaaaatgagagtgttaccagcggcgtggtaaatgccatcagcccacccaataaacctaaccagcgattgacaggattagccaaaaccagcagagcaataatcacctccacgacgccaagaccgttggaaaaaccataggtattattagccgtttgccatgctcttgcttctggtttgtattcgccttcgtgagtcagatgctgtttatagtcttccgggtgttcataaaagaacgacattagtggactgtttgcgacgaatggtgtaatgctgtctgcctcgtaagggacaaactttaataacccaatccacataaaaacaatcgcaatactcagacgaatcaatgtcaggccaattttatctccccgacttaacaggtgcaggtatctttccattgtaaacatccttatttatacaatactgctgttgcggttgaattattatcaattcgcatcgatgtaactttccaggatgaagcattatattttctggccatatcagcaatggcattctcaagaactgtcggtgatgctgatactgatgagacgctgatatgtttcagaattattttatcatctgcattggtggaaaatgccataacgccagataatagtgttgcaaataaaacagattttttaaacatataaaataccatcaatgaagtgattaagaagttataaagtaacagggaattaataagattcttttctctgagacgccagaatatttgttctggcgtctgattttgagtttatttgactaatgaaaatagatcattgagtgattcgctcatcgacggatgagtaaatatctgatcgcgtaatatgctataaggcagcccggcatccatcaccattttcactatattgatcatctcgtgggagtcaacacacagcagtgatgcccctaatatacgttgggttttattatcaacaatcgcttttaataccccacgagtatcattcatcactctggcacgcggaattgcagctacaggcaatgtcaccacctgaatatcagcaccactctctctggcctgttcttctgtcataccaaccctggacagtggcggtgtcatgaatacggaataaggcacatttttccgatcatcagtactacgtctgccttctcccagcaactcatcacgcacaatgcggtaatcatccagtgaaatataagtaaattgcagcccgccggtaacatctcccatcgcccaaatattgtctgcggtggtatgtaattgcttgtcaacgacaattgccccgcgctcgtttactgcgatacctgcattttctggatgtaacgaagcggtagccggttgacgaccggaagctattaacagtgcatccaccgccagttgggcgtgctcgctatgcacttgcacttgattttcatggtgactgattcgctccacatgggcattgaggattatatcgacaccctgatcgcgtaaaatcgtcgcgatattatcagcaatatcccgatcttcccgaggcaaaaacagcgaagctgcctctaaaatggttactttgctgccaaaattagcgaacatagaggcgaactcaacgccaatatatccgccgcccaaaatacctaaatgcccaggcaattcttttagattaagtaatccggtgctgtcatatacaccaggcgtggtggtaattccaggaattggcggaaccacggcttgtgcaccggtattaataaaaattttctcgccatgaatctccagatttctcccaggccgatgaacacgcaggctatgattattgataaactccgcctggccgtcgatcacgtcgatattgggcatatccgcaagattatgaaaattcttattacgtaaaaaattaaccacttcatttttacgctgtatggcacggacaaaatctgtgtgctgctgtgcgtcatgaaccaatgttttggttgggatacagccgatattaatacaggtcccgccatacattgcatttgattgttcgatgagagccacacgccaacctgcttttgccagcgtgacggctaatgtttttccagccttgccaaaaccaataataactgcctgatatttattcatgatgatttcctgtcgaaacgcgttcatttgacatcatgactatagacgcaaaagagcaaataacatttcttcacaacgcttgatattttgtcttatcgtctggtattttctttttcttaatcagaatcacaaaacaaaaatcatgattaactatttgatggtattagattaattattgactaagattgttggtgtttgtaatcaaaaaaccactcaggagtctgatatggatgctcttagccgtttgttgatgcttaacgctccacaaggaacgatcgataagaattgcgtgttaggaagtgactggcaacttccacatggtgccggggaattgtcggttattcgttggcatgcgttaacgcaaggagcggcgaagctggaaatgccgacgggagagatttttacattacgcccgggaaatgtggtcctgctaccacaaaattcagctcatcgcctgagtcatgtcgataatgaatcgacctgtattgtctgtggcactcttcggctgcaacattcggcgcgttattttttaacgtctttgccggaaacgctgtttgtagcaccagtgaaccatagcgtggaatataactggctgagggaggcgatcccgtttttacaacaggaatccagatcggcaatgccgggagtggatgctctgtgtagccagatctgcgctacattctttaccctcgcggtgcgtgagtggattgcacaggttaatacagagaaaaacattctcagtttgcttctgcatccacgtcttggtgcggtaatacagcaaatgatggaaatgcctggacacgcctggaccgtcgaatcgctggccagcatcgcccacatgtcccgggcaagttttgcccagcttttccgtgatgtttccggaaccacgccgctggctgtattaacaaagttgcgtctacaaatagcggcccagatgttttcccgggaaatgctccctgttgtggtgatcgctgagtcagtaggctatgccagcgaatcatcttttcacaaggcgtttgtccgcgagtttggttgtactccgggagaatatcgggaaagggtcagacagcttgcaccctgaataaaaccgccagaaatcagggcaaagataatccgcattccgggagttgtgagcctttcaactatttctatttccaacggtagttttgggctttatatattttttttgatggactctagctcagtttttaaataaaaatgcaaactaaattgcttcaattaaataaaatcccgactattacttgatacgtgattattgtcggtgatttttttgtgcaccatcagtgtatatctcaataacccctgaataagtagctctgaataggtataaggggtgtagcctttttaaatggatttcttatgccaaaaatgatcgtcgatttccccataaaatgtgagcgatgccgaaagaaataaaattagttattgcatttgaagtttagatgaaagattattatttgtcatacaaatgaggggtggtatgttgctagccaattaaaaaagaacgccatatttattgatgattgatcccccggaaggggggaaccatcgggcataaatgggcatgaagtaatggagtattagttgtgaatgtcaatttctttgtcacctgcattggtgacgccctgaaatcaagaatggcacgagactccgtgctgctactggaaaaactcggctgtcgcgtaaatttcccggagaaacaaggatgctgcggtcagcctgcgatcaatagtggttatatcaaagaagcgattccagggatgaaaaatctgatcgccgcactggaggataacgacgatcccattatttcaccggctggctcttgcacctatgccgtaaaaagttacccgacgtatctggcggatgaacctgaatgggcatcacgtgccgaaaaggttgccgcgcgtatgcaggatctcacctcttttattgttaatacattaggggtagtcgatgtaggtgccagtttgcaagggagagcggtgtatcacccatcttgtagcctggcccgtaagctgggggtgaaggacgaaccacttacgctgctgaaaaatgtgcgtggactggagctgttgacctttgctgaacaggatacctgctgcggatttggcggcacgttctcggtcaaaatggccgaaatatccggcgagatggtgaaagaaaaggttgcgcacctgatggaagtccgccctgagtatttaattggtgctgacgtgagttgcctgctgaacatcagtggacgattacaacgggaagggcagaaagtcaaagtgatgcatattgctgaagtgctgatgagccgctgaggatataaagatgtcgatcaaaaccagtaatacagattttaagacacgcattcgtcagcaaattgaagatccgatcatgcgcaaagcggtggcaaacgcgcagcagcgtattggggcaaatcggcaaaaaatggtcgatgaattggggcactgggaggagtggcgcgatcgggccgcccagatacgtgatcatgttctgagtaatctcgacgcttatctgtaccagctctcagaaaaagtgacgcaaaacggaggtcacgtctattttgcaaaaaccaaagaagacgccacccgctacattttacaggttgcccaacgcaaaaatgcccggaaggtggtgaaatctaaatcgatggtgaccgaagagattggtgtcaatcatgtgttgcaggatgccgggattcaggtgattgaaaccgatctgggtgaatacattctccagctggatcaagatccgccctctcatgttgtggtcccggcaattcataaagatcgccatcagatccgtcgagtgctacacgaacatctgggctatgaggggccggaaacgcctgaagcgatgaccttattcattcggcaaaaaatccgcgaagatttcctcagtgctgaaataggtattaccggctgtaatttcgcggtggcagagaccggttcggtatgcctggtgaccaatgaaggtaatgcgcgaatgtgtaccacgctgcctaaaacgcatattgcagtgatgggaatggagcgtattgctcccacgtttgcagaggtagatgtattgatcaccatgctggcgcgcagtgccgttggtgcacgtttgacgggatacaacacctggctgacaggaccgcgcgaagcggggcacgttgatggtcctgaagagtttcatctggttattgtcgataacgggcgttctgaggtgctggcctctgaatttcgggatgtgctgcgctgtattcgttgcggggcttgtatgaatacttgtccggcatatcgccatattggcggtcatggatatggctctatttatccagggccaattggtgcggtgatttccccgttacttggcggttataaagattttaaagatttaccctacgcctgctctttatgcaccgcttgtgacagcgtgtgtccggtgcgtattccgctgtcaaaactgattttgcgtcatcgtcgggtgatggctgaaaaagggatcaccgcaaaagcagagcaacgggcgataaaaatgttcgcttatgccaatagtcatccaggattgtggaaagttgggatgatggctggtgctcatgcggcaagctggtttatcaatggcggcaaaacaccactcaaatttggcgcgattagcgactggatggaagcacgcgatcttcctgaagctgacggagagagtttccgtagttggtttaagaaacatcaggcgcaggagaaaaagaatggataatcggagcaaatttttgaataacgttgctcaggcactggggcgcccgctgcgacttgaaccgcaagcagaagatgcgccgcttaacaactatgctaacgagcggcttacccaacttacccaacagcagcgctgtgacgcgtttatccagtttgccagcgatgttatgttgacgcgctgtgaactgaccagcgaggcgaaggcggcagaagctgcaatacgtctgtgtaaagagctgggagatcagtcggtcgtgattagtggtgacacgaggctggaggaattggggattagcgaacgtttgcagcaggaatgcaatgccgttgtttgggatccggcgaaaggtattgagaacatatcacaagcagagcaggctaaagtgggcgtcgtatatgctgaatatggtttaaccgaatcgggaggcgtggttcttttttccgccgccgggcgcgggcgttcattgagcctgctcccggaatcttctctttttatcctgcgtaaaagcacaatcctgccgcgtgtagcgcaactcgcagaaaaattgcatcagaaagcgcaggccggtgaacgaatgccgtcatgtattaacatcatcagtggtcccagttcaacggcggacattgagcttatcaaagtcgtcggggttcatggtccggtgaaagcggtgtatctgattattgaggattgctgagagagatatgtagtctggacataaacctgaaggcggtatacgaggttgtgaatagcgttaaggacaacctgacttaaccccgttccgtcatggttatgcagctcttctgtaaatatcctgacattaataatgccaggatatttacagttaaaaagacaggaatccattcctgaagacgggctcccttcccggtcactgtcactatagttttatacaggcactctctgtcagaatgctgtttattactgcccagagttttgttggtattcatctaccatttttttgacaaggcaaaacatcacagaaatcacaatacttagaaaaaatcccagagccaggcaaatggcagcagggtatttattttttatttctggtgagcttatagtgacacagccatcaccgttcggatacagtgaccagttcctggtcaggtatatcatttttgtataaagctcactgttaattgctgaaggcgtttgtatctcatcgagaacttgcctgccattatggtattctgacgcataccatttgatgatagacgcctgcacgcgagatatttccgcttcagcagttggtaaatctctcttatttcctgaccattccagctttatttctctgttcttgacatctgggctggtctgaaaaaatgtagtaattcgctgaataacatcttcagtcattgtggtctgacaggcaaagttattattgctatcacagctaacaagtatgcctggtgttgtctggtttatttttagactgtaagtcacttttatattatctttattgatatacagaaacaacagcaccattaccatacagatagctataataaaaaggataacacgaatctttttcttcagataaaataaaatctcaatcagatcgatatcctgtttgatttgttcattcataatatatccagaaaatgaaatctgtcgcagataagattgtattaatagtctgtatcaggaatgttcagggtaaatatcagcaaaaagccagcatcatgaatactggatatttatagcctgcaggcagcatactgctgcctgcagggggtataacagtcgacaggggaaccgactgctttattcttaccaggtcacattgataccaactacaccctgtagcgggttctcaatgtcgtcacctttggtgtagtcaaggcttgcatatgctcccatgtttttggtgatatcagcctgtacacctgcacccacgcggaatgctgcaccgtcaatgctggcattgacagactcatcacccagacggactttgttgccatcagagaattcgttcagtgcggccagattcagataaggtttaacggtcgcgttgcccacagcgaagtcataacccacgcgcgtaccggcctcacccagcacagagttatagctgtcagaatgaacgtccacgccgttgagttgataatccacaccttccagagtcagagcagacagtttggcatatggctgaataaacaggccattaccgtctttccatgtgtaaccgcctttaaccatcgcaccaaaaccattggtgttaaagtcagctttgatggtaccgccaccattcatcaggcgaacatctgccgtgttgctgtagtgaccaaactgtgcagcagtatcaatgaagataccgttgttatactggcggctcaggtaagcgtggaagctgtaaccttcagtgtcacctttgctctgcatggtagtcatgtcacctttcgcagaagacatcgccacaccggccagccagctaccatcttcagtcatgaagcgggtatcaccacccagcattacaccatttacatccaggtcataggatgcatttcccgcggtggtatgtttctgtttaccgccaaagtactgaatccatacgccacccttgtcattttcgctcagacggacagcatcctgacgggcggagagcgtgtcagcctgcagattagcgacgttagccggagcagctgccattgcctgaatcacggagctggcgttggatgctttatgcgtgttttttacgaaataaaagttaccatcagctccctgtgtcaggtcatattgatacagaccaccttccgttgtgcctgtggcttttagagtgctgtctttgccggtagaaataaatgccgtttgttcattgataagatccaatgaacccgcactgtaaacacgcaagtcaccgctcgctttaccgctgatatccagagtgttttcagaagaggcatcaacaatcagagtgccgttttgagaagcaaacgtgccagtattgactgtagccttcgtgatattaaccgtactgtcttttactgccagagcatcaacagttgaggaacccgtaacattccagacagacccgttttgcagagatacactggcatctcctgcccctgaaactttgcctttccagactgaactatcggaaagatttatatccagatcactacccgctttatcgccgctattgaaggtataagcattaccttcccagtaagagcgggcaacgttcatatttacatttgttgtggtactggctgaattctcgctttcagaaagggccaggacatcagagtagatggttgaatcagcaacagacaaatttaaattttgcgttgctgaacctgcgccttgtgccgaagcagaggcataaattgtttgtttattattagccgccccaattactgagccatccttaatattcaggttgactgtatgaattcccgtcttattcccggcagtaactattgtttcaatcccgccattaataatatttgagtcagcaagggtgatgttgtcggttgcatcaccgtcaaaaccctgcaacaaattacccttttgagcaaaaattgccgtagagccgttgctgtaactcttattaccttgagcatttatggttgtaccattgagcgttaaattatttcccgtggtcgcttccagagatatccctgtcgcactacctttttcattttttgcaacgaaattaccgccattaacaacaacatcgccagttgaatcaatgaccattgcagtccggacataggtgccttcaccttgagctgtgatggtggagtctgtagcattaatcacaacatttttgttaccactaacttttacaccttcaacgaaatcttggtttaccgttgatgcggcggtaatatcgtgaccgccaaaagtaacattaaggtctttatctgaatctgacgtttcaattgttacggctgtaatcttgttatcaccgttaataacaacatcttgatccagagtcgtcttctctgtattcagcgtaaccggatcagttgataccgtgctatcagtagcgaatgctggtgcagaaagagccataacaatagctgtcgctaatgcgctgcggtaaaatgccttactgtttttcatgaagaaattctccattctggtaactaatttcaatttcccacttatttatatttatgcagagataaagcctgcgtccctgcatttaccaccacggaatacctgttggtatttccgttttcacgcaatgtcatggcattcgttgtttccaatgcatttccatcaccgtgaaaattattgctgctcagcagcagggcttcccgcaatgacatgctgtccggtattccccaacgcttttttagcgactgctcggcaagccatatctgtcttatccccgttttgagaaactgcgcactgtattcccagctgtgtccggcaagaagtaacgacaacaccttcttttgcttttccgggaagcgttctgacatgacgattgtctttgtgcggttattcacctctttcataaagacagagtaactgtccataactggcaaaatttctgcatgcttcagccctgaaaacccaccagaggcatttgcaatactgatgacacgctctactgacattcctggtttcagtaacctcaggtttttgagaacgccagaaatactcacatccggtggcagaaaaaagggcgcgacgcacaacaccaccacgaatgagtgatcccgataaaatcggaaccacatttcagcgcattcggcaggtcgccctgccgatatcacgacactctgtggcctgtgccgcaatttattgcgtaactcctcttctgttctgatgcaggtaacattgccgacagaaccggttgatagagctgcgaactgcgctggtacaattcctgagggacagaaaagaacgaaacgcatccttccctcacagatgtcagtacgccagcacgctgtacaggctgtacagcgtgcctcccaatcctgcagcccagaacagtagaaatattttggctcctacactgtagcgagtccgtatgcgccgcagtgggtggtagtaacaacgctgctgtgtcataacaatcctggtctttttttagatatattttttctttgtccggaaagtacttttccggaaatggcgtcagaatttattgattcaccaacggcaactttctctggataaaggattccggataccatgttctgcacatactgagtgagtcgatgagcggaatgttgtccgatatattttgcatgtagccgtatattccgtttcactctgctgtcaccgcatcccgtatagagcagcctgaaatcgctcagtgttcccagtccaagtttcattaaagcccgtgtggcaatcgcatgcagggtctttgaactgcgttgttcataacgggcaatctcactgaaactcatgccctgcatcagaatcttaagcacgctcaactcccgtgcagtcaggagccagaaatcgctcatatcgccgggcaaaggacgtagtaaccagcggataatttgattctgataacgactcgctgtcagcatggtgccgatgcgtgggaagccgttatacagacttgcagcaggagcattatcgaaccagtcggagtcaccggtcaggcagacctgccattgcccggcatcactccgcaaacgggcgagacaagccagaagaaccaactcccccgaaggaagcgaagggatatcagctaacaggtagccacaggaggtctttaaaacgaattcaacctctgtagtgacgttgctgtacacccgcacgatatacctgtccgttgggatgagagactccagtgccagcctggtgaactgacaggcactgataataaccagaggcttcttcattcagactcgtccacgccattgctacaaaacctgacattttgattcaaaatgtcaggtttggtttaatagcctgaatatttaattttcttggaatataaatctaatttgtttgatttttattgtttttaattttgtattatttaacaatatgggcgaaagttaatcactggtatgacctttgtgattaatcatttcaaatcatggggttattttactttagctagaaatatcaacatgttatgtgttttatttaattgaatgggctgtttttttatggaagaattgaggaaaacgtaggaatctgacattttgaatcagaaggtactgttttaacgaggcttttttttccacacccctttaaaacgagcagcattactggctgtgtatctgacagtatgctgaatatttcgatgacccaggtaatcctgaagtagtcgggtatcgacaccattgtcagccagagcaaaaccacaggcatgacgtaacatatgaggatgtgcttttacagctaatcctgcacgttttccagcctcacgaatgatagaaaaaaaatgttgtctgctgatagggcggcgtttccgggagagaaaaagccagtctccttcaactccgttttcaattaacttcctctgcttaagccacaacttgatcaaattatattcatcaggaagaagaggatgtgttgtcgagaaaccatttttaatacgccgaatattaagttgttttccagatgcatcaatatcggataaacgtaaatcaagaagttcactggccctaaaaccgtgaatgaaagccatcataatcagacagcgatttctttcaggaaaggacatgctctgggctgcatccatcagcctgtagacttcatcctgtgtgagatattttctcgtcatacgccaccgtgtacagttgtaaaaaaaagagaggcacacccagataagtatgcctgcaatcagaacgttatcgatgtaatctcattatctcattaataagattttttgaatagtagttctacgcaacagattaaatatgaactatttattgtgcagcttttctacaagtcatttttaatgcgtgtttttatctactataatgtgaaaaaaataaatattaaaactatgagtgacaggtcgtgtgggatgtgtattacgtctaatgctttagtaattttttattatttctgagatatttaacatcatttcctgtgagattgtcttgttgtgtatctaattgattttaattttgttttttttttgatgcataaatttggatgatagaaagtaagattagcttaatatcaatgatatgaatttataaatacatattgttgcaaggtgttctttacttttttggtcgttagtaaatcattgttaatgggttctgttcataaattaaaaatattcatttaaatgatttttactttttgtatatctcaatttgtttattttgcattcatttgatggagagtattccaacactttttatttttcgcaaaaaacttattaacaactttttattatcaattgaaaattaatgtaaactaaaatgttagcgaagcgataatcttgtgctaaaaaatatttaagcatgatgattaattaaagaagagtaaaaataaatcgctgctaataaattatacgaaccgtgtttaaagctccatgtggttttggtctgacttatttttgtactcgttacaagaacccttttcgtacatgctaaccgtgagcgggaatgaacaggtaaccatagccaggaacattagcggcgtaattcttaagctgagtggtatttcatctgtagtttatctgtgtatgcatagcaccttcatcagccagattgagcaagtcagcttagaatttgctggtgagattgtcacgatgaagcatgagagttacctcagtgttttatataaggattcggtcctcatagtagaacggtaactctcaatctgataggttcctgagtcagttcacatcacgactcatttttttcgctctcaccggcatcccatttgccacaaaatatcttgccgtgctcctcggcaacgcatccttcccgcgaatcatatccgccattttctcgccaatcataatcgtcgtggcgttcaaattgccggtgataatctgcggcataattgacgcatccaccacgcgcaggccttccagcccgtgtacgcggccttcggcgtcaaccactgccatctcgtcataacccattttgcaggtaccgcacgggtggaaggcggtttcggcgtggttacgcacgaactcatcgagctgctcatccgtctggcattcgacaccggggctgatttcgcggccacgatactgatccagcgccggttgatgcatgatctcccgggtgatgcgaattgcgtcgcggaactcctgccagtcctgctcgtgcgacatgtagttaaacagaatcgccggatgctggtgcgggtcgcgggatttaatccgcacatgcccacggcttggcgagcgcatcgatccgacgtggcactggaagccgtgctctttcactgcgttcgagccgttatagttaatcgccactggcaggaaatggtactgaatattcggccacgcaaattcctcacggctgcgaataaatccgcctgcttcaaagtggttgctggcaccaacgccggtgccgccaaacagccactccgcaccgattttcggctgattccaccactgcagggcagggtagagggaaaccggttctttgcactcatattgcagatacatctccaggtgatcctgaagattttcgccgacgccaggtaattcatgcaccagcggaatatcaaactccgccagcagttcagcgttgccgacgccggagcgttgcaggatctgcggtgaagcaatcgcgcctgcacataacagcacttctttattcgccgccgcgcgggtcggaatggtgctgtcgccttccagccactcgacgcccaccgcgcgtttgccgtcaaaaaagatgtgatcggtcatggcgtgagtacgaatggtcaggttagggcgcgatttggcctgatcgagatagccacgcgcggtgctggcgcgacggccatgcggcgtgacggtgcgatccatcgggccaaaaccttcctgctgatagccgttgagatcgtccgtgcgcgggtagcccgcctgcacgcccgcttcaatcatcgcttcaaacagcggattgacgccgggtttggaggtggtgacgctcaccgggccatcaccgccgtggtagtcgttctcgcccacatcgcgagtctcggccttgcgatagtagggcaggcagtcgagataactccagttctccagaccaggttcttgtgcccagttatcgagatccagcgcattgccacggatgtagcacataccgttgatcagcgatgaaccgcccagacctttgccgcgtccgcactccatgcggcggttgttcataaacggttcgggttccgtctcataggcccagttgtagcgtttgccctgtagcgggaacgccagcgcggcgggcatctgggtgcggaagtcaaagcgatagtccgggccgcctgcttcaagcagcagcacggttgtgttcggatcttcagtcagacgggtagcgagaacgttgccggctgagccggcaccaataatgatgtagtcaaattgcaaataaacctcctggttagaatatggactggaatttagccatctcaacctggatggacttcacctgggtgtaactctggagcgtcatcactccgttctcgcgaccaatgccggagtgtttgtagccgccaacgggcatctctgccggggattcgccccaggtgttgatccagcaaatacccgcttccagctgatgaatgacgcgatgcgcgaggttcaggtccgccgtcacgatacccgccgccagaccgtagtcggtatcgttagcgcggcgaatgacttcgtcttccgactcgtaggtcagaatggacatcaccggcccgaaaatctcttctcgcacaatggtcatatcgtcgctgcaatcggtgaacacggtcggtgcaacccatgcgccgttatcgaagctatcccccttcagtacatcgccgccgcacagtacgcgcgcgccttcctctatgcctttggcgatatagcgcagcacgttatcgcgatgcgggaagctgaccagcgggccgaagttagtttgcggatcgaaaacgtcgcccgcgcgaatgcgctcaacgcgcgccagaatcttttgttcaaatgcggctttgcatttcgtcggaacgaagacgcgagtgccgttggtacacacctgaccggagctgaagaaattcgccatcatggtgatatcggcggcgagatcgagatccgcatcgtcgaaaacgatcagcggtgatttaccgcccagctccatggtcacttctttcagggaggaagctgccgagttagccatcacttttttgccgctggcgacacccccggtaaatgacactttggcaatgcccggatgatcggtcagatattgcccggtctccgcgcccacgcccggcaacacgttaaatacaccgtccggcaggcccgcttcgctgtaaatttcagccagctttaacgcggtaagcggggtgacttcgctcggtttgaagatcatcgcgttacccgccgccagcgcgggggcggatttccacaaagcaatctggatcgggtagttccatgcgccaatccccgccaccacacccagcggttcgcggcgggtataaacaaatgacgtctcacgcaacgggatctggctgccttccagcgccgggatcagcccggcatagtactccagcacgtccgcaccggtaacgatatcgacggttgaggtttccgaatatgcttttccggtgtcgagggtttccagttttgcgagttcgtcattgcgttcacgcagaatatcaacggcccgacgcagaatacgcgagcgttccatagcggtcatcgccgcccagattttttgcccttgttgggcactcttcacggcgcgatcgacatcctcacgcccggcggcctgcacggtcgccagcacgttaccgttggccgggttaatggtctcgaaggtgcgaccgctggtggcggaggtataaccaccatgtatataaagctgctgttctgccattcgggacatcacgtttcctcggttaatcggtgggtaaatgctgagtaataaagtgacgggtcagcgagtgtgcgagaggtttatccagcgctttgccgctcagtgccgcgcgcagccataatccgtcaattagcgcggcaaggccgtagcccgcttcctgtgcctgttggcgcggtaactcgcggcgaaattcgctcaccagattcgacaataagcggcggctactgacctgctgcaagcgatagagcatcggctgatgcatactgctggcccagaaggccagccaggctttcatcgccgcactgctcacctgggtttcatcgaagtttccgccaacaatcgcctgtaatcgcagctctgcactgccctgcggaagtgcatgtaatcgattcaaaaccgcgtcacgcagctgactggtgatatcgcgcatggttgcttccagcagaccatttttgtccctgaaatagtggctgatgatccccgtagaaacgcctgcacggcgggcgatctgcgcgatcgttgcatcgtgcatgcccacttcatttattgcttccagcgtggcgtcgatcagttgtctgcgccggatcgactgcatccccaatttgggcattttcgccactccattaatcagcgttgtttatctattaaagcggttattgattggacgttcaatataaaatgtgtcttaattgttactaatttgattttaaatggtaacaataacagtggggatactggatgacagacctttcacacagcagggaaaaggacaaaatcaatccggtggtgttttacacttccgccggactgattttgttgttttccctgacaacgatcctgtttcgcgacttctcggccctgtggattggccgcacgctggactgggtctctaaaaccttcggttggtactatctgctggcggcaacgctctatattgtctttgtagtctgtatcgcttgttcgcgttttggttcggtgaagctcgggccagaacaatcaaaaccggaattcagtctgctgagttgggcggcgatgctgtttgctgccgggatcggtatcgacctgatgttcttctccgtagccgaaccggtaacgcagtatatgcagccgccggaaggcgcgggacagacgattgaggccgcgcgtcaggcgatggtctggacgctgtttcactacggcttaaccggctggtcgatgtatgcgctgatgggcatggcgctcggatactttagctatcgttataatttgccgctcactatccgctcggcgctgtacccgatcttcggtaaacggattaacgggccgataggtcactcagtggatattgctgcggtgatcggcaccatcttcggtattgccactacgctcggtatcggtgtggtacagcttaactatggcttgagcgtgctgtttgatattcccgattcgatggcggcgaaagcggcactgatcgccttgtcggtgatcatcgccactatctcggtgacatccggtgtcgataagggcattcgcgtgttatcggaactcaacgttgcgctggcgctgggattgatcctgttcgtgttgtttatgggcgacacctcgttcctgcttaatgcactggtgctgaatgttggcgactatgtgaatcgctttatgggcatgacgctcaacagttttgccttcgaccgtccggttgagtggatgaataactggacgctcttcttctgggcatggtgggtggcatggtcgccgtttgtcggcttgttcctggcgcgtatctcgcgtgggcgtaccattcgccagttcgtgctgggcacgttgattattccgtttaccttcacgctgttatggctctcggtattcggcaatagcgcgctgtatgaaatcatccacggcggcgctgcatttgccgaggaagcgatggtccatccggagcgcggcttctacagcctgctggcgcagtatccggcgtttacctttagcgcctccgtcgccaccattactggcctgctgttttatgtgacctcggcggactccggtgcgttggtgctggggaatttcacctcgcagcttaaagatatcaacagcgacgcacccggctggctgcgcgtcttctggtcggtggcgattggcctgctgacgctaggcatgctgatgaccaacgggatatccgcgctgcaaaacaccacggtgattatgggcctgccgttcagctttgtgatcttcttcgtgatggcggggttgtataaatctctgaaggtagaagattaccgccgtgaaagtgccaaccgcgataccgcgccgcgaccgctggggcttcaggatcgcctgagctggaaaaaacgtctctcgcgcctgatgaattatccgggcacgcgttacactaaacagatgatggagacggtctgttatccggcaatggaagaagtggcgcaggaactgcggttgcgcggcgcgtacgtggagctaaaaaacctgccgccggaagagggacaacagttggggcatctggatttgttggtgcatatgggcgaagagcagaactttgtctatcagatttggccgcagcaatattcagtgccgggctttacctaccgcgcacgtagcgggaaatcgacctactaccggctggaaaccttcctgttagaaggcagccagggcaacgacctgatggactacagcaaagagcaggtgatcaccgatattctcgaccagtacgagcggcaccttaactttatccatctccatcgtgaagcgccgggccatagcgtgatgttcccggactcgtgattgttattgcataaaaccgcgccatgtctgcatatggcgcggtttctcttacctcttgatacgttatatctgtgtacagttaagcccttagtatcgattgatgattgccaggcaacagataataaaaaagaaaagaactattgaagcccaaaacctacgtttggactgttgtgaatgttcaataagcttagtcttatttaatgtaaatattggtgctaatttgaaatgacgctttattcatggggaacgcgtagcgcaaatcaactaaaatcaatgtaactgtttgttgtttaaggtttaattgtctgtgtctgatattttatcgattgttttaaatattgtttttattgtcattgttataatgttggctatctattgctgaatggattcagtcttaagaagcaggttgttaagggataggcatagagtaatgacgtgtatgcataaccaacatctttactcattatgtcattgaatgttgacgctatgtgtttatgaggttgaggtattttcagttgatctggattgttaaattcatataatgcgcctttactcatgaatgggcgtcaatacgtagtgggaaattataaatatcgaaatagtccaactacttctttattaccaaaaatgagtatctgaattttaatattgcattcttgcgtgattatctcctgagtttgacttgtgattacctttttaaggtatttagcgtaactgtttttgagcgagcatcagaggtaaagataatcttcttgatagtgatgtgggatgttatacgtatggcatcgctaatgtttatggttaccccttatgtgtgctcaggaatccacaggtaatcactcatactgaacagcgataaaagataaaaggtgtgttcatgaattcatgtgattttcgtgtttttctgcaagagttcggtacaacggttcatttgtcattgcctggtagcgtatccgagaaagaacgactgctactcaagctgctgatgcagggaatgtctgtaacagaaatatcacagtacagaaatcgcagtgcaaagaccatttcacatcaaaagaaacagctctttgagaaactggggattcagagcgatattactttctggcgggatattttctttcagtacaatccggagatcatatccgccacgggtaataatagtcacaaatatattaatgataatcactatcaccatatcgtcacgcctgaagccatcagtctggcgttggaaaaccacgagtttaaaccgtggatccaaccggttttctgcgcgcagactggggtactgacgggctgtgaagtgcttgtccgctgggaacatccacaaacgggaatgatcccaccggatcagtttattcctctggcggagtcatccggtcttattgtcataatgactcgccagctgatgaaacagactgcggatattctgatgccggtaaaacatttgctgccggacaatttccatattggtatcaacgtctcggcgggctgttttttggctgcgggatttgaaaaagagtgtctgaacctggttaagaaattaggtaacgataaaatcaagctggttcttgagctgacggaacgtaatcctattccggtaacgccagaagccagagcgatatttgacagccttcatcagcacaatattacttttgcgctggatgactttggtacgggttatgcgacctatcgttacttgcaggcgttcccggtcgattttattaaaattgacaagtcgtttgtgcaaatggcgagtgtcgatgaaatctccggtcatattgtggacaatattgtcgaactggcgcgtaagcctggtctgagtatcgtggcggaaggggtagaaacccaggagcaggcggatttaatgatcggtaaaggcgttcactttttacagggctatttgtactctccgccagtaccgggtaataaatttatctctgaatgggtaatgaaagcaggtggttgatgtaaaccgctattcacagcgcatcgggaggttggcagcgattaattctcccgatgcagtaaatcctgatagatccccgttaatatgccatttggcgcaaattgttttttaatccactgcgtcacctgaccggtggcagagtgctgggttgcgagtaacatgcgtgaatcctggcgcgggttatggatttgtcgggtaaccagcaaggattgcgccatcgcctcacggaccatgtaatccggcaaaaaaccaattccttcacctaaaatctggcactgacatttggtgttgaaatctggcaccagaattgactcctgcccatgcagcaaccagcccacttttttattaatcgtatgcgcggtgtcctccaccatgatattagggtagagacgcagctggctttcggcgatcggctccggcacaaaggctaatgggtgatccggggcgatggcaaaagcccagcgaatcgcgccaatctccgtgtaatcaatgccgccgccgtccagcagcgtgtcgggcgcgccgatggcgatatttgcctgattattaataatcgcatcccagacgccgttatacacttcggtcgtcacggtaatctggcaggtaggaaactgctttttcagcacctgtaataagcgcgcggtgtgtttgggcgtataaagcagctgattaatacaaatgcgcacacgcgcttctatgccctgcgaaatagtatcgatactgcgtttaatggcgtgaaaatcattcagcaggtcggtagctttgcggaaaaaataacgcccggactccgttaactcaatgctgcgggtactgcgagtgaacagcaccacatccagccctgtttccatacgtttaatggtgtagctaatggcggaagtggttaaacccaactcttctgcggctttactgaagctgccaaaacgcgcagcggtagtaaatgccaacagattctcttcggtaaaaattgagttcatcgactcgctcccgccattttcgattctgaatttctccagccatgactgtagaggtatccattaaagatggataatcatttttgaataacttttaatacccgtcgcttttggtcgtcgcttcgcttaatttttgtccgccgtattctgaaattatccccacgcagttacccgccagaaaacccagtaatgtcaccgtccagttcatcccgctggcaaaaaatagcgtcatgccgagaaagcctccgggaataaaagacagtaaccagaaacgcccttgccagaccaccaccgccgagaagggtacagtcgtaatcacgctcgcccagaacgcggacagtccactcaccggggccagccaaccggcagccagcgcggcgaaaaacgcccacaccatcccggaataattaaccgccaggcttttgataaaccccgatttaccgccgcctgcggcataaaaactgcaaaaggcgacgaagccaatggttcctaataattcccatccctgagagagcccgacatgtgaagacactaactgccaaagccctgcacaaataccgacggtgacacccgttgccgtgagtccgttcatcttgttcccctctggttagacatggacgaaagctactcttacatgtgcagactatagagaaataaaacctgattgagtgaaagggtatcgggtcaaagaaacaaatattgcactaccgcacacggcgaaaagattgttgaacatcattcaacaaaaaggcgaaatacggcgaattaaatttaagcgggttcttttatcagattatcgttgctattctcaattcatcgaaaacagccacaaaaaccaggtgaatgtgaatgactataaaaaatctacctgcagactatttattggctgcgcaacagggggatatcgataaagtaaaaatctgccttgcgctgggtgtcgatattaatacctgcgatcgtcaggggaaaacggcaattacgctggcaagtttatatcagcaatatgcttgcgttcaggcattaattgacgccggagcgaatattaataaacaagatcatacctgtttaaatccttttttaattagctgtctgaacgatgatttaacgctactacgaattattttaccggctaaacccgatcttaattgcgtaacccgttttggcggtgtcggcctgacgcctgcctgtgaaaaaggccatttaagtattgtaaaagagcttttggcgcatacggagattaacgttaaccagaccaaccatgttggctggacgccgctactggaagcgattgtgcttaatgatggcgggattaaacagcaggcgattgtccagttattactggaacacggtgccagcccgcatctgacggataaatatggcaaaacaccgctggaactggcgcgagaacggggctttgaagagattgcgcagttactgattgccgcaggcgcataaaccgggaggcttgctatcaacacaccagaaagacggtgtgtgtgggcgctaactgcggatgctgattttctggcgcagcgggggcaaggacaggttgaacaggtctttgccagagcggtaaatatcgcactcccggctcgccagcagttgctgacgctgctttgtgaagagtacgacaatgcgccaaacagttgtcggttggcactcactcactttaatggtctgttccggcatggtgataaggttcagtttgacgatcaaggcattacggttggtcaacatcttcatatagagatgagtcattgccagcgttggctgtccccaaccttgcaaatgaccgctctgaattttcaccttatcgcctggcaacagtggcacgacattattcatcagcacctgggggaaaatgaaaccctgtttaattatcgcggcgataatccgttttatcaggcgttaaataaagaactacatattaaacgacgggcagttattcaggccgtaaacgataaacaaaatatcgccgtagcggtcgccagtatgatgggcttagggattggccttacgccatcagccgacgattatttaacaggtctggcgcttattttatttcttcccggacatccggcggaaaaatacaaagaggaattttatctcggtctgcaacgcggcagaaataataccacgttattaagtgccatcacgctggaagccgcattacaacaacgctgccgggaaaatattcatcgttttattcacaacattatttatgacatccctgggaacgcaactcaggcaatagaaaaaattaaacatattggctccagttccggctgcgacatgctgtatggcatggccgatggttgtgcgctgagtcaaacctacggagggaattatgtcagttaaaatagtcattaaaccgaatacctattttgattctgtctcgctgatgtctatctccacgcgtgcaaataaactcgacggcgtcgagcaggcatttgtggcgatggcgaccgaaatgaacaaaggcgtgttgaagaatttaggactgctgacgccggagctggagcaggcgaaaaacggcgacctgatgattgtcatcaatggtaaatcgggtgtggacaacgagcagttgctggcggagattgaagaactgttcaacaccaaagcgcaaagcggctcgcacgaggcgcgttacgccactattgccagcgccaaaaagcatatcccggaaagtaacctggcagtgatttcggtcaacggtctgtttgccgctcgcgaagcgcgtcaggcgctgcaaaatgacctcaacgtgatgctgttttccgataatgtctcagttgaagatgaactggcgctcaaacagttggcccatgaaaaagggctgctgatgatggggccagactgcggcacggcgattatcaacggcgcggcgctctgctttggtaacgccgtgcgtcgcggcaacatcggtattgttggcgcatctggcaccggcagccaggaattgagcgtccgtatccatgaatttggtggcggcgtttcacaactgatcggcaccggcgggcgcgacctgagcgagaaaatcggtggcctgatgatgctcgatgccatcgggatgctggaaaacgatccgcaaactgaaatcattgtgcttatctccaaaccgcctgcgcctgcggtggcccgcaaagtgctggaacgcgcacgcgcctgccgcaagccagtggtggcctgcttcctcggtcgtggcgaaacgccagtggatgagcaggggctacagtttgctcgcggcagcaaagaggcggcattgaaagcggtgatgctctccggcgtgaaacaagaacatctcgacctgcatacgcttaaccagccgttgattgcggatgtgcgtgcgcgtctgcaaccgcagcagaaatacattcgtggtctgttctgcggcggtacgctgtgtgacgaaaccctgttcgcggtgatggaaaaacatggcgatgtctacagcaatatccagcccgatcctgaattccgcctgcaagatatcaaccgcagcatcaaacacaccttcctcgactttggcgatgatgacttcaccaacggcaagccgcatccaatgattgacccgaccaaccgtatcagccgcgtgatcgaagaagcgcgcgatccagaagtggcggtgatcgtgatggattttgttctcggatttggatcgcatgaagatccggtcggttccaccatcgaggcgatcaaagaagcgaaagcgatcgccgctgccgaaggacgcgagttgatcattctcgcctatgtgctgggcaccgatctcgatacgccatcattagaacaacaaagccagatgctgcttgatgccggagtgattctggcgagcagcagcaccaataccggattgctggcgcgtgaatttatctgcaaaggggaggaagcctgatgagccagtcactgtttagccaaccgttgaacgttattaacgtcggtatcgccatgtttagcgatgatctgaaaaagcagcatgtagaagtgacccaactcgactggacgccgccggggcagggcaatatgcaggtggtgcaggcactggacaacattgccgattcgccactggcggacaaaatcgcctccgcgaatcagcaggcgctggagcgcattatccagtcgcatccggtgctgattggttttgatcaggcgattaacgtggtgccgggcatgacggcgaaaaccattcttcacgccgggccgccggtcacctgggaaaaaatgtgcggcgcgatgaaaggcgcggtcaccggagcgctggtgtttgaaggactggcgaaagatctcgacgaggcggctgagctggcggcttccggggagatcaccttctcgccgtgccacgaacacgactgtgtgggatcgatggcgggcgtcacctcggcctcgatgtttatgcacatcgtgaaaaacaaaacctatggcaacatcgcttataccaacatgagcgagcagatggcgaagattttgcgtatgggcgctaacgaccagagcgtgatcgaccgcctcaactggatgcgcgatgtgcagggacccatgctgcgcgacgcgatgaaaattatcggcgaaatcgatctgcgcttaatgctggcgcaggcgctgcatatgggcgatgaatgccataaccgcaataacgccgggacgacgttgctgattcaggcgctgacgccagggattattcaggcgggctattccgtcgaacaacagcgggaagtgtttgagtttgtcgccagctgcgactacttctccggcccgacgtggatggcgatgtgtaaagcggcgatggatgcggcgcacggcattgaatacagcactgtggtcaccaccatggcgcgtaacggcgtcgagttcggcctgcgggtcagcggattaccggggcaatggtttaccggtccggcgcagcaggtgatcgggccgatgtttgccggttataagccggaagattcggggctggatatcggcgacagcgccatcactgaaacctacggcattggcggatttgccatggcgaccgcgcctgcaatcgtcgcgctggtgggcggtacggtggaagaggctatcgatttctcccgccagatgcgtgaaatcactctcggtgaaaaccccaacgtcaccattccgctgctcggttttatgggcgtgccgtcggcaatcgacatcacccgcgtgggcagcagcggcattctgccggtgatcaacaccgccattgcccataaagatgcgggcatcggcatgattggcgcgggcattgtgcatccacccttcgcctgcttcgagaaagccatttttggctggtgcgaacgttacggcgtctgatctgtaaagtgcgcgttgtttctgccggatgcggcgtgaacgccttatccggcctacgagtggcgcaagaatctgtaggcctgataagcgtagcgcatcaggcagtctggcgttggtcataaccccatcaccctctgtcgcggacataacaacatgaaagaacttgtggtcgttgccattggtggcaacagcattatcaaagataacgccagccagtcgattgagcatcaggcggaggcggtgaaagccgtggccgatacggtgctggaaatgctggcttccgattacgacattgtgctgacccatggcaacgggccgcaggtcgggctggatttacgccgcgcggagattgcccacgagcgcgaagggctgcccttaacgccgctggcgaactgtgtggcggatacgcaaggtggcattggctatctgatccagcaggcgctgaacaaccgactggcgcgtcacggcgagaaaaaagccgtcaccgtggtgactcaggtagaagtggataaaaacgatccggggtttgcccatcccatcaaacccattggcgcattctttagtgaaagccagcgtgacgaactacaaaaggcaaaccctgactggcgttttgttgaagatgccggacggggctatcgccgcgtggtcgcctcgccggaaccgaaacgtattgtcgaagcacctgccattaaggcgctgatccaacaaggctttgtggtgattggcgcgggcggcggcggaattccggtagtgcgtactgacgcgggggattaccaaagcgtggacgcggttatcgacaaagatctctctaccgcgctactggctcgcgaaattcacgccgacattctggtgatcaccactggcgtcgaaaaagtgtgtattcactttggcaaaccgcagcagcaggcgctggatcgcgtagatattgccaccatgacccgctatatgcaggaagggcatttcccacctggcagcatgttgccaaaaatcatcgccagcctgacgttcctggaacaaggcggcaaagaagtgattatcaccacgccggaatgcctgcctgcggcgctacgcggcgaaacgggcacccatattattaaaacctaaggacgtaagatgaaagaaaacaatagccgccgtgaatttctgagccagagcggtaagatggtcaccgccgccgcgctgtttggtccctcagtgccgctcgcccatgcgggggtagctggcaccctaaactgcgaagcgaacaacaccatgaaaatcactgacccgtattactatctcgataacgtgctgctggaaaccggttttgactacgaaaatggcgtggcggtgcagacccgcacggcgcgccagactgtggaaattcagaacggtaaaattgttgccctgcgcgagaacaagcagcatccggacgccacgctgccgcactatgacgctggcggtaagcttatgttgcccactactcgcgacatgcatattcatctcgacaaaaccttttacggcggaccgtggcgctcactcaatcgccctgcaggcaccaccatccaggacatgattaagctcgagcaaaaaatgctgccggaactgcaaccctacactcaggagcgggcagaaaaactgatcgatttattgcagtcgaaaggcaccaccattgcccgcagccactgcaatatcgaaccggtttccggcctgaaaaatctgcaaaatttgcaggcggtgctggcgcgacgtcaggcgggcttcgagtgtgaaatcgtcgccttcccgcagcacggtttgctgctgtcgaaatcggaacccttaatgcgcgaagcgatgcaggcgggggcgcattacgtcggcgggctggacccgaccagtgttgatggcgcgatggaaaaatccctcgacaccatgttccagattgcactggactacgacaaaggcgtcgatattcacctgcacgaaaccactccggcaggcgtagcggccatcaattatatggttgaaacagtggagaaaacgccgcaactgaagggcaagctgaccatcagccacgcctttgcgctggcaacgctcaatgagcaacaggtagatgaactggcgcaccggatggcggcgcagcaaatttctatcgcctcgacggtgccgattggcacgttgcatatgccgctcaaacaactgcacgacaaaggcgtaaaagtgatgaccggcaccgacagcgttatcgaccactggtcgccttacggcctgggcgacatgctggaaaaagccaatctctacgcgcagctctatattcgtcctaacgaacagaatttgtcccgttcgctgtttttagccactggcgatgtattgccgctcaacgaaaaaggcgagcgtgtgtggcctaaagcgcaggatgacgccagctttgtgctggtggacgcctcctgttccgccgaggcggtggcgcgtatctcgccgagaacggcgacgttccataaagggcaactggtgtgggggagtgtggcaggttgatacgaacttgatatgtctgcaacggtgaacagtaagagatttaagccccagggagtggggcatcaatggtttgctaatgaatgatcctgaactttataatctccgggcataatttccaggggattatttgagagaaatacacaaaagtgagttttaacaaaggtatttatcaagccataaatgtgacctgcttcggataaaaagattaaacatagaaaaaccaatgatcctcttgctgatggttatcaacagtaattaagatgtgatttgtttttccgtaatcgcgaaaatattctcatgaccataaaagaaaaaatctcacaaaaatatccccatgcttccttttgtacttttggcgattcagcagcgttggccgatcacctcgcaacgttgattgcgactggtgttaaaacagcttcctgtggttcgctggcgggatgtattgaagacaacgcatttccgatgattggggagtataagattgtagaaaatagccgtggtgagcctgtctgtgttatcagagtaattggcctgcatttactgcgcttttctgatgtcaccgcggagcttgcccgtaaggaaggtgaaggtgacctcagtcttgaatattggcgtaatgaacaccgtcgttttttccaggcagaaggatgctattcacccgaaatggacgttatctttgaagaatatgcccttattgacgttgtgtagataactatttttctacgcgaaataagctcacaaacataaagtatcgctaattttgtttattttgctattttttacgtgatgattgtcacacttattgttactgcccgttttgtccatatttataaccaaatttttaatagctgcctgaaatagggctgtttattctgcataaaaatattcgaaaattcttattctctccagcgcgctaatttgggcgaacacttcctgactaccctgcaatgaggctgaaatgatgaataaacgttttgttatcaatatggtgtcttcgctgttattaggcgctgcgctaatttctgcgccgctccaggccgcggaaaaagtcgtggtgaatatctctaaagtcgatggtatgccgtggtttaatcgcatgggcgaaggtgtggttgaggcgggtaaagcctttggtgttaatgcgtcacaggtggggccttcaagtactgatgctccacaacaagttaaaattattgaggatttaatcgcccgtaaggttaatgcaattacaattgtgccaaacgatgccaacgtgctggaaccggtattcaaaaaagcgcgagatgccggaattgtggttctgaccaacgaatcccccggtcagccaagtgctaactgggatatcgaaatcattgataacgaaaaatttgccgctgaatatgttgagcatatggcgaaacgcatgggtggcaagggcggctatgtgatttacgtgggtagtttgaccgtgccgcagcataacttatgggctgacttgctggtgaaataccagaaagagcattacccggatatgcatgaagttacccgccgcatgccggttgccgagagtgtggatgactcacgtcgtactacactggacctgatgaaaacctatcctgacttgaaagcggttgtctcctttggttcaaacggtccgattggcgcgggacgtgcagtgaaagagaaacgggcgaaaaataaagtcgcagtctatggcatgatgatcccttcacaggcggcatcactgattaaaagtggtgatatcaccgaagggattacttacgatccggcctctgcaggttacgcactcgcggccgtcgccagcacgttgctgaagggtgaagagatcaaacctggattagaaatgcagaatctgggtaaggccgacgtagatatggataagcgaattatccgtttccataaggtattactggtcaacaaagacaatatcgactcactttattaatccatttcttcggggcgaaagccccgattcttattgccaggggatgttatggaaaccttcctttcccttcgtcatatcaacaaaacgtttcatgccacgcgagcgctgcgcgatgtttctctcgactttatgtcgggtgaagtgcactgtcttgccgggcaaaacggctgtggtaaatcgacgttgattaaaattatgtccggtgtttatcgcccggatgagggagcggaaattacgcttggtgggaaaaactggtcaaagctgacacccgccgcttcggtggcgcaggggattcaggtgatttatcaggacctctctttatttcctaacctgagtgtctgggagaatatcgccgtgaatcactatcaccacggtctgtttgttaaccgacgtcgtctgcgtgaggtggcgcaggcggcaatgaccagtattaacgtcacattgccactggatacgctcgtttctgagctttcaattgcccgctgtcagctggtggcaatttgccgtgcactggcgcaggacgcacggttgatcgtgatggatgaaccaaccgcttcgctgacccatcaggaagtgcaagggttattacaggtggtgcatcaattgcgggaacgcgggatctgcgtggtcttcgtcagtcatcgtctggaagaagtgatggaagtttccgaccgtatttcagtgctgaaagatggtgagctggtcgggacctttccggccgcagagatgaccacaaaacaactcggttttctgatgaccggccaggagtttgaatatcaggtgcgagagttgtggcagggaaaatccagcaccccggtgctggaggtgcgtaatttaagtcgtcatggggaatatctaaatattaacttgcgggtggaagcgggcgaagtggtatcgattgttggcctgcttggtgcggggcgcacggaattatgtctgagtctgtttggtatgacccgaccggatgctggcgagatcctcatcaacggccagctggttacactgcatagtaaccaggacgccatccgccacggtattggttatgtttcggaagatcgcatgtcgcgcggtttggtgatggcgcaatctattgaagacaacatcattagcactgtttttcacaaggtaaaagatcgcttcggctttctgagtgaagctaaagtgtgtgacctggtggacaggctaatcaaggcattgaccatcaaagtctctgatcctcatctcccggtgaatacgctttctggtggtaacgcgcagcgagtatcgatcgccaaatggctggcgattgggccacgactgttgattctcgatagcccgacagtcggtgttgatatcgccaacaaagcaggaatatacggcattatcagcgatctggcggctcatggcattgcggtattgatgatctgcgatgaaattgaagaagcgtggtatcaaagccaccggattttggtaatgcaaaaaggtcagatcacccatagcttcctgcctgacagcagttctcaggccaggattgcggaggtggtaaatggctgaactgaaaaaacgccatgaattctggctggcattactgattgtggtgctgtttgttggccttgcctggcgcagcgacgagtttctgacattcggtaatttgtacgatctcgccaataactatgccatgttgactattctcgcctgtggtttgtttgtggtgttaatttccggtgggattgatatttcgtttccggcaatgaccatcattgcgcaatacggcatggtgctgctgctgcaaaaaattggtggcaactttgctgtcgcgtttgccctggcgggcggcatcggcattttacttggcttaattaacgccttactggttaatcgcctacgggtgccttctatcatcatcactatctcgacgctgaatattttttatggcctgctgttatggttgagtaaaggtgtgtggctgtacgactttccgccgtggtttgagcagggggtaatgttgttcaagtacaccgatgctgatggctatgactatggccttggtctgccgctgatcgccatgattacggtggtgctgctgacagcgtttatcatgaatttcaccagtgtagggcgcaaaatttatgcccttggcgggaaccgcgaatcagccagtcgcatcggctttagtgtgctgaaactgcaacttttcgtctatggctatatgggattgatgtctggtgctgcgggtgtagtgcagtcgtggacggtgatgactgtcgcccccgattctcttctgggttatgagctgacagtactggctgcggtggtgcttggcggcactagtttgctcggcgggcgcggcacgttaaccggtactttgctcggcgtggtgttgttggcagtgatgcaaaacgggctaaatttattgggagtctcgtcttactggcaaacattgatcaccggcatcatcatcgttgccagcattagcgccacggcgtggagtcagcatcagaaccggagtctgctatgaaaaaatcgtggcgtaataacgttgagttttacttgatcggcctgctggtgctaactgttgccgccttcagcattactatgccggagattttctggtcgataagtaatttccagtccgtcgcttcgcaaatgcccgtgctgggcattctggcgttggctatggcggtgaccatgctttgcggtggcattaacttgtcaattatagccactgctaacgcctgttcactggtgatggcgtgggtggcgactcagtatccaccaggtattgctacggttgtcgctacgctgctggcgggcgctggcgcggcggtgataatcggtttatgtaacggcgtattgattgctggtattcgagtgtcgccaattcttgcaacacttgggatgatgacgttgctcaaaggggttaatattctggtgacaggcggtagcgccattgccaattatccctcatgggtgctgtggttgaatcatgcacagtggttcggtattccgctaccgatgtggttgtttaccgcagtggcgctggggctgtggatattgctggagaaaacgccgctcggtaaatccatttatctgattggttctaacgaacgagcaacactttactccggtattaacactcgtcgggtgctgatatgggtgtatgtcatttccgccttgctttgtgcggtagcggcatttttgatgatgtcgaaactcaactcggctaaggcctcttatggcgaatcttacttgctggtgtcaatcctcgcggcagtactcggcggggttaatccggacggcggcagcgggcggataattggtatggtgctggcgctgtttcttctgcaaattattgaaagcggcttcaatattctcggtataagcccctacctgacgatggccttatggggaacgttgctgctctgtttcattcaggctcgcggcatgttagggctggatcgggtggtttaaatattggctatattcaatggacgcgttttgccgcgatgacatatcaggcatcgccaaatacacatagctaatcaggagtaaacacaatgaagatcaaagctgttggtgcatattccgctaaacaaccgcttgaaccgatggatatcacccggcgtgaaccgggaccgcatgatgtcaaaattgaaatcgcttactgtggcgtctgccattccgatatccaccaggtccgttccgagtgggcggggacggtttatccctgcgtgccgggccatgaaattgtagggcgcgtggtagccgttggtgatcaggtagaaaaatatgcgccgggcgatctggttggtgtcggctgcattgtcgacagttgtaaacattgcgaagagtgtgaagatgggctggaaaactactgtgatcacatgaccggaacctataactcgccgacaccggatgaaccgggccatactctgggcggctactcacaacagatcgtcgttcatgagcgatatgttctgcgtattcgtcacccgcaagagcagctggcggcggtggctcctttattgtgtgcaggaatcaccacgtactcgccgctacgccactggctggccgggccgggtaaaaaagtgggcgtggtcggcatcggcggtctgggacatatggggattaaactggcccacgcgatgggggcgcatgtggtggcatttaccacttctgagtcaaaacgcgaagcggcaaaagccctgggggccgatgaagttgttaactcacgcaatgccgatgagatggtggctcatgtgaagagtttcgatttcattttgaatacagtagctgcgccacataatctcgacgattttaccaccttgctgaagcgcgatggcaccataacgctggttggtgcgcctgcgacaccgcataaatcgccggaagttttcaacctgatcatgaaacgccgcgcgatagctggttctatgattggcggcattccagaaactcaggagatgctcgatttttgcgccgaacatggcatcgtggctgatatagagatgattcgggccgatcaaattaatgaagcctatgagcgaatgctgcgtggtgatgtgaaatatcgttttgttatcgataatcgcacactaacagactgaaaaaattaataaacatcctgtggtttaacatattaacttcgctccacttaactttttagttaaggagagcgaaataatatcaaagtagtggtaaacctatagcgtaaattcagattgttaaattaactccactactttacacgttagttatgagcgatttctgatagtgtctggtttaatcagagctttattatctgcgacgtttatttttatttaagagagccacctgcaagttgttattccaccagagagtgaatcgcaaagcaggtcatcatttcatctgtatatctgtatgccaaatggcattccccctcctttttcgccgatattttgttgtgaacggcggagtttcgcttaaaaaagcaccagtagtggtttcgcagctatatggtgtataaaaaatgttctcatacagatgttttgtgaatgtgtgggttgacattcatatgaaaaaaatcataattccatcatgtttgtgtggggtcttttctgtatcttacgcatcgcactcaagcctgacagaaaatatgctgtaaggctcatatcaaaaaccgccattagctcatcaggaagagcagacgacaaccaggattgttgtatggtacggggttcgaggcctcgatggcggtccaacttttcaaaactcttctgaatcagatccccttattttcatccctgcaaagtggaacattgccattgtttggctattcaggacgggtcagagcaatgaaaaaagcccacacaggggagagtgggctgaaatgggaagctaaagactcaagtaaacttatcggaaataaggaccacgcattacgggggctatcatcgccgatggtcgggattcggcaaatcaggttgattacgtagagagtaaattatctgctcaccgctgcgtcaccccttcgtaaatcaggcgtagcgcgaatacaccaataattgcaccaataacccgactggcaacgcgttgcatacgcccataagcacgacgcactgcgggcaaagaaaacgcctgactaagaaagactcgccagataattgatgcgagcacaatccccgcccaggccattaaacgtgcccatgttggtgtttcggcatttaatgttactgagaaaatactgataaaaaataaaacggtttgcgggttagagagatcggtaattaatccacggcggaaaaagacataccagggggcactaatcggttgttgtagtgtgctcatctgcggtgttgactggcggcgcatgctacaccacgcaaaccataagagataagcgccgccgacgattctgataagcgaaaaaatctcctcacactgcgtaattagcgttgcaagaccaaacaaacccaacccggaataaaacgcatcgcccagcgccacgcccagtccggtcagcacccctgcgcgtcgaccggaagccaggctggtttgtactaccacaaagagattggctcccggattaaaaaaagtaatcacgaacagtcctacggtcagataaacggcgtgcaaaggatccatagtgatttcatccataaataagtgaagtaacttcatcatatttctaccaaaaataatcgggtgcgagagagatcacaaagtgtcttatttccggttactggcgtttatgccctgactgaactaattattaatcaacccaataatgtgggtgggtgatagtgtgataacaactctggagccgtaatatgaaaataatctctaaaatgttagtcggtgcgttagcgtttgccgttaccaatgtctatgccgcagaattaatgaccaaagcggaatttgaaaaggttgaatcgcaatatgaaaaaataggtgatatttcaaccagcaatgaaatgtcgaccgcagatgcgaaagaagatttgatcaaaaaagcggatgaaaaaggggctgatgtgttggtgctgacctctggtcaaactgacaataagattcacggcacggcaaatatttataagaagaagtaattctgaaacctatgtaaacatccccgatgcgtaagtttatcggtgatcatcatctattgaaatttatgccggataaagcgttcgcgctgcattcggcagttcagtttttcagccgccgccagaaggtcgtccggcttatgcctaaataattcgccgctgctgttttatcgcctttaaatttctccagtgcctgttgtggtgtcagcaagcgtggagcgggagttttcgctgactcgcgcgccagctccggcagtagcagctgcaaaaattgcggcgttaaatccggcgtcggttccacacttaaaaacagcgccagtcgctccatcatattgcgcagttcacgaatattgcccggccagtcgtagtgcaccagcacggtttcgcttgcctgtaatccctggcgtaatgcggcagaaaacggggcggagagcgctgccagagacactttcaaaaagctttccgccagcggcagaatatccgtcacccgctcgcgcagtggtggcaattgcagacgcaaaatactcagccgataaaacagatcacggcgaaactgcccttgccgcatatcttcttccagattgcagtgagtggcgctaatgactcgcacatccaccggaacaggctgatgcccgccgacgcgggtgacctctttttcttccagcacccgcagcagccgagtctgcaacggcagcggcatttcgcctatctcgtcaagaaacagcgtgccaccgtgggcgatttcgaacagcccggcgcgacctccgcgtcgcgagccggtgaacgccccttcctcatagccaaacagctctgcttccagcaacgattcggcaatcgccccgcagttgacggcaacaaacggatgcgactttttgccctgtcgcgcatcgtggcgggcaaaatattcccgatgaatcgcctgggccgccagctctttgcccgtccccgtttccccctcaatcaacaccgctgcactggagcgggcatacagcaaaatagtctgccgcacctgttccatctgtggtgattgaccgagcatatcgcccagcacgtaacgagtacgcagggcgttacgggtggcatcgtgagtgttatggcgtaacgacatgcgcgtcatatccagcgcatcgctgaatgcctggcgcacggtggcggcggaatagataaaaattccggtcattccggcttcttctgccagatcggtaatcagccccgcaccgaccaccgcttcggtgccgttagcttttagctcgttaatctgcccgcgtgcgtcttcctcggtaatgtagctacgttgatcgaggcgcaaattaaaggttttttgaaacgccaccagtgccggaatagtttcctaataagtgacaacgccgatagaagaggtgagttttccggcttttgccagtgcctgtaacacatcgtagccgctcggtttaatcaaaataactggcactgacaggcggcttttcagatacgcgccgttagagccagcggcaatgatggcgtcacagcgttcgcttgccagtttcttgcggatgtaggtcaccgctttttcaaagccaagctgaataggggtgatattcgccaggtgatcaaactcgagactgatatcgcgaaacagctcgaacaggcgcgttaccgataccgtccagataaccggtttgtcgtcattaagccgtggtggatgtgccatagcgcaccgcaaagttaagaaaccgaatattgggtttagccttgtttcataattgttgcaatgaaacgcggtgaaacattgcctgaaacgttaactgaaacgcatttttgcggattacttcatgactttatctctaacaaattgaaattaaacatttaattttattcagtcaattgtggcacaccccttgctttgtctttatcaacgcaaataacaagttgataacaaaggatgggctatgtctctacactctccaggtaaagcgtttcgcgctgcactgtctaaagaaaatccattgcagattgttggcaccattaacgccaaccatgcgctgttggcgcagcgtgccggatatcaggcaatttatctctccggcggtggcgtggcggcagggtcgctggggctgcccgatctcggtatttctactcttgatgacgtgctgacagatattcgccgtatcaccgacgtttgttcgctgccgctgctggtggatgcggatatcggttttggttcttctgcttttaacgtggcgcgcaccgtgaaatcgatgattaaagccggtgcggcaggattgcatattgaagatcaggttggtgcgaaacgctgcggtcatcgcccgaacaaagcgatcgtctcgaaagaggagatggtggatcggatccgcgcggcggtggatgcgaaaaccgatcctgattttgtgatcatggcgcgcaccgatgcgctggcggtagaggggctggacgccgcgatcgagcgtgcgcaggcctatgttgaagcgggtgccgagatgttgttcccggaggcgattaccgaactcgccatgtaccgccagtttgccgatgcggtgcaggtgccgatcctcgctaacattaccgaatttggtgccacgccgctgtttactaccgatgaattacgcagtgcccatgttgcaatggcgctgtacccgctttcagcgttccgtgccatgaaccgcgccgctgaacatgtctacaacgtcctgcgtcaggaaggcacgcagaaaagcgtcatcgacaccatgcagacccgcaacgagctgtacgaaagcatcaactactaccagtacgaagagaagctcgacgacctgtttgcccgtaaccaggcgaaataaaacacaacgaaaaatatctcgaccctacaaatgacgaggacaacatgagcgacacaacgatcctgcaaaacagtacccatgtcattaaaccgaaaaaatcggtggcgctttctggcgttccggcgggcaatacggcgctctgcaccgtgggtaaaagtggcaatgacttgcattaccgtggctacgatattcttgatctggcggcacattgcgaatttgaagaagtggcgcatctgctgatccacggcaaactgccgacccgtgacgaacttgccgcctacaaaacgaaactgaaagccctgcgcggtttaccggctaacgtgcgtactgtgctggaagccttaccagcggcgtcgcacccgatggatgttatgcgcaccggcgtttccgcgctcggctgcacactgccggaaaaagaggggcacactgtatctggtgcgcgggatattgccgacaaactgctggcgtcacttagctcgattcttctctactggtatcactacagccataacggcgaacgcatccagccggaaactgatgacgactctatcggcggtcacttcctgcatctgctgcacggcgaaaagccgtcgccaagctgggaaaaggcgatgcatatctcgctggtgctgtacgccgaacacgagtttaacgcttccacctttaccagccgggtgattgcgggcactggctctgatatgtattccgcgattattggcgcgattggcgcactgcgcggaccgaaacacggcggggcgaatgaagtgtcgctggagatccagcaacgctacgaaacgccggacgaagccgaagcagatatccgcaagcgggtggaaaacaaagaagtggtcattggttttgggcatccggtttataccatcgccgacccgcgccaccaggtgatcaaacgcgtggcaaagcagctctcgcaggaaggcggctcgctgaagatgtacaacatcgccgatcgcctggaaacagtgatgtgggagagcaaaaagatgttccccaatctcgactggttctccgctgtttcctacaacatgatgggtgttcccaccgagatgttcacaccactgtttgttatcgcccgcgtcaccggctgggcggcgcacattatcgaacaacgtcaggacaacaaaattatccgtccttccgccaattatgttggaccggaagaccgccagtttgtcgcgctggataagcgccagtaaacctctacgaataacaataaggaaacgtacccaatgtcagctcaaatcaacaacattcgcccggaatttgatcgtgaaatcgttgatatcgtcgattacgtgatgaactacgaaatcagctccagagtagcctacgacaccgcacattactgcctgctcgacacgctcggctgcggtcttgaagctctcgaatacccagcctgtaaaaaactgctggggccaattgtccccggcaccgtcgtccccaacggcgtgcgcgtccccggaactcagttccagctcgaccccgtccaggcggcatttaacatcggcgcgatgatccgctggctcgatttcaacgatacctggctggcggcggagtgggggcatccttccgacaacctcggcggcattctggcaacggcggactggctttcgcgcaacgcgatcgccagcggcaaagcgccgttgaccatgaaacaggtgctgaccggaatgatcaaagcccatgaaattcagggctgcatcgcgctggaaaactcctttaaccgcgttggtctcgaccacgttctgttagtgaaagtggcttccaccgccgtggtcgccgaaatgctcggcctgacccgcgaggaaattctcaacgccgtttcgctggcatgggtagacggacagtcgctgcgcacttatcgtcatgcaccgaacaccggtacgcgtaaatcctgggcggcgggcgatgccacgtcccgcgcggtacgtctggcgctgatggcgaaaacgggcgaaatgggttacccgtcagctctgaccgcgccggtgtggggtttctacgacgtctcctttaaaggtgagtcgttccgcttccagcgcccgtacggttcttacgtcatggaaaatgtgctgttcaaaatctcctttccggcggagttccactcccagacggcagttgaagcagcgatgacgctctatgaacagatgcaggcagcaggcaaaacggcggcggatatcgaaaaagtgaccattcgcacccacgaagcctgtattcgcatcatcgacaaaaaagggccgctcaataacccggctgaccgcgaccactgcattcagtacatggtggcgatcccgctgctgttcgggcgcttaacggcggcagattacgaggacaacgttgcgcaagataaacgcattgacgccctgcgcgagaagatcaattgctttgaagatccggcatttactgctgactaccacgacccggaaaaacgcgccatcgccaatgccattacccttgagttcaccgacggcacgcgctttgaagaagtggtggtggagtaccccattggtcatgctcgccgccgtcaggatggcattccgaaactggtcgataaattcaaaatcaatctcgcgcgccagttcccgactcgccagcagcagcgcattctggaggtttctctcgacagaactcgcctggaacagatgccggtcaatgagtatctcgacctgtacgtcatttaagtaaacggcggtaaggcgtaagttcaacaggagagcattatgtcttttagcgaattttatcagcgttcgattaacgaaccggagcagttctgggccgagcaggcccggcgtattgactggcagacgccctttacgcaaacgctcgaccacagcaacccgccgtttgcccgttggttttgtgaaggccgaaccaacttgtgtcacaacgctatcgatcgctggctggagaaacagccagaggcgctggcattgattgccgtctcttcggaaacagaggaagagcgtacctttacctttcgtcagctgcatgacgaagtgaacgcggtggcctcaatgttgcgttcattgggggtgcagcgtggcgatcgggtgctggtgtatatgccgatgattgccgaagcgcatattactctgctggcctgcgcgcgtattggcgctattcactcggtggtgtttggtggatttgcctcgcacagcgtggcggcgcgaattgatgatgctaaaccggtgctgattgtctcggctgatgccggagcgcgcggtggcaaaatcattccctataaaaaattactcgacgatgcgataagtcaggcgcagcatcagccgcgccacgttttactggtggatcgcggactggcgaaaatggcgcgcgtcagcgggcgggatgtcgatttcgcgtcgttgcgccatcaacacatcggtgcgcgggtgccggtggcgtggctggaatccaacgaaacctcctgcattctctacacctccggcacgaccggcaaacctaaaggtgtgcagcgtgatgtcggcggatatgcggtggcgctggcgacctcgatggacaccatttttggcggcaaagcgggcggcgtgttcttttgtgcttcggatatcggctgggtggtagggcattcgtatatcgtttacgcgccgctgctggcggggatggcgactatcgtttacgaaggattgccgacctggccggactgcggcgtgtggtggaaaattgtcgagaaatatcaggttagccgcatgttctcagcgccgaccgccattcgcgtgctgaaaaaattccctaccgctgaaattcgcaaacacgatctttcgtcgctggaagtgctctatctggctggagaaccgctggatgagccgaccgccagttgggtgagcaatacgctggatgtgccggtcatcgacaactactggcagaccgaatccggctggccgattatggcgattgctcgcggtctggatgacaggccgacgcgtctgggaagccccggcgtgccgatgtatggctataacgtgcagttgctcaatgaagtcaccggcgaaccgtgtggcgtcaatgagaaagggatgctggtagtggaggggccattgccgccaggctgtattcagaccatctggggcgacgacgaccgctttgtgaagacgtactggtcgctgttttcccgtccggtgtacgccacttttgactggggcatccgcgatgctgacggttatcactttattctcgggcgcactgacgatgtgattaacgttgccggacatcggctgggtacgcgtgagattgaagagagtatctccagtcatccgggcgttgccgaagtggcggtggttggggtgaaagatgcgctgaaagggcaggtggcggtggcgtttgtcattccgaaagagagcgacagtctggaagaccgtgaggtggcgcacttgcaagagaaggcaattatggcgctggtagacagccagattggcaactttggccgcccggcgcacgtctggtttgtctcgcaattgccaaaaacgcgatccggaaaaatgctgcgccgcacgatccaggcgatttgcgaaggacgcgatcctggggatctgacgaccattgatgatccggcgtcgttggatcagatccgccaggcgatggaagagtaggtcggataaggcgctcgcgccgcatccgacaccgtgcgcagatgcctgatgcgacgctgacgcgtcttatcatgcctacaggcctgaaccgtaggtcggataaggcgctcgcgccgcatccgacaccatgcgcagatgcctgatgcgacgctgacgcgtcttatcatgcctacccactgtttttacacagataagtttcccccgcctttttgcactcattcatataaaaaatatatccccctacgaaaacgattgctttttatcttcagatgaatagaatgcggcggattttttgggtttcaaacagcaaaaagggggaatttcgtgtcgcaagataacaactttagccaggggccagtcccgcagtcggcgcggaaaggggtattggcattgacgttcgtcatgctgggattaaccttcttttccgccagtatgtggaccggcggcactctcggaaccggtcttagctatcatgatttcttcctcgcagttctcatcggtaatcttctcctcggtatttacacttcatttcttggttacattggcgcaaaaaccggcctgaccacccatcttcttgctcgcttctcgtttggtgttaaaggctcatggttgccttcactgctgctgggcggcacccaggttggctggtttggcgttggcgtggcgatgttttctattccggtgggcaaggcaaccgggctggatattaatttgctgattgccgtctccggtttactgatgaccgtcaccgtcttctttggcatttcggcgctgacggttctttcggtgattgcggttccggctatcgcctgccttggcggttattccgtgtggctggccgttaacggcatgggcggcctggacgtattaaaagcggtcgttcccgcacaaccgttagatttcaatgtcgcgctggcgctggttgtggggtcattcatcagtgcgggtacgctcaccgctgactttgtccggtttggtcgcaatgccaaactggcggtgctggtggcgatggtggcctttttcctcggcaactcgttgatgtttattttcggtgcagcgggcgctgcggcactggggatggcggatatctctgatgtgatgattgctcagggcctgctgctgcctgcgattgtggtgctggggctgaatatctggaccaccaacgataacgcgctctatgcgtcgggtttaggtttcgccaacattaccggtatgtcgagcaaaaccctttcggtgattaacggtattatcggtacggtctgcgcattatggctgtataacaattttgtcggctggttgaccttcctttcggcagctattcctccagtgggcggcgtgatcatcgctgattatctgatgaaccgtcgccgctatgagcactttgcgaccacgcgtatgatgagtgtcaattgggtggcgattctggcggtcgcgctggggattgccgcaggccactggttaccgggaattgttccggtcaacgcggtattaggtggcgcgctgagctatctgatccttaacccgattttgaatcgtaaaacgacagcagcaatgacgcatgtggaggctaacagtgtcgaataatgctttacaaacaattattaacgcccagttacccggcaaagaggggctgtggcagattcatcttcacgacggaaaaatcagcgccattgatgcgcaatccggggtgatgcccgtaactgaaaacagcctggatgccgaacaaggtttagttttaccgccgtttgtggagccgcatattcacctggacaccacgcaaaccgccggacaaccgaactggaatcagtccggcacgctgtttgaaggcattgaacgctgggccgagcgcaaagcgttattaactcatgacgatgtgaaacaacgcgcatggcaaacgctgaaatggcagattgccaacggcattcagcatgtgcgtacccatgtcgatgtctccgacgcaacgctgactgcgttgaaagcgatgctggaagtgaaacaggaagttgcgccgtggattgatctgcaaatcgtcgccttcccgcaggaagggattttgtcgtatcccaacggtgaagcgctgctggaagaggcgctacgcttaggggcagatgttgttggggcgattccgcattttgaatttacccgtgaatacggcgtggagtcgctgcataaaaccttcgccctggcgcaaaaatacgaccgtctcatcgacgttcactgtgatgagatcgatgacgagcagtcgcgctttgtcgaaaccgttgctgccctggcgcaccgtgaaggcatgggcgcgcgagtcaccgccagccatactacggcaatgcactcctataacggggcgtatacttcgcgcctgttccgtttgctgaaaatgtccggtattaactttgtcgccaacccgttggtcaatattcatctgcaaggacgtttcgatacgtatccaaaacgtcgcggcatcacgcgcgttaaagagatgctggagtccggcattaacgtctgctttggtcacgatgatgtcttcgatccgtggtatccgctgggaacggcgaatatgctgcaagtgctgcatatggggctgcatgtttgccagctgatgggctacgggcagattaacgacggcctgaatttaatcacccaccacagcgccaggacgttgaatttgcaggattacggcattgccgccggaaacagcgccaacctgattatcctgccggctgaaaatgggtttgatgcgctgcgccgtcaggttccggtacgttattcggtacgtggcggcaaggtgattgccagcacacaaccggcacaaaccaccgtatatctggagcagccagaagccatcgattacaaacggtaatcggctgggttaccgcgagcgtagtttatgccggatgcggcgtgaacaccttatccggcctacgtagatctctgaaattgtaggcctgataagcggagcgcatcaggcaattttgcttatttaaactgaagactcaactttaaaatctttgaaataatattgcttatcccggtcgtttatttcgcgaataacccgacaaggaacgccagcagccacgacgtttggtggaatgtcttttgtgacgacactacccgcgccaataacagaattatccccgatggtgacgcctggattaataaccacatgacttccgatccagacgttattgccaatcgttatcggaaaagagtacatctctccgttttttctcaattcatggtgtaccgggtgtcccgtaacggaaagagtaacgttgggtgcaatcagtacgttatcaccgatcgttaccgtgtagtcgtcgacaatggttaaattgaaatttgcataaaaattgcggcctatatagatgttggaaccgtaagagaaatagacggggggttctacccaggcgttttcccctaccgtggcaaacatttctttaatcagactttctcttttatcaacttctgatggatgcgagtgattaaactcatacattaacgtttttccacgaagtcttttttcaggtaagccttcgcacatatcggtaaatagcttgcctgcttttattctttctgtcatcgacatgttcattgcgatcattccgccctgatatgttggtcggataaggcgctcgcgccgcatccgacattgattgcttaagcgacttcattcacctgacgacgcagcaaggaaagcgggccggggccgctaagcgtgaacacggaaattaaggtgaagcccagcgccaccagacccagtaccagataagcgccctggaaaccgatgctttcatacatattgcccgccagtacagacataaaaatcatcgccagttgcttaaagaagcagaaacagaccagataaatcgtcgctgaaaaacgcacttcaaactggctggtaatatatttaaagcagcccaccagcaggaacggtacttcaaacatatgcagcgttttcagaataaccacttccagcgctgaggtggcgaacgatgagccaataatacgtacagacataatagtgccagccagcagcagggcatttttcccaccgatgcgattaatgatcagtggcgcaaagaacataatcgaggcattaagtaattcgcccattgtcgttacgtagccaaatacccgcgtaccctgttcaccggtagcaaaaaacgaagtaaagaaattagcaaactgttggtcaaaaacatcgtaggtgcaggaaacgccaataacatacagtgacaaaaaccacagttttggctgtctgaacagttccagcgccagcttaaggctaaatgccgaatggttggcacctaccgcattggcaaccgtggctgaagagggcgcatccgttttggcgaaaaagagtaaaacggcgaggatgagtgcacagccagaacccagccagaaaacaaactgattattgatggtgaacatgatgccgacaatcgaggcacacagcgcccagccaacacagccaaacatccgcgcgcgaccaaattcgaaattactgcgacggctgactttctcgataaatgcctctactgctggcgcaccggcgttaaaacaaaagccaagataaataccaccaacaatcgatcctactaaaatgttgtattgtaacagtggtccgaagataaaaataaagaacggcgcaaacatcactaacatgccggtaataatccacagcaggtatttgcgcagcccgagtttgtcagaaagcagaccaaacagcggttggaataatagcgagaacagagaaatagcggcaaaaataatacccgtatcacttttgctgatatggttgatgtcatgtagccaaatcgggaaaaacgggaagtaggcccccatgataaaaaagtaaaagaaaaagaataaaccgaacatccaaaagtttgtgttttttaaatagtacataatggatttccttacgcgaaatacgggcagacatggcctgcccggttattattatttttgacaccagaccaactggtaatggtagcgaccggcgctcagctggaattccgccgatactgacgggctccaggagtcgtcgccaccaatccccatatggaaaccgtcgatattcagccatgtgccttcttccgcgtgcagcagatggcgatggctggtttccatcagttgttgttggctgtagcggctgatgttgaactggaagtcgccgcgccactggtgtgggccataattcaattcgcgcgtcccgcagcgcagaccgttttcgctcgggaagacgtacggggtatacatgtctgacaatggcagatcccagcggtcaaaacaggctgcagtaaggcggtcgggatagttttcttgcggccccaggccgagccagtttacccgctctgagacctgcgccagctggcaggtcaggccaatccgcgccggatgcggtgtatcgcttgccaccgcaacatccacattgatgaccatctcaccgtgcccatcaatccggtaggttttccggctgataaataaggttttcccctgatgctgccacgcgtgggcggtcgtaatcagcaccgcgtcggcaagtgtatctgccgtgcactgcaacaacgccgcttcggcctggtaatggcccgccgccttccagcgttcgacccaggcgttagggtcaatgcgggtcgcttcacttacgccaatgtcgttatccagcggcgcacgggtgaactgatcgcgcagcggggtcagcagttgtttttcatcgccaatccacatctgtgaaagaaagcctgactggcggttaaattgccaacgcttattacccagctcgatgcaaaaatccgttccgctggtggtcagttgagggatggcgtgggacgcggaggggagtgtcacgctgaggttttccgccagacgccattgctgccaggcgctgatgtgtccggcttctgaccatgcggtcgcgtttggttgcactacgcgtaccgttagccagagttgtccggcgctctccggctgcggcagttcaggcagttcaatcaactgcttaccttgcgggccaacatccagaggcacttcaccgcttgccagcggcttgccatccagcgccaccatccagtgcaggaactcgttatcgctatgacggaacaggtattcgctggtcacttcgatggttcgcccggataaacggaactggaaaaactgctgctggtgttttgcttccgtcagcgccggatgcggcgtgcggtcggcaaagaccagaccgttcatgcagaactggcgatcgttcggcgtatcgccaaaatcaccgccgtaagccgaccacgggttgccgttttcatcatatttaatcagcgactgatccacccagtcccagacgaagccgccctgtaaacgggggtactgacgaaacgcctgccagtatttagcgaagccgccaagactgttacccatcgcgtgggcatattcgcaaaggatcagcgggcgcatttctccaggcagcgaaagccattttttgatggaccatttcggcaccgccgggaagggctggtcttcatccacgcgcgcgtacatcgggcaaataatatcggtggccgtggtgtcggctccgccgccttcatactgtaccgggcgggaaggatcgacagatttgatccagcgatacagcgcgtcgtgattagcgccgtggcctgattcattccccagcgaccagatgatcacactcgggtgattacgatcgcgctgcaccatccgcgttacgcgttcgctcatcgcgggtagccagcgcggatcatcggtcagacgattcattggcaccatgccgtgggtttcaatattggcttcatccaccacatacaggccgtagcggtcgcacagcgtgtaccacagcggatggttcggataatgcgaacagcgcacggcgttaaagttgttctgcttcatcagcaggatatcctgcaccatcgtctgctcatccatgacctgaccatgcagaggatgatgctcgtgacggttaacgccgcgaatcagcaacggcttgccgttcagcagcagcagaccattttcaatccgcacctcgcggaaaccgacatcgcaggcttctgcttcaatcagcgtgccgtcggcggtgtgcagttcaaccaccgcacgatagagattcgggatttcggcgctccacagttccggattttcaacgttcaggcgtagcgtgacgcgatcggcataaccgccacgctcatcgataatttcaccgccgaaaggcgcggtgccgctggcgacctgcgtttcaccctgccacaaagaaaccgtcacccgcagttcatcgcgcagctcgccgtacatctgaacttctgcctccagtaccgcgcggctgaaatcatcattaaagcgagtggtaacttggaaatcgctgatttgcgtggtcggtttatgcagcaacgagacgtcacggaaaatgccgctcatccgccacatatcctgatcttccagataactgccgtcactccagcgcagcaccatcaccgcgaggcggttttctccggcgtgtaaaaatgcgctcaggtcaaattcagacggcaaacggctgtcctggccgtaaccgacccagcgcccgttgcaccacagatgaaacgccgagttaacgccatcaaaaataattcgcgtctggccttcctgtagccagctttcatcaatattaaatgtgagcgagtaacaacctgtcggattctccgcgggaacaaacggcggattgaccgtaatgggataggtcacgttggtgtagatgggcgcgtcgtaaccgtgcatctgccagtttgaggggacgacgacagtatcggcgtcaggaagatcgcactccagccagctttccggcaccgcttctggtgccggaaaccaggcaaagcgccattcgccattcaggctgcgcaactgttgggaagggcgatcggtgcgggcctcttcgctattacgccagctggcgaaagggggatgtgccgcaaggcgattaagttgggtaacgccagggttttcccagtcacgacgttgtaatacgacggccagagaatccgtaatcatagtcatagctgtatcctgtgtgaaattgttattcgctcacaatttcacacaacatacgagccggacacatagagtgtaaagactggggtgcctaatgagtgagctgactcacattaattgtgttgcgctcactgcccgctttccagtcgggaaacttgtcgtgccagctgcattaatgaatcggccaacgcgcggggagaggcggtttgcgtattgggcggaagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacacgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcatttagcatttgcatggtttgttgaaaaccggacatggcactccagtcgccttcccgttccgctatcggctgaatttgattgcgtgtgagatatttatgccagcctgccagacgcagacgcgccgagacagaacttaatgggcctgctaacagcgcgatttgctggtgacccaatgcgaccaggtgctccacgcccagtcgcgtaccgtcttcatgggagaaaataatactgttgatgggagtctggtcagagacatcaagaaataacgccggaacattagcgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagattttatcgccgcaacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggcaggcctggttcaccacgcgggaaacggtctgataagagacaccggcatactctgcgacatcgtatagcgttactggtttcacattcaccaccctgaattgactctcttccgggcgctatcatgccataccgcgaaaggttttgcgccattcggcgaggctgacgccgaagtgagatttaaaatgctgacgccaggtcacaggtgagagaaaacccacgccaatacacctacggcgtttacaggtatactcgctaaaaattattcagcgggtttggaaacaaagatggcaaaacttaccttacaagagcagttgctcaaagcgggactagtcaccagcaaaaaagcggcgaaggtggagagaacggcgaaaaaatcgcgcgttcaggcgcgtgaagctcgggctgcggtagaagaaaataaaaaggcacagcttgagcgtgataaacagcttagcgaacagcaaaaacaagcggcgttggcgaaagaatataaagcccaggtgaagcagctcattgaaatgaaccgaatcaccattgccaatggcgatattggttttaacttcactgacggcaatctgattaagaagatttttgtcgataagctcacacaggcgcagttgattaatggtcgtctggcgattgctcgcttgttggtcgataacaatagcgaaggtgaatacgccattattcccgccagcgttgccgataaaattgctcagcgtgatgccagcagtattgtgttgcacagcgcgctcagcgccgaagagcaggatgaagacgatccgtatgccgacttcaaagtgcctgatgatttgatgtggtaaacatagataagccgtgcagtgatgcctgatgcgacgcttacgcgtcttatcaggcctacggtttacgggcgaagtgtaggccggataaggcgttcacgccgcatccggcagccgtgcgcagatgcctgatgcgacgcttttcgcgtcttatcaggcctacggcttacgggtgaaatgtaggccggataaggcgtttacgccgcatccggcagtcgtgcactattatcaacgcatattcagtttattggcgtggtacgcaatatgctcgccaataaaactggagacaaaataatagctgtgatcataaccctcgtgataacggattaacgtcttgatattcatctcctggcagatcttttcaagatttggagtccgcagctgttctgcgtaaaaatcatcactcaatccctgatcaaccatgatttccgcaacgcgttgaccttgtgaaataagactcaccgggtcgtaatccaaccaggcatctttattttcaccaagatatgcggcaaaggcttgctgtccccacggtacttgcgatggggagacaatgggcgaaaacgccgagacgctgacatattcatctgggttacgtaacgccagcaccagcgcgcccagcccgcccatagaatgacctgagatagactttctggccgttgctggaaaatgatgcatcactaaattcggcagctcgttgcggatatagtcatacattttgtaatgttcattccacggcgcttgcgtcgcgttcaggtaaaacccggcaccttgcccgagatcgtaacggtcagcatctgcgacatgactgcctcgcggactggtgtccggcgcaacaacaataatgttgtgctcagccgcgtaacgctgcatccccgatttagtaatgaaattctgctcgttgcaggtcaggcctgaaagccagtacaacaccggcaatttttcattctcggcttttggtgggagatagacgccgacattcatttcacatttcagtgattgggaataatgccgatacacattttgccagccgccaaagctggcatgtttttcaatgagttccatcagtcattatctcacggttaatcccccggacggctgcccggggagagtattaagaaccccatctgaactggacggggtaaaccagcgggaaatcagtaacgaattacggttcgaatggatttaccttcatgcatcaggtcgaaggcgtcattaatttcatccaggctcatggtatgcgtgacaaacggttccagatcgatatcacctttcatcgcatcttcaaccatacccggtaactgggaacgacctttcacgccgccaaacgcggaacctttccatacgcgaccggtgaccaactggaatggacgggtggagatttcctgaccagatcctgcgacaccgatgatcaccgattgaccccagccgcggtgcgcactttccagcgccgcacgcatcacgttgacgttaccgatgcattcaaaggtatggtcgataccccatttgttgatatccagcaggacatctttaatcggtttgtcgtagtcattcgggttaatgcagtcggtggcaccgaagcgacgcgccagttcgaatttcttcgggttggtatcgatagcgataatccgtcccgctttcgcctgacgcgcgccctgaaccactgccagaccaatcgcgccaagaccaaacacggcaacagaatcacctggctggactttagctgtgttgtgtaccgcgccaataccggtggtcacgccacagcccagcaggcagacgtgttcatggtttgcttctggattaattttggccagagacacttccgctaccacggtgtattcactgaatgttgagcatcccatgtagtgataaagcggctgcccgttgtaagaaaaacgggtggtgccgtctggcatcaagcctttgccctgcgtttcgcgaaccgcgacacacaggttggttttgccagaacgacagaactcacactcgccgcactctgcggtgtaaagcgggatcacatggtcgccaggtttgacgctggttacgccttcaccgacttcaacaacaaccccggccccttcgtgaccgagaaccaccgggaagacaccttccgggtcatcgccggagagggtaaatgcgtcggtatggcaaacaccggtatgggtgactttaatcagcacttcaccttttttcggtggtgcaacgtcaatttcaacgatttccagcggtttaccgggagcaaatgcaacggcagcacgtgatttcatctctcgctcttcctcaatatggtaatagattcagctatttaagataggcacgaaccagttcaatagtgtcgtcaacggattggctgacttcgcggctgtagcagtcatttcggtcaaacgtttcccggatatggctttcaagcacttctgccatcagtccgttagccgcgccccgaacggcagcgatctgttggagtatggcacggcattcggcatcaccctccagcgaccgttccagagcatcaatctgcccccgaatacgacgaactcgagtaaggacctttttcttctcttccggagtactgggcatttcgcacctcatcatctgcacgcaataamtataggggggtatgctatatgtcaatgcatacccccctatagtatataacactggagaataaaatttatccggtgaatgtagtcggaaaacaaagaggaaaggggataggggctaatcggcagggaaggccgccccggatagcgggcggcagaaggaatcagaatttccaggtcagatgggctgcaagttgcagaccgttataatcatcggttggggtgtcgtaccacactttacctgccgtcaacccgagattaagttgctcagtcagcggttgaatacgttgcaaactgatgctcttcatgctgccgtagcgtgtttctggcgtccagtcgtaggtgtaagcacctgttccgcggcttagccatagttgcgtgtaaccagtgccgcgcgggtcattcagacgcacggaaatcatattgctgtaactaccacctgcatcgctggagtcataatgggtatagcgatagctggtgatcaccgggccagtatagagtgatatgccaccttgccaggcatcgacttcgacatcatcgtaatatttagtgtagcgataaccggtcgtgaaaagcgtttttggcaacagggccaggttaatatcctgacgaaaatcctggcgggcaaagaccggcgtattatccgcaaaggcaatacccgttcgggttgtcagccagttattccatttgtaccagactgcaccctggccgcgagtggcattgaaatgttcagtttcataatcacgacgcccctgggaaagattaaaaagcagcgttgcgttttcaactttcgccaccagttcagcatacgctaaattacggttgccatgatcgccagaataatcggtaaaatcgtagcccgcggtaatggaagttaacccggcataaacgggtaatgcgctaaaaattgccgccgctaataacgtccgttttatcattttaatctcctgtacggataagttcttgtcggagtgaataagttccggtaggtaaattacgttctacaatcacgcgcgggccaagttgcgtgttcggggaaataattcgcccaggcaaaataataacttgtacgccaaggcgtgaacgctgcccgatataacaacctaatttatcgcatccggtagcgataattccatctggagttcgaacagacacgggctgttcatccagacgatgattactggttcgtacttgtgcgcccaaatatgcctggtttgcaactaccgagtcggcaataaagcattgcggaccaatcgtggcttccgcttcaataaccgcatttttaatttcggtggcaaaaccaattcttacgccattgctgattattgtgccaggacgaataaacgcataattacctattaggcagtttgcgccaatcactaccggaccctgaataacggcaccgtggcaaatacgggtattcgcgccgataacaacctcaccggcactttcatcaataatcacctggtctgcaatctgaatatttttctctttaacattaagcttcagatagtttttcagttcctgtgacagaagggtgggaataagcggttgacgcttccaccagtgcggaatagcgggtgggtttgtcgcgctgaggttcgcgtccagtaaaaaaggcaataagtccataaataatccagatggcataagctaataatacatacacaacggaaagcggtgctaaaggcaccaacaaccagcaacgatgaaaccaggcgctaaatgcaccaataacacaaactacgccgacccagataagcgggaacattgccaacaccacaccatgtggcccggtggtgatgaattcattaaaccaggtagtgagataaataccaacgccataaagcacaaccaacagcataggaaatatactgaagataccgaagcggctaaataaaagtcttttatgcaggcgcatacagaccgcgtagcccacaatccaacgccgccagcggcgccactcctcacgcggactgttacattcctgtgggtatacgatgcagcgattcgcctgccgaatacggtagccgtttgccaccaatgtccaggtgagatcaaggtcttcgactttagtacgatccgagaaaccgaacttacgcaatacatcagtacggaacatcccgcaggcaccgctgatgataaacggtgcgccgcccagaagctgctgtagcgtgcgcttcataacaatcatcggcaactttacggtcgcgcggatgtgtggtaacagacccgcgcctttcaacgcagtagagggaatgccgcctacggcatcagcgccacgctcaatttccgccagcatatagcccattccgtcttgatcgggcggaacataggtgtcggcatcacttaaaaaaacctgatcgcaggtggcgtaattgaggccattcatcagcgcaccacctttaccggtatttttttgcgtgacggcaacaaagcggtcgccccatttgcgtttgacttccgccatgaccgcttcggtattgtccatggagccgtcgttaacgcaaattacccggcaaaaataagggttacgcagcagattatccagtgactgcgccagacacgggccttcgttataagcaggtataatggcgtcaatacagcctttcttttggctgggcttacgccttaacgtactcagaaaccatagcaatattgctacggccatacatataaagatccaggttttcatgcaatttgctcaaagaatcattttatgaataacaaaaccttcacccagatcgctattgacctgttgcccgcgaaattgagcaactgcacgcagacgctccgggcgcatataatctcgctggctctgacttttatgtttttttaacgcagtcagtttaagagaaaaatattcttctttcacggattcaaaaacctgaggcataaatgaaagccaggtacttggtgtttcatagccgagaatttgcggaatagcgcgacaggcaaccattgaggcttgatagactgcaagatgatcctgatggcggtcagcatcatgcatggtatatacacgtataatttcaacatcagagggaatttgattttttatgatgttttccagggcagaaatcatatcattgagctgtaaatgagcgcgggtgtcagcaaaattaagatgaatagtttggtggcaccctaatatctttagagcgttgcgtgattcttcgtggcgatcgattattccatctacgccagaattaccggtagtcatcactacggtagcaatataaattcctttttgcgcaaggcgagctagcgatgcgccacagcctaattctatatcgtcaggatgcgcgccaatggcaaggataccctttcttttatttgccgaagaaaggatcgctgaatctaaaaccttatccactttatgacactccattttatttattatactacaagcacaacgacgcccccagagacgtaacctctgacgcagacagatgctaatttttaagtgttaaaaatagctgatagctgaaaaacaaggggctgtcaggtacgggggtaagagtgtgtaatcttttatgtagttcatatgttaagtgtttgtgtgtttggtttgtatggttattttattttatatattgtatttaaatgtgatttagtttgtcaattaattgcatattaaaaatatgttctatgcacaaatattgattatatacattatgtgaatacattatgtggttgattgagaatgatacatttatatatgcaatgtgaatataatggtttcattatatgtgttgctgttaataaaataacagacattagaacctgcttgtttatgcattaataaaatgaagtgcagtaatttactgagttatcagagtgggcgtaattgcatatttaatctttcctttgccgcttttttgctaagaataaaatcatctgtacgataacgactaattcttttaatgaatgtttttattcctgaatactgctcccataacaagacgggggagcagacaatcatggtaatttcatcgcgtaacacatttcttgccgcactggcattcatcgcttttcaggcgcaggcggtgaacgtcaccgtggcgtatcaaacctccgccgaaccggcgaaagtggctcaggccgacaacacctttgctaaagaaagcggagcaaccgtggactggcgtaagtttgacagtggagccagcatcgtgcgggcgctggcttcgggcgatgtgcaaatcggcaacctcggttccagcccgttagcggttgcaaccagccaacaggtgccgattgaagtcttcttgctggcgtcaaaactgggtaactccgaagcgctggtggtaaagaaaactatcagtaaaccggaagacttgattggtaaacgcatcgccgtaccgtttatctccaccacccactacagcctgctggcggcgctgaaacactggggtattaaacctgggcaagttgagattgtgaacctgcagccgcccgcaattatcgccgcatggcagcggggagatattgatggtgcttatgtctgggcaccggcggttaacgccctggaaaaagatggcaaggtgctgaccgattctgaacaggtcgggcagtggggcgcgccgacactggacgtctgggtcgtgcggaaagattttgccgagaaacatccagaggtcgtgaaagcgttcgctaaaagcgccatcgatgctcagcaaccgtacattgctaacccagacgcgtggctgaaacagccggaaaacatcagcaaactggcgcggttaagcggcgtgccggaaggtgacgttccggggctggtgaagggaaatacctatctgacgccgcagcaacaaacggcagaactgaccggaccggtgaacaaagcgatcatcgacaccgcgcagtttttgaaagagcagggcaaagtcccggctgtagcgaatgattacagccagtacgttacctcgcgcttcgtgcaataaaaggaggcgcagatgctgcaaatttctcatctttacgccgattatggcggcaaaccggcactggaagatatcaacctgacgctggaaagcggcgagcttctggtagttctggggccgtctggctgcggcaaaactacgttgctgaatttgattgctggttttgtgccttatcagcatggcagcattcaactggcgggtaagggtattcagggaccgggagcagagcgtggcgtagtttttcagaatgaagggctgttaccgtggcgcaatgtacaggacaacgtggcgttcggcctgcaactggcaggtgtagagaaaatgcagcgactggaaatcgcacaccagatggtgaaaaaagtcgggctggaaggcgcagaaaaacgctacatctggcagctttccggtggtcaacgtcagcgggtggggattgcccgcgcgttggcggcaaatccccagctgttattactcgacgaaccgtttggtgcgctggacgccttcacccgcgaccagatgcaaactctgctgctgaaactctggcaggagacgggaaagcaggtgctgttgattacccacgatatagaagaagcggtgtttatggcgactgaactggttctgctttcacccggcccaggccgtgtgctggagcggctgccgctcaactttgctcgccgctttgttgcgggagagtcgagccgcagcatcaagtccgatccacaattcatcgccatgcgcgaatatgttttaagccgcgtatttgagcaacgggaggcgttctcatgagtgtgctcattaatgaaaaactgcattcgcatcggctgaaatggcgctggccgctctcgcgtcaggtgaccttaagcattggtacgttagcggttttgctcactgtatggtgggcagtcgcggcgctgcaactgattagcccgctgtttttgccgccaccgcaacaggtactggcaaaactgctcaccattgccgggccgcagggatttatggacgccacgctgtggcagcatctggcagccagcctgacgcgcattgtgctggcgctactcgcggcggtgttgatcggtattccggtcgggatcgccatggggctaagcccgacggtgcgcggcattctggatccgataatcgagctttatcgtccggtgccgccgctggcttatttgccgctgatggtgatctggtttggtattggcgaaacctcgaagatcttactgatctatctagcgatttttgcgccggtggcgatgtcggcgctggcgggggtgaaaagcgcgcagcaggttcgcattcgtgccgcccagtcgctgggtgccagccgtgcgcaggtgctgtggtttgtcattttgcccggcgcgctgccggaaatcctcaccggattacgcattggtctgggtgtgggctggtctacgctggtggcggcggagctgattgccgcaacgcgcggtttaggatttatggttcagtcagcgggtgaatttctcgcgactgacgtggtgctggcggggatcgcggtgattgcgattatcgcctttcttttagaactgggtctgcgcgcgttacagcgccgcctgacgccctggcatggagaagtacaatgagtgaacgtctgagcattaccccgctggggccgtatattggcgcacaaattacgggggccgacttaacgcgcccgttaagcgataatcagtttgaacagctttaccatgcggtgctgcgccatcatgtggtgtttctgcgcgatcaagctattacgccgcagcagcaacgcgcgctggcccagcgttttggcgagctgcatattcaccctgtttaccctcatgctgaaggggttgacgagatcatcgtcctggatacccataacgataatccgccggataacgacaactggcacaccgatgtgacatttattcaaacgccacccgcaggggcgattctggcggcgaaagagttaccctcgaccggcggcgatacgctctgggccagtggtattgccgcatatgaggcgctctctgttcccttccgccagctgttgagcgggttgcgtgcggagcatgatttccgtaaatcgttcccggaatacaagtaccgcaaaaccgaggctgagcatcaacgctggcgtgaggcggtcgcgaaaaatccaccgttgctacatccggtggtgcgaacgcatccggtgaccggtaaacaggcgctgtttgtgaacgaaggttttaccacacgaattgttgatgtcagcgagaaagagagcgaagccttgttaggttttttgtttgcccatatcactaaaccggagtttcaggtgcgctggcgctggcaaccgaatgatattgcgatttgggataaccgcgtgactcagcactatgccaatgcggattacctgccacagcggcggattatgcatcgggcgacgattcttggggatattccgttttatcgggcggggtaagggggaaatgccgggttggataacccggcataatgatcattaacgcagaatcttcttctcagccaaatccagcgcaaagtagctgaaaatcagatccgcacccgcacgcttaatcgaacctaagctttcgagcacgactttctcttcatctatagcacccgccagcgcggcgaacttaatcatcgcgtactcaccgctcacctgatacgcgccaatcggcaattcagtacgttcacgcagctcacgcacgatgtcgaggtatgctccggcaggtttaaccatcaggcagtctgcgccctgggcttcatccagcagcgactcacgaatcgcctcacgacggttcattgggttcatctgatagcttttgcggtcgccttttaatgcgcttccggcagcttcacggaacgggccataaaaggaggaggcgaacttggtcgaatacgacataatcgccgtatctttaaagcccgcagcgtccagcgcctggcgaatcgcctgtacctgaccatccatcgcggcagaaggggcgatgaagtctgcgcctgcagcagctgcaaccacagcttgcttgcctaaattttccagagtcgcgtcgttgtcgacgccatgctcgcacagaacaccgcagtgaccgtgagatgtgtattcacagaagcaggtgtctgacataacgatcatttctggcacggtctgcttgcagatgcgcgacatacgcgccaccagtccatcttcccgccaggcatcgctgccggtttcatcggtatggtgagagatgccgaaagtcatcacggaacgaataccggcgttggcgatgcgttcaatttcgcgtgccagatgtttctctggaatgcgcatcacgcctggcatggcttcaacggctttgtagtcgtcaatttcttcttcaacaaagatcggcaacaccaggtcgttaaggctaagtgttgtctcttcaaacatagcgcgcagcgcaggagatttgcgcaggcgacgagggcgttggattaaatctgtcatggtctgcctgatgtttgtggaatcgaggagcatagtatacctgaagcaggctgggtgtgttttacgaaagttgtcgcgatgttgacaaaaagagaatgaaaaagaggtcaggacatctttgtaatagaaatagcaataatttcatattcactgaaaatatttttaatttttatttatagccatagattattgtttttggggatttggtgacgtttccaaaaagtgaatagcttaaagttcattgcttattgatacattatttgtctgtttttgttgttttatattttcatggtctatgttttaaaattaacgctttcattaacgtattgaaatattgtgtttttgttatttctttctttgtgtgtgttcacgtgctttatatatgtccgcaatcggacttaggggaaagaataattgaaccattcctctataacgccgcataatcgtaaacgcgaaacataatatgttttctatgcattgataattgatggatcaacttattacgtccctgaggagggatgacaaatgcactcctggaaaaagaaacttgtagtatcacaattagcattggcttgcactctggctatcacctctcaggctaatgcagcaaactatgatacctgggggtatcatgacaacaccacgaccgatttagtttggccgtatgacactgacaatgatggaattgccgatgctggcggcatggacccgatgggttcagacggtaactacgtaacttacaatggttttgtttactataacaatgccaatggcgatttcgatactgtctttaaaggcgataccgttaacggtaccatttctacttattacttgaatcatgattacgctagcggttctgttaaccaggtagatatcagcaattcagtaattcatggggcaatcacctctgaactgccatttggttattacagcattactcctgcagaagttaatgctaaaggtgaagttgtaactccacagacctataatggctataatttctataacggaatcactactgaccttgactacaattggtacgatggtgacgtattcactctgaacgtatccaattccaccattgatgatgactatgaagctctttacttcactgacacatatcttgatggtgataaatctaagtcaaccaatgaaacgttctataccgctctgggtgttgcagtaaatcttgatgttgaaagcaatatcaatattactaacaactcccgtgtagctggtattgcgctgtctgaaggcaatacaagcaacacgacttatactagcgaatatcatcagtgggacaacaacattaatgtgtctaactccactgtaacttcagggtcacagactccgctggaagaaagcaatggcttcttcggtaaatctgctgaaccaagtgattacgctggtaatggtggcgaaaatgacgtagctctgtcattctctgacaatgctggctcaaattattccatgaaaaacaatgtaaactttgaccattcaaccctgttgggtgatgtcgagttcacaagccactggaataacgatggcgtattcttctattcaaccggccatgacagcaatggtgacggtgtccttgataccaacggtggttgggtagatgatgctcagaacgttgatgaactgaacattactctgaacaacggtagtaagtgggttggctcagcaaacatgagtgctgaagtaattgctccggcagatatgtatgatgttgcgccgaacagcctgacccctggtgccactatcgaagctaacgattggggtcgtattattgacaacaaggtattccagagcggcgtatttaacgtagcactgaacaatggttcagaatggaataccgttaatagttcagtaattgatacattagctgtaaataatggctctcaggtaaatgttactgattcctctctggtctcagataccattggtttaaccaacggctcctcactgaatattggtgaagatggtttggttgctacagaccacctgactgttgatagctacagtaccgttaatttaaccgaatctactggctggaataactattctaacctgtatgccaatatcatcaccgtaactaacggtggtgtactggatgtgaacgttgatcagtttgatactgaagctttccgtactgacaaactggaactgactagcggcaacatcgctgaccacaacggcaatgtagtttctggtgtgttcgatatcaacagcagcgattatgttctgaacgctgacctggtgaacgaccgtacttgggataccgctcaggctaactacggctacggtgttgttgctatgaactctgatggtcatctgactatcaacggtaacggcgacgtagacaacggtactgaactggataacagctctgtagacaacgttgttgcggcaaccggtaactacaaagttcgtatcgacaacgcaactggcgctggcgcaatcgctgattacaaagataaagaaattatctatgtaaacgacgtcaacagcaacgcgaccttctctgctgctaacaaagctgacctgggtgcatacacctatcaggctgagcagcgtggtaacaccgttgttctgcaacagatggagctgaccgactacgctaacatggcgctgagcatcccgtctgcgaacaccaatatctggaacctggaacaagacaccgttggtactcgtctgaccaactctcgtcatggtctggctgataacggcggcgcatgggtaagctacttcggtggtaacttcaacggcgacaacggcaccatcaactatgatcaggatgttaacggcatcatggtcggtgttgataccaaaattgacggtaacaacgctaagtggatcgtcggtgcggctgcaggcttcgctaaaggtgatatgaatgaccgttctggtcaggtggatcaagacagccagactgcctacatctactcttctgctcacttcgcgaacaacgtctttgttgacggtagcttgagctactctcacttcaacaacgacctgtctgcaaccatgagcaacggtacttacgttgacggcagcaccaactccgacgcttggggctttggtttgaaagccggttacgacttcaaactgggtgatgcaggttacgtgactccttacggcagcgtttctggtctgttccagtctggtgatgattaccagctgagcaacgacatgaaagttgatggtcagtcttacgacagcatgcgttatgaactgggtgtagatgcaggttataccttcacctacagcgaagaccaggctctgactccgtacttcaaactggcttacgtctacgacgactctaacaacgataacgatgtgaacggtgattccatcgataacggtactgaagggtctgcggtacgtgttggtctgggtactcagttcagcttcaccaagaacttcagcgcctataccgatgctaactacctcggtggtggtgacgtagatcaagactggtccgcgaatgtgggtgttaaatatacctggtaatattcttcactccgaagaaataggtaatttaatctaaataatgcccgtcaaggatttgacgggcattactgcaaaggacgcgcaaatgttatctgtagttaaacctcttcaggaatttggtaagctcgataaatgtttgtccagatacggtacgcgcttcgagtttaataatgaaaagcaagttatattttccagtaatgtcaatagcgaagatactttcgttattttagagggcgttatctctttgcgtagagaagaaaacgtacttatcggtattacacaggctccttatattatggggctggctgatggtttaatgaaaaacgatataccatacaaattaatatcagaaggaaactgtacgggatatcatttgccagccaaacaaaccattactcttattgaacaaaatcaactctggcgagacgctttttactggttagcctggcaaaatagaattctggaattacgcgacgttcagctcattgggcataattcctacgaacaaatccgcgcgacgttattatcaatgattgactggaatgaagaattgcgatcacgtattggcgtgatgaattatatccatcaacgtacacgtatatcgcgttctgtcgttgcggaagttcttgctgctttgcgtaaaggcggctatatcgaaatgaataaaggcaaactggtcgctatcaaccgtttgccttcagagtattaatcaggatgcggggataaccaacggtttattcccgcttagctcggtcaccaggtcattgatgccatcgctcatatttttaaagcgcgtcaacggcgaacgagtgaccaccacaaacgcgccaatattcttctgcgggatcatcgccatataggtaatgaaaccgccaccaccacctgtcttctgaataatccccggacgaccctctttcggggccatatatacccagcctaaaccaagcgcatccgctttgccggggacatccatgccaatcacttttgtaaactgcgcgcgctgataaatcaacgtctgcatgcgatcagcctggttactgcgctgataaaaatcagatgacaaatactgctgcatccagcgcatcatatcgcctggcgtggaatagacgccgccgctgccaattgccgccagcgtgttattgcacggactggcaccgcgctcagcaaccattaaacggcggcactgatccggtgagggggtgtaggtggtgtctttcatccccaacggacgggtaatctgctcttcaaacaactgggtataaggcttgccggacgcattcgccagtgcatctgccagcagatcgaatgcgaggttggagtacgcggcctggctgcccggcgcggcttttagtttggcagtggaaaggtatttccagcgttgctcgcgcgttggccagacaaataccggacgatgtgccgcgccaccgggctgttcacggggcagggcgctggtatgggttgccagattcaccagcgtaatgggcgtcccattgtaggtcggtacgcgtgcgcctggcggagcatatttacttagcggatcgtttaacttcacggtcccctggtcgagcaatttcaccagcatctcactggtcattaacttggtgagggaagcaatacgtatgacggaatccagctgcgggcgaacgttattaccaggtcgcgtttcgccataactgcgaaagacgcgctggttaccgtcgataacaaccagcgccatccccgtggcaccgctgccgtaaaaaatatgatcggcataacgatcgacaatatcagaggcaaactccggttcagtgatcggctgcgccgtatggacggaggtcaatgacgccgcatacagcacggcagaaaaaagcagactacgtttcaacggtggtgtccatagattgaatgaaggtaactgagcgtatttatactactcattgatggattgcaaagggcgaattagtgcaataatagtgttaaaaacgtaacggcgcgtaaacacgatctttttcctgctcaccaatgcctgcatttgtgatcctgcgcgtgttaatccgcttatgtaaacaatctttggtttgtgaaacccgtcgaaacaattcttatggtcaggctggcgaactaagcgccttgctatgggtcacaatgggcagtttcatttggctgacgctttgtagcggtcatgcggttaatacacagcagttgttaaaacgataagaagttagcaggagtgcatatgtttaagtcttttttcccaaagccgggaacgttttttctctcggcctttgtttgggcattgattgccgttatcttctggcaagccggtgggggtgattgggtggcgcgtatcaccggcgcttccgggcagatcccgattagcgccgcgcgtttctggtcgttggatttcctgattttttacgcttactacattgtttgcgtaggactttttgcattgttctggtttatctatagcccgcaccgttggcaatactggtcaatactcggtactgcgctgattatcttcgtcacctggtttttggtggaagtcggggttgccgtcaacgcctggtatgcgccgttctatgatctgattcaaacggcgctaagttcgccgcataaagtcaccatcgaacaattttaccgcgaagtgggcgtctttctggggattgcgctgatcgcggtggtgatcagtgtgctgaacaacttctttgtcagtcactacgtgttccgctggcgtacggcgatgaacgaatattacatggcgaactggcaacaactgcgtcatatcgaaggggccgcgcagcgtgtgcaggaagacaccatgcgttttgcttcaacgctggagaatatgggcgtcagctttatcaacgctatcatgacgttgatcgccttcctgccggtgctggtaacgctctccgcacatgtgccggagctgccgattgtcgggcacattccgtatggtctggtgattgccgctatcgtctggtcgctgatggggaccggattactggcagtggtagggatcaaactgccggggctggagtttaaaaaccagcgtgtagaggctgcctaccgtaaagagctggtttatggtgaagacgatgccacgcgcgcgacgccgcctacggtacgcgagctttttagcgccgtacggaaaaactatttccgcctctattttcactatatgtatttcaatatcgcccgcattctctatttgcaggtcgataacgttttcggtttgttcttgctgtttccgtcaattgttgccggtacgattacgctcggcctgatgacgcagattactaacgtttttggtcaggttcgcggtgctttccagtacctgattaactcatggaccacactggttgagttgatgtctatctacaaacgtctgcgcagctttgaacatgagctggatggtgacaaaattcaggaagtaacccataccttgagctaaaaaggagaagtaatgtcgcgcgtcaatcctctatcttcgctgtcattgttggcggttctgattttagcggggtgtagtagtcaggctccgcaaccgttgaaaaagggcgaaaaagcgatagatgtggcgagtgtcgtgcggcagaagatgcctgcgagcgtgaaagaccgcgatgcctgggcgaaagatctcgccaccacctttgaaagtcaggggctggcaccgacgctggaaaacgtctgctcggtgctggcggtggcgcagcaggagtcaaattatcaggcagatccggccgttccgggcttaagcaagatcgcctggcaagagattgaccgtcgtgctgaacggatgcacattcctgcttttctggtgcataccgcgctaaaaatcaaatcgccaaacggcaaaagctatagcgaacggttagattcggtgcgtacagaaaagcaattgagcgcgatttttgacgatctgatcagcatggtgccaatggggcagacgctgtttggttcgctcaatccggtgcgcaccggtgggccgatgcaggtcagtattgcttttgccgaacagcataccaaagggtatccgtggaaaatggacggtacagtccgtcaggaagtcttcagtcgccgcggcgggttgtggtttggtacttaccatttactgaattatcccgccagctatagcgcgccgatataccgttttgctgattttaacgctggctggtacgccagccgtaatgccgcgtttcagaacgcggtcagtaaggccagcggcgtgaagctggcactggacggtgatttaattcgttacgacagtaaagagcccgggaaaaccgaactggcaacgcgcaaactggcgggaaaactggggatgagcgacagcgaaattcgccgtcagttagagaaaggggacagcttctcttttgaggagacggcgctgtacaagaaagtttatcaacttgccgaagcgaaaaccggtaaatcactaccccgcgaaatgttgcctggcattcaactggaaagcccgaaaatcacccgcaatctgactacggcctggtttgcgaagcgcgtagacgaacggcgggcgcgttgtatgaaacagtgatcaaacaggaatgtcacgccagataaggcgttttaggccgcatctggcaacgtaaatcttactggcggcgatgtcgccagtgcagccatagcgccactactgcaaaaatgaggcagcctactaaaaacgggatcagcccaaaaatggtgccgacacctaaaccaatttccacccgtgggcgacctgtttcctggacctgcattaaacgctcatagacgccgggcgcatgcactagcaggttcagcaattgcgccccagcccaaaagcaaaacagcacaaacaacgcataggcaatattgccaggcgttgaagatgcattgcgatattttccgctaaacagcgattttgacagggtgaaatcagccataaaaacctccggaagtcatctgcttctcttctggtgtgataccagcggcttatggcaagtctgacaggtcatttcgattgtcaatatcagaatcatggtaaattgatgttgggaatattcccgaagcgtgaatcttcgttgtgagtcacaaaatagcaaccttaagttaaatttattaacaattgcgaaagtgttgtctacaccacagacagttgttacagaatatgcaaggatgttgtttttcgttaacggagctgccatgaatctgcctgtaaaaatccgccgtgactggcactactatgcgttcgccattggccttatattcattcttaatggcgtggtggggttactgggatttgaagcaaaaggttggcagacctatgccgtcggtctggtgacgtgggtgattagtttctggctggcggggttgattattcgtcgtcgcgatgaagaaactgaaaacgcccaataagaatattaccgggcgtttgaatattacattgtggttttcagtgcgttatccgcagcgtgacgctccagcgccagctcaatcaaacgcgtgatcaggtcggtgtaacccagaccgctggcttgccacagcttcggatacatactgatgttggtgaagccaggcagggtgttgatctcgttgatcactacttcgttctctggggttaaaaacacgtctacacgcgccatgcctgcgcatcccaacgtctgataagcctgaacggcaatcgcccggatcttatcgttgatttctggcgcaatggctgctggaactaccactttcgcgccatcttcgtcaatgtacttggtgtcgtaggcatagaaatcgctggtgagtacgatctcgccacaggtgcttgcttgcgggttatcgttgccaagaactgcgcattcgatttcacgacctttgatcccttgctcaacgatcactttatgatcgaactcgaacgccagatcgacggcaattgtgtactgttcttcactggttactttgctgacaccaacagaagagccctgattagccggttttacaaacagcggtaaccccagtttagactccacttcggcaaaactgatgttgtgacgattagcgcgcgtcagggtaataaatggcgcaatgttcagcccggcatcgcgcagcagacgtttggtgacatctttatccatacaggccgctgaagccagaacatcagaacctacaaacggtaaattggcgacccgcagcattccctgcaaggaaccatcttcgcccagcgtaccgtggacaatcgggaaaatgacatccaccgtcggcaacggctgaccgttttgtgcgtcgataagctgatgctcatgtttacctggcacctgcgcaaggctggtcgccgaaggacgcaacgcaatatgggcaggatcgtctgcatttagcagataattgctggcatcgctgacgtgccattgcccttgtttatcaatgcccagcagcacaacatcgaagcgacttttatcaatggcatcgacaatgttttttgccgattgcagagacacttcatgttccgctgatttaccaccaaaaacgattcctacccgcagtttttccatcttaaaaacctatcccgtctaacacaaagtgcatacattaccacgacaaaacgggggattcgcggccttctgacagaatgttgcaatcttctgctgacaaagcgagcaacgtactggtgaagaaagtgcgttatctcaaagatgtgtgcaagatcacaaaaatgatgaacgggaagctaatttattcctggcttaaatgaccatgtggtgagttttttctcttaattataagataacgaagagaatatatttcataacttttatttataataaaggttgataattaaaggcctgtattttatgtgggtaattatttaaataagagaaacgtttcgctggtaatcaaacaaaaaaatatttgcgcaaagtatttcctttgtcataaaaataatacttccagacactatgaagttgtgaaacataatgttaacttctccatactttggataaggaaatacatacatgaaaaatctcattgctgagttgttatttaagcttgcccaaaaagaagaagagtcgaaagaactgtgtgcgcaggtagaagctttggagattatcgtcacggcaatgcttcgcaatatggcgcaaaatgatcaacagcggttgattgatcaggtagagggggcgctgtacgaggtaaagcccgatgccagcattcctgacgacgatacggagctgctgcgcgattacgtaaagaagttattgaggcatcctcgtcagtaaaaagttaatcttttcaacagctgtcataaagttgtcacggccgagacttatagtcgctttgtttttattttttaatgtatttgtacatggagaaaataaagtgaaacaaagcactattgcactggcactcttaccgttactgtttacccccgtgacaaaagcccggacaccagaaatgcctgttctggaaaaccgggctgctcagggcgatattactgcacccggtggtgctcgccgcttaacgggtgatcagaccgccgctctgcgtgattctcttagcgataaacctgcaaaaaatattattttgctgattggcgatgggatgggggactcggaaattactgccgcacgcaattatgccgaaggtgcgggcggcttttttaaaggtattgatgccttaccgcttaccgggcaatacactcactatgcgctgaataaaaaaaccggcaaaccggactacgtcaccgactcggctgcatcagcaaccgcctggtcaacaggtgtcaaaacctataatggcgcgctgggcgtcgatattcacgaaaaagatcacccaacgattctggaaatggcaaaagccgcaggtctggcgaccggtaacgtttctaccgcagagttgcaggatgccacgcccgctgcgctggtggcgcatgtgacctcgcgcaaatgctacggtccgagtgcgaccagtgaaaaatgtccgggtaacgctctggaaaaaggcggaaaaggatcgattaccgaacagctgcttaacgcccgtgccgatgttacgcttggcggcggtgcaaaaacctttgctgaaacggcaaccgccggtgaatggcagggaaaaacgctgcgtgaacaggcacaggcgcgtggttatcagttggtgagcgatactgcctcactgaattcggtgacggaagcgaatcagcaaaaacccctattaggactgtttgctgacggcaatatgccagtgcgctggcaaggaccgaaagcaacgtaccacggtaatatagataagcccgcagtcacctgtacgcctaatccgcaacgtaatgacagtgtaccgaccctggcgcagatgaccgacaaagccattgaattgttgagtaaaaatgagaaaggctttttcctgcaagttgaaggtgcgtcaatcgataaacaggatcacgcagcgaatccttgtgggcaaattggcgagacggtcgatctcgatgaagccgtacaacgggcgctggaattcgctaaaaaggatggtaacacgttggtcatagtcaccgctgatcacgcccatgccagccagatagttgcgccggataccaaagctccgggcctcacccaggcgctaaataccaaagatggcgcagtgatggtgatgagttacgggaactccgaagaggattcacaagaacataccggcagtcagttgcgtattgcggcgtatggcccgcatgccgccaatgttgttggactgaccgaccagaccgatctcttctacaccatgaaagccgccctggggctgaaataaaaccgcgcccggcagtgaattttcgctgccgggtggtttttttgctgttagcaaccagacttaatggcagatcacgggcgcatacgctcatggttaaaacatgaagagggatggtgcgatgaaaattacattactggttaccttgcttttcggtctggtttttttaaccaccgtcggcgctgccgagagaaccttaaccccacaacaacagcgtatgacctcttgtaatcagcaggcgacggcgcaggcgttgaaaggggatgctcgtaagacctacatgagtgattgcctgaagaacagcaaatctgcgcctggtgaaaaaagtttgacgccacagcagcaaaagatgcgcgaatgtaataatcaagcaacacaacaatctctgaaaggggatgatcgtaataagtttatgagtgcctgcctcaagaaagccgcctgatacctgatagtgctaacgggtgagctacgaaaatggctcacccgaaatttcatacttctgcctttagccccgtctctataatttgggaaaattgtttctgaatgttcccaaaaataatgaatgatgaaaactttttcaaaaaagcggcggcgcatggggaggaacctcctttaactcctcaaaacgaacatcagcggtccgggctgcgctttgcccgtcgcgtcagactaccccgcgcggttggcctggctggcatgttcttaccgattgcttcaacgctggtttcgcatccgtcgccgggctggtggtggctgttgttggtcggctgggcgttcgtctggccgcatttagcctggcaaatagcgagcagggccgtcgatccgcttagccgggaaatttacaacttaaaaaccgatgcagtattagcgggaatgtgggtaggcgtaatgggcgtaaacgcactgccttccaccgcgatgttgatgattatgtgtctgaatttgatgggggcaggcggcccccgtctgtttgtcgcgggtctggtgttgatggtggtctcctgccttgtcaccctcgagctgacgggcatcaccgtgtcgttcaatagcgcaccgctggaatggtggctctcccttcccattattgtcatttatcctctgctgtttggctgggtcagctaccagacggcgactaaactggcggaacataaacgcaggttgcaggtcatgagtacccgcgacggtatgacgggcgtgtataaccgacgtcattgggaaactatgttacgcaatgaatttgataactgtcggcggcataatcgcgatgcaacgttactgattatcgatatcgaccatttcaagagcatcaacgatacctggggccatgatgtgggtgatgaagcgattgtggcgcttacccgacagttacaaattaccctgcgcggtagcgatgtgattggtcggtttggcggcgatgagtttgcagtaatcatgtccggtacgccagctgagagcgccatcaccgccatgttacgggtgcatgaagggctaaacacgttacgcttgccgaatacgccacaggtaactttacggattagtgtgggggttgcgccgctgaatccacaaatgagtcactatcgcgagtggttgaaatcggcagatttggcgctctacaaagcaaagaaagccggacgtaaccgcaccgaagtggcggcctgacgtccggcaaaagccatcaggatttgctgagtttttctgatttttccatacacttcgtcatcgcttcgatcactgcggcacggaagcctttctcttccagtacgcgtaccgcctcaatggtggtgcctcccggtgagcagaccatatctttcagtgtccccggatgttctcccgtttccagcaccatttttgcggagcccattaccgcctgagcggcaaatttatacgcctgggcgcgtggcatcccgcccagcacggcggcgtcggccatcgcttcgataaacataaagacgtaggctggcgaagaaccgctcacaccgaccaccgggtggatcatcggctcagcaatcacttccgcttcgccaaagcagcggaaaatattcagcacatcagcggtatcttctggggttaccagcgcgtttggcgttacggaggtcatcccggcattaaccagcgcgggagtgttcggcatggcgcggataattttccggtcatggcccagcgcgcgggcaagctggtcgagcgtgatacctgcagcaatagaaacgaccagagagtctttattcaggctggaggtgatttcgctaagcactttaatcatgatgcctggtttaacggcggcaaaaatgatgtcggcgatttgcgctacttcttgcgccgattctgcggcgttgatgccgaactggtcatgcaggacggtgactttatccggggagggggtatatacccagatttgccctggaagcacctgaccgctggcaatcagaccgccgagaatggcttttcccatattgccgcagccaataaaaccgattttcttttccattgcctcactcctgccgtgaaattcattgttttgataatcgctggcagaagcataaacagaactatgccggaaggcaaaagcgcgacacaatagaggattacccaacaaaggatgactttatgacaatttgggtggatgccgacgcgtgtcccaatgtaattaaagagattttgtatcgcgcggcggaacgtatgcagatgccgctggtactggtagcaaaccagagtttacgcgtgccgccatcgcgatttattcgtacgctgcgcgtcgcggcaggtttcgacgttgctgataacgaaattgttcggcagtgtgaagcgggcgatttggtgatcaccgcagatatacctttggctgctgaagccatcgagaaaggcgcggcggcgcttaatccgcgcggcgaacgttacacgccagcgaccattcgtgagcgcctgacgatgcgcgattttatggataccttacgtgccagtgggatccagaccggaggaccagatagtctttcacaacgtgaccgccaggcttttgctgcggagctggagaagtggtggctggaagtgcaacgtagtcgtggctaaatgtaatttattatttacacttcattcttgaatatttattggtatagtaagggatgtattgagatttccaccttaagtggaattttttctttacaatcgaaattgtactagtttgatggtatgatcgctattctcatgacaccggctttcgccgcattgcgacctattggggaaaacccacgatgacacaacctctttttctgatcgggcctcggggctgtggtaaaacaacggtcggaatggcccttgccgattcgcttaaccgtcggtttgtcgataccgacctgtggttgcaatcacagctcaatatgacggtcgcggagatcgtcgaaagggaagagtgggcgggattccgcgccagagaaacggcggcgctggaagcggtaactgcgccatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccactgagcgaagaagttcaggaagtgctggaagaacgcgatgcgctatatcgcgaagttgcgcatattatcatcgacgcaacaaacgaacccagccaggtgatttctgaaattcgcagcgctctggcacagacgatcaattgttgattttcgagcgcctatacttaacgttcatcccgtgaaataaggaagaacgatgccaacgaaaccgccttatcctcgtgaagcatatatagtgacgattgataaaggaaagccaggacagacggtaacctggtaccaactcagagccgatcatcctaaaccagactcgttgatcagtgaacatccgaccgctcaggaagcgatggatgcgaaaaaacgctatgaggaccctgacaaagagtgaccgcatcagactgctcggaagggattctgagtgccgccacaagggatctgcgtcacatttttcacaattcatgtttttcaaataattagaatattaaacaataacaatccattactggaatcatttggaatctttacattatgcagtgcaggtctgctgctacgctttttgtcatttgtagcacaagtaagtgtcagcagtggtgcttaacacttgcccggtaattaacgacgaaataaaagtaaggtggaagaacaatgagtgcgtcgttggcgatcctgactatcggcattgtacctatgcaggaagttttgccgctcctgacagaatacattgacgaagataatatttcccatcatagcctgctggggaagttaagccgcgaagaagtgatggcggagtacgcgccagaagcaggcgaagacacaattctcacattattaaatgacaaccatctggcccatgtttcgcgtcgcaaagtggagcgagacctgcaaggtgtggttgaagtgctcgataatcagggttacgacgtcattatattaatgagtacagcaaacattagtagtatgaccgcgcgtaatacgatctttcttgagccgtcgcggatattgccaccgctggtttcctctattgttgaagatcatcaggtgggggttatcgtaccggttgaggagttgctgaccgttcaggcgcaaaaatggcaaattttgcagaaaccgccagtattttcattgggtaaccccattcatgattcggaacaaaaaatcattgatgccgggaaagaattactggcaaaaggtgcagatgtcatcatgctggattgtttgggatttaaccagcgtcatcgcgatttactgcaaaaacagctcgatgttcctgtcttgctctctaacgtattgattgcacggctggctgcggaattactgatgtaattttgcgtgacagccagcgcctctggcccctatagtgaagtagatgttcaactaccagacagggccagtttatgcttcaaagtaatgagtacttttccggcaaagtgaaatcgatcggcttttccagcagcagcactggtcgcgccagcgtgggtgttatggttgaaggtgaatacaccttcagcaccgctgagcctgaagagatgacggtaatcagtggcgcgctgaatgtgttactgcctgacgcgaccgactggcaagtgtatgaagccggttcggtgtttaatgttcccggtcacagcgagtttcatctgcaagttgccgaacccacctcttatctgtgccgctatctgtaattcctcgccttccccttgaacgggagggcatttttctgaaatgtcctctctttaacccataataatatttcctttgctgggattttttcgatttccgatatattcataattcatcaaggttgatataaatatcagcgaagatctccagatattgttgcggaactggcgacgataaaagataaatcagatgatgaatggtggcgtgcattgctgcaaagtcgcaatgatcatttgcgccaaacggcattgcacaacgcacataccccggtgttgttgttaacgacattgactgagcctcaggagcggtcgctggctattaataattcacagctggctgccgatgtgaaaacggcgtggttaaaagaggagccatcattactcttatttgtcgaacaacccgatctttcgctgttacgtgatttagtgaaaaccggggcaacgcgaaaaattcgcagtgaagcgcgtcaccggcttgaggaaaaacaatgacacaacgcccctggagcaagttacagcataaaacgcataatattgctgcgctaagaattattgcccgctgtagctaacgattatattcctggtgtggctttgtacgccggataagacgcggcaggcgtcgcatccggcattaaaggtaaatcagcaattaacgttgtgcttcgccacctaatccttcaatcaggttttgaattaacgctgccagttcaccagtcatcaggatgaaatcggcatcaaagcgctgggcgaaatcttcacggtcgatatcttcgttttgatcgcgcagctcgtcgcagaacttcagacgcttgagcgaaccatcgtcgcacatcacaaactgaatgcgctgctgccagtcaagcgccagtttagtcaccacttttccggcttcaatgtggttggtgatctcttcgctggtcagatcttgtttcttcgcgcggatcacgccgccatcttccagcaacgatttcagctcggcttcatcaagcagctggaagccctgtgccgcgctgccggaacgtacccattcggtcagcgtcagttcaatcgggttttccatgctcaatggtacaaccggtaacgaccccaggcttttacgcagcagtgccagcgtatcttccgcttttttggcgctggcgcagtccaccataatcaaaccgttaaccgtgtcgatccacatcattgtctggctaaaacggctgaaagcacgcggcagcagagagtgcagcacttcgtctttcagcgaatctttttcggttttcttcagcttacgcgcctgttctgcttccagtttggcgattttcgcttccagcgcctgtttaatcaccggggacgggaggattttttcttctttgcgcgcacagataacaatttgaccattggcaacgtgcgttaacgcatcgctgtgcgatcccatcggaggtacccagcccatcttcgccatgtcctggctgccgcatggggtaaatgccatcgaggctagctgtttttccatctcttctgcacgcagcgaaatctcgcggctaagacggtaaaccattaaatttttgaaccacagcatgataatttccacggccttgtcgttaaatttagcgggcatgataacgaattgtcggcggccttgcattgccaatccggttgtccgtctctacgctattgatattgaaaaaataaggagagtaccgtgcgtataggtatcgatttaggcggcaccaaaactgaagtgattgcattgggcgatgcaggggagcagttgtaccgccatcgtctgcccacgccgcgtgatgattaccggcagactattgaaacgatcgccacgttggttgatatggcggagcaggcaacagggcagcgcggaacggtaggtatgggcattccaggttcgatttcgccctacaccggcgtggtgaagaatgccaattcaacctggctcaacggtcagccattcgataaagacttaagcgcgcggttgcagcgggaagtgcggctggcaaatgacgccaactgtctggcggtttcagaagcggtagatggcgcggcagcgggagcgcagacggtatttgccgtgattatcggcacgggatgcggcgcgggcgtggcattcaatgggcgggcgcatatcggcggcaatggcacggcaggcgagtggggacacaatccgctaccgtggatggacgaagacgaactgcgttatcgcgaggaagtcccttgttattgcggtaaacaaggttgtattgaaacctttatttcaggcacgggattcgcgacggattatcgtcgtttgagcggacatgcgctgaaaggcagtgaaattatccgcctggttgaagaaagcgatccggtagcggaactggcattgcgtcgctacgagctgcggctggcaaaatcgctggcacatgtcgtgaatattctcgatccggatgtgattgtcctgggcggcggaatgagcaatgtagaccgtttatatcaaacggttccacagttgattaaacaatttgtcttcggcggagaatgtgaaacgccggtacgcaaggcgaaacatggtgattcgagcggcgtacgcggcgctgcatggttatggccacaagagtaaaaaaaccaggcaattggcgtatcatgcctgatgcgacgcttgccgcgtcttatcaggcctacaaagtgagccgtccggtaggccggataaggcgctcgcgccgcatccgacaacaaataacgcgcacagtggcggcaaccccccagtgctccgatgcctgatgcgacactggcgtgtcttatcaggcctacaaaatgaacagtcccgtaggccggataaggcgttcacgccgcatccggcaacaagcgatgcgcactgcgactgctatctaccccagtggtttcgccagcaccgaactatccgccgcttgctggcgcttatagcgaccatacagcagcaacgacgacatcgcagcaaacgaaagcagggcggcgggcagcgccacgtaattatatgccagccccagcgtcagcatcataccaccgcaatatgcgccgacggcgctaccgaggttaaacgctatttgcccacctgcggcacctaataactctccgcctttggcattttgcagtaataatatttgtagaggtgctgatagggcaaataatcccgcgcaacaaataaaagcaaaaataagcgacgttgttttcataccgccgaagaaaaagagcatcagcagtgccagtacaatgataaagtcagtcactgctgcaatgcgcagtggtgaataacgtcctgaaatcctgccacttagcatattccccagcaccatccctagcccaactaacatcataataaaggtcatcgccgtttccgaaaaaccggaaataaacatcatgtatggctttacgtagctgaaccaggcaaacacacctgcgttgccaaacatcgtagcggcgaaaattaaccacggggcagggctgcgtaaaaagtgaaattgttcgcgtagttttcctttcgcctcgtcgcgaatatccggcacccaaaaatagaccgatgccatcaccgcaatattaaaaacagcgatcaacaaaaaggtgtagcgccagctaaattcctgacttaaatacgttcccagtggaatgcccagcaaattggcgactgtcatcccggaaaccatccctgccacggcggcggtgactttgccgggtttgataatttttgataacacgatcgcgccgacgccaaaaaatgcaccatgcggaaagccggaaaccagccgaccaatggcgagcatcaggtaagacgaagagagcgtgaacatggcgttgccaatgacgcacaacgccaccagaaacaacaagatatgtttgagtgagtagcggctggaaaaaagcgcgattataggcgcaccgaccaccacccccagcgcataatacgagatcatatgcccggcggcaggaatcgaaattcctacgttatgcgccagctccgtgagcacgcccataatgccaaattcggccatccccaaaccaaacgtgcccagagccaaagataaaataacttttttcataccaccatcacaaccaccagaacggctaccaatcaccgtagccaataaagtgatagattgcaggataacgaccagcgaggccaagagataattcgcccctctgtattcattatcctgctgaatagttatttcattgcaaacgcactttccagtttgctgtagcccagtccattgatcttcttcactttgatctgcaccggaatacgctctttcatcgcctcaacgtggctaatcaccccgatggttttgccactggcattcagggcatccaacgcatcaagggcggtatccagcgtttcgctatccagtgtgccaaaaccttcatcaaggaacagcgagtcaatacgcgttttatggctgaccagatctgaaagcgccagtgccagcgccagactgacgaggaaactttcgccgccggaaagggtacgggtatcgcgtaccgcatcagcctgccaggtatcaacaacctcaacttccagcgcttcgctggctttgcgctgtaacagatagcgcccgtgtagccgggtgagttgctgattagcgagatggactaaattatccagcgtcagcccttgggcaaacttgcggaatttatcgccctctttggaacctattagcgaattcagatatccccagtcctcaacctgctgcgtcatttgagcaatttgctgcattaaggtttgttgttgctgacggttatctgcatcctgcttcagctgctggcgaatctcgccttgactcgtggtgttttcacgcaacttttggtgagtttgcgctaactcttgctgaatctgctccaccgtcacagtgagagacaacccgccaggtcggtgttgctgatgctgtgtcagcgtttctgctgtctgagtgaccagcgtttgcgcctgacggcgctggttttccagattctgcttgagctgttccagctgcgttagtgtttgttcatccattagcgccgcaaggaacgcctgctgatcgtcaaagacgctcgcctgtagcgcggtgtcaaactgcgcctgggctttttgcagactttgcgccgccagaacatcctgttgctgtaacgtctgctgctggctgtgtaatgcgagacattgttcatgaacctgccgccagttttccagcgccacagtttcttcgctgtgcgggagttcatcactttgcggcaacgtttccagaatcggcgtcagttgctgaatacggttttgcagcgcggttaattcgttctggcgatgctgccagctctgcgcttcttgctgacgcgtcgccaaccagctctcttcttcatcttcctgtggcaatgtcagtgcataacccgccaatgccgttaagagctgctgctggcgttgttcaatttgctgttgatactggataatttgctgattatgcgcggcaatctgcccttgtaattcatgccgttggctgagtaaccgcagctggcgttcgtgctcatcttgtgcatctagccacggttgaatatcgtcctgtggctgcaaggtgatattgaggctggccgtgacggcttgccattgttgagtaagtgcttgctcatcttgtcggaggctttgcgcttcgttttcatcacgctgaagttgctttgttaaggcgtccagttgcccacgtagcgtcgcaccttcttcgccgagctttttcacttctttttccagcgttaatagccgggcctgattaacgcccggttccagcgcctgatacgcctcgaccgccgggtggctggtggaaccacaaagtggacaaggctgacccgcttgtaactgcgcgcgctgggcttccagcgttttaatgcgagtttcctgctcgcaaatggttttcacatcggcaagttgttgcgttttttctttataacgatggcgcatttcgttaagtgcggcattacgttgcgtctgttccagagtgacattctggatagcgacctgtaactgcgccagacgtttttgttggggaacaatctgcccatgcagtgcgaccaggcgctgacgcagtgggcgttgctcagcatgttgcgccagggcgctagcaacttcatcggcggttaacgtcaacgtgatcgccgcaagtgcattaagtttttgctcagcatgagttaactgttgctgccattgccgcagatgctcgcgatcgctggtttgttgggagaactgcgcacgccaacccgccagttcgttgttccactgacgtaagcggtcgtgttcctgtaaccaggcattcaggctttgttgctgctgctgtaattctgctgactgcttcgccgcgtggtggcgaatgctcgcacgaagcgccattgtgctctgtaagcgagtatttacttcttcaatctgctggcgagtatgcgccagcgccgtgctgtattctgcgatgcgttcccagtgcggacgaagatttcgtgccggttgtgccagactgagcgccgccagttgaggttgcgctttttcttcttcggctaacgcctgttgcaaggcctgttgacggcggctgccttcttgctgcaattcgtccagacgcgttaaccagtttagcgattgttgttcttgctgctgcgcggtaattaactgtttttcttcgtcagtaagtacctgcaaactcgctgtcagcgattgcacttgttctggcgtgagcaacgcgacgccgctggcctgcgcttgcagcttctccagctctgtgcgggccgatttgtgctgctcaaaaaccatcgccgagatttgcccgtagatttcagtgccggttaactcctcgagcaattctgcgcgttctttgggtttggcattcaggaaggcagcaaattgcccctgcgaaagcagcatcgaacgggtgaagcgcccgtaatccagtccggttaacgtcgccgtcagttccagcttatctttcactttgtcggcgagaattttgccgtctgcacagcgcgccagctctacgcgtggcacctgcaaattaccgtccggctggttacgcgcccgattctggctccagaacgcgcgatacgcttcacctttgacttcaaactccacttccgccagacattcggcggtatcgcgggtcatgagatcattttgcgattgtgaaacgttagagaggcgcggggtttcgtgatacagcgccagacaaatggcgtccagcagggtggttttccccgcaccggttgggccggtaatagcaaacagcccgttgctggcgaacggctcgcgggtgaaatcaatcttccattcgccttttaatgagttcaggtttttcaggcgcaggctgagaattttcatgcttcgtgttctccggcgaggctatgcaacgtcgtggcgaaaagatgctgcagacgttgctgctgtgattcatccagttcttccagtgccagacggcgattgaacacctcttcgacgctgagttcgctgagggtttcacgctgttggctggctaacacacgctcgcgctgttcacgactccggcgtaccagcaaaacttcgacaggcaatgattcggttaatgcctggattttgcgctgaatatcatgcagatactcatcagtagtgatttcgatatccagccagacaggcggctcctgtgatatatcgcgccactgttccagctgtgcggtaatcgacgccagatcgcctttcagcaccgccatgggttgcgttaccggtacgttcaggttttccacgctctctaatttgccgtttgaaaatgtcaccagatggacatatttactcttaccgcattcatcaaaactcagtggtatgggggaaccgcaatagcgaacatgttccatgccgccaataatctgcgcgcggtgaatatgcccgagcgcgatgtagtcggctggtggaaagttttgtgccggaaacgcgtccagcgtgccaatataaatgtcacgcacggcgtcacttttactggcacccacggtcgttaaatgtccagtggtgatgatgggcagaggctgagcgccgcgcagtttgcaggcatcggcataatgttgttgataataatcagtaatagccgccagcaaatgctgctgtttttcaataccgttaagccccgcctggctggtaataatgtcacgcgggcgtaaaaaaggtatgggacacagcaccgcgcctggcgtcccgtcgcgacggggcaatatttgcggcgcatgtccggcgctggcgaccacggtagtattgaggaacgccatgatatcgcgcgattcattcagcgtggcgaccgagtcatggtttcctgccagtaccaccagatgacagccagtttgctgtaaattgacaacaaaacggttgtataacgtgcgggcgtaactgggcggcgagccggtatcgaaaacatcaccggcaacaataatcgcatccacctgatgggcttgtgctgtctccagcagccagtcaagaaaagcctgatgttcggcttcgcggcttttactgtagaagttctggccgagatgccagtctgaggtgtgaaggatgcgcataacggttccctggcgaaaaagcatgggcgcgattatacccaaacagatgtgccatttgcttttttctgcgccacggaaatcaataacctgaagatatgtgcgacgagcttttcataaatctgtcataaatctgacgcataatgacgtcgcattaatgatcgcaacctatttattacaacagggcaaatcatggcgagacgtattctggtcgtagaagatgaagctccaattcgcgaaatggtctgcttcgtgctcgaacaaaatggctttcagccggtcgaagcggaagattatgacagtgctgtgaatcaactgaatgaaccctggccggatttaattctccttgactggatgttacctggcggctccggtatccagttcatcaaacacctcaagcgcgagtcgatgacccgggatattccagtggtgatgttgaccgccagaggggaagaagaagatcgcgtgcgcggccttgaaaccggtgcggatgactatatcaccaagccgttttctccgaaggagctggtggcgcgaatcaaagcggtaatgcgccgtatttcgccaatggcggtggaagaggtgatcgagatgcaggggctaagtctggacccgacatctcaccgggtgatggcgggcgaagaaccgctggagatggggccgacagaatttaaactgctgcacttttttatgacgcatcctgagcgcgtgtacagtcgcgagcaactgttaaatcacgtatggggaaccaacgtgtatgtggaagatcgtacggtcgatgtccacattcgtcgcctgcgtaaagcactggagcccggcgggcatgaccgcatggtgcagaccgtgcgcggtacagggtatcgtttttcaacccgcttttaaggccttgctcatcggacgtagagcagggcttatgatttcttaactggagtatcttacgtgctggaacggctgtcgtggaaaaggctggtgctggagctgctactttgctgcctcccggctttcatcctgggtgcattttttggttacctgccctggtttttgctggcatcggtaacaggactgcttatctggcatttctggaatttattgcgcctttcatggtggctgtgggtggatcgtagtatgaccccgccaccggggcgtggtagctgggaaccgctactatacggcttacaccagatgcagctgcgaaataaaaaacgccgccgtgaactgggcaatctgattaaacgctttcgtagcggcgcggagtcgctgcccgacgcggtggtgctgaccacggaagagggcggtattttctggtgcaacggtctggcgcaacagattcttggcttgcgctggccggaagataacgggcagaacatccttaacttgctgcgttacccggagtttacgcaatatctgaaaacgcgtgatttctctcgcccgctcaatctggtgctcaataccgggcggcatctggagattcgcgtcatgccttatacccacaaacagttgctgatggtggcgcgagatgtcacgcaaatgcatcaactggaaggggcgcggcgtaacttttttgccaacgtgagccatgagttacgtacgccattgaccgtgttacagggttacctggagatgatggatgagcaaccgctggaaggcgcggtacgtgaaaaagcgttgcacaccatgcgcgagcagacccagcggatggaagggttggtgaagcaattgctgacgctgtcgaaaatagaagccgcaccgacgcatttgctcaatgaaaaggttgatgtgccgatgatgctgcgcgtcgttgagcgcgaggctcagactctgagtcagaaaaaacagacatttacctttgagatagataacggcctcaaggtgtcaggcaacgaagatcagctacgcagtgcgatttcgaacctggtctataacgccgtgaatcatacgccggaaggcacgcatatcaccgtacgctggcagcgagtgccgcacggtgccgaatttagtgttgaagataacggaccgggcattgcaccggagcatattccgcgcctgaccgagcgtttttatcgcgttgataaagcgcgttcccggcaaaccggcggtagcggattagggttagcgatcgtgaaacatgcggtgaatcatcacgaaagtcgcctgaatattgagagtacagtaggaaaaggtacacgtttcagttttgttatcccggaacgtttaattgccaaaaacagcgattaattcgcctttgtcatcttttattgccataagccagccgatgctggcttattttctttgcagtcgaaatacgggcgttagattttacaacggttggtgattttttgttcgcatgattagccatgtctttttcacggaaatagtgttttgtactggttggtgatttcttatcgctatatacctctggtttttagatcccttcttgctttaaaacgttataagcgtttaaattgcgcttcaggtgctgtcatactgactgcattcacgcggtaaatcgaaaaactattcttcgccgcgcctggttgggagtatttcccgctaaaattgtttaaatataccgctgtatcatccccagggattggcacaaaaatttaacgttacaacaccacatccacaggcagtatgatttatgacccatcaattaagatcgcgcgatatcatcgctctgggctttatgacatttgcgttgttcgtcggcgcaggtaacattattttccctccaatggtcggcttgcaggcaggcgaacacgtctggactgcggcattcggcttcctcattactgccgttggcctaccggtattaacggtagtggcgctggcaaaagttggcggcggtgttgacagtctcagcacgccaattggtaaagtcgctggcgtactgctggcaacagtttgttacctggcggtggggccgcttttcgctacgccgcgtacagctaccgtttcttttgaagtggggattgcgccgctgacgggtgattccgcgctgccgctgtttatttacagcctggtctatttcgctatcgttattctggtttcgctctatccgggcaagctgctggataccgtgggcaacttccttgcgccgctgaaaattatcgcgctggtcatcctgtctgttgccgcaattatctggccggcgggttctatcagcacggcgactgaggcttatcaaaacgctgcgttttctaacggcttcgtcaacggctatctgaccatggatacgctgggcgcaatggtgtttggtatcgttattgttaacgcggcgcgttctcgtggcgttaccgaagcgcgtctgctgacccgttataccgtctgggctggcctgatggcgggtgttggtctgactctgctgtacctggcgctgttccgtctgggttcagacagcgcgtcgctggtcgatcagtctgcaaacggtgcggcgatcctgcatgcttacgttcagcatacctttggcggcggcggtagcttcctgctggcggcgttaatcttcatcgcctgcctggtcacggcggttggcctgacctgtgcttgtgcagaattcttcgcccagtacgtaccgctctcttatcgtacgctggtgtttatcctcggcggcttctcgatggtggtgtctaacctcggcttgagccagctgattcagatctctgtaccggtgctgaccgccatttatccgccgtgtatcgcactggttgtattaagttttacacgctcatggtggcataattcgtcccgcgtgattgctccgccgatgtttatcagcctgctttttggtattctcgacgggatcaaggcatctgcattcagcgatatcttaccgtcctgggcgcagcgtttaccgctggccgaacaaggtctggcgtggttaatgccaacagtggtgatggtggttctggccattatctgggatcgtgcggcaggtcgtcaggtgacctccagcgctcactaaatcactgaacatttgttttaaccacggggctgcgatgccccgtggttttttattgtgttgatgggttaggaattgatggaaagtaagaacaagctaaagcgtgggctaagtacccgacacatacgctttatggcactgggttcagcaattggcaccgggctgttttacggttcggcagatgccatcaaaatggccggtccaagcgtgttgttggcctatattatcggtggtatcgcggcgtatatcattatgcgtgcgctgggggaaatgtcggtacataacccggcagccagctctttctcgcgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtactgagtgtggtgctgatcatttgcgccgtaaacctgatgagcgtgaaggtattcggtgagctggagttctggttctcgttctttaaagtcgccactatcatcatcatgattgtcgccggtttcggcatcatcatctgggggattggcaacggcgggcaaccgaccggtattcataacctgtggagcaacggcggcttcttcagtaacggctggcttggtatggtgatgtcgttgcaaatggtgatgtttgcttacggtgggatcgaaattatcgggattaccgccggtgaagcgaaagatcctgagaaatcgattccgcgtgcgattaactccgtgccgatgcgtattctggtgttctacgtcggtacgctgttcgtcattatgtctatctacccgtggaatcaggttggcactgccggtagcccgtttgtgctgacgttccagcatatgggcattacctttgccgccagcattcttaactttgttgtgctgaccgcttcgctgtcggcaattaacagtgacgtatttggtgtaggccgtatgctccacggtatggcagagcagggcagcgcgccaaaaattttcagcaaaacctcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaatcgccttccgtcgccgtttgccgccagaagaagttaaggcgctgaaatttaaagtgccgggtggggtagcaacgaccatcggcggtttgattttcctgctctttattatcgggttgattggttatcacccggatacgcgtatctcgctgtatgtcggtttcgcgtggattgttgtgctgttgattggctggatgtttaagcgccgccacgatcgtcagctggctgaaaaccagtaatccttgcgttctgtaagccggttcaggaggaaatcctgatccggctattccgaaagttatccgcccccgtcctcctcccccaaatatccttcagatgatgagtgatcctgcattaggctatggcaaggtgatcagattttcatcacaggggaattatgatgttaaatgcatggcatctgccggtgcccccatttgttaaacaaagcaaagatcaactgctcattacactgtggctgacgggcgaagacccaccgcagcgcattatgctgcgtacagaacacgataacgaagaaatgtcagtaccgatgcataagcagcgcagtcagccgcagcctggcgtcaccgcatggcgggcggcgatcgagctctcctgcggacaacctcggcggcgttatagtttcaaattgctgtggcacgatcgccagcgttggtttacaccgcaaggcttcagccgaatgccgccagcacgactggagcagtttgccattgatgtaccggatatcggcccacaatgggctgcggatcagattttttatcagatcttccctgatcgtttcgcccgtaatcttcctcgtgaagctgaacaggatcatgtctattaccatcacgcagccggacaagagatcatattgcgtgactgggatgaaccggtcacggcgcaggctggcggatcaacgttctatggcggcgatctggacgggataagtgaaaaactgccgtatctgaaaaaacttggcgtgacggcgctgtatctcaatccggtgtttaaagctcccagcgtgcataaatacgataccgaggattatcgccatgtcgatccgcagtttggcggtgatggggcgttgctgcgtttgcgacacaatacgcagcagctgggaatgcgactggtgctggacggcgtgtttaaccacagtggcgattcccatgcctggtttgacaggcacaatcgtggcacggggggagcttgtcacaaccccgaatcaccctggcgtgactggtactcgtttagtgatgatggcacggcgctcgactggctgggctatgccagcttgccgaagctggattatcagtcggaaagtctggtgaatgaaatttatcgcggggaagacagtattgtccgccactggctgaaagcgccgtggaatatggacggctggcggctggatgtggtgcatatgctgggggaagcgggtggggcgcgcaataatttgcagcacgttgccgggatcaccgaagcggcgaaagaaacccagccggatgcgtatattgtcggcgaacattttggcgatgcacggcaatggttacaggccgatgtggaagatgccgccatgaactatcgcggcttcacattcccgttgtggggatttcttgccaacaccgatatctcttacgatccgcagcaaattgacgcccaaacctgtatggtctggatggataattaccgcgcagggctttctcatcaacaacaattacgtatgtttaatcagctcgacagccacgatactgcgcgatttaaaacgctgctcggtcgggatgttgcgcgcctgcccctggcggtggtctggctgttcacctggcctggtgtaccgtgcatttattacggtgatgaagtgggactggatggcaaaaacgatccgttttgccgtaagccgttcccctggcaggtggaaaagcaggattcggcgttattcgcgctgtaccagcgaatgattgcgctgcgtaagaaaagtcaggcgttgcgtcgtggcggctgtcaggtgctgtatgcggaagataacgtggtggtatttgtccgcgtgctgaatcagcagcgtgtactggtggcaatcaaccgtggcgaagcctgtgaagtggtgctacccgcgtcaccgttgcttaatgtcgcgcaatggcaacgcaaagaaggtcacgggcaactgacggacgggattctggctttgcctgccatttcggctacggtgtggatgaattaacgtcttataacgccttgcgtgacgcctgctccatcatccgcggataaaactgccagaagcgggtttcgagagcatcgtaatgggcgtctaaatcgtaccaggagtcacgcagggcatccagacgtgggcgacggcttgccatgccgtttaacacgctctggatgaaatccatatcgcgatagcgcaccaaccactgctctgaccataagtagttgttcagattgataaagcgtggcggtgagtctggaagaatagtcatcacttgctcccgggcataacaggtaaattcctgtagcggaaaatcgggcgacagctgcgaccagtggcgggacagaaagtgatcccacatcacatccagcgtaataggcgcgacacggcgcgtttcattacgaaaccactcccgcgcttcgcggacttccggcagattgtcggttaatacgtcgattcgccgatgcatatgaataccagccacgacgtcgggcggaaaactttcttcaggatttccgcgtacgaaatcagccagtaaattgccggaaagcgagctttccgcgagatgggctaaatgcaggtgagctaaaaaattcatatacacttcatccttcaaactgcctcttcgttggctgccttcactcaccccagtcacttacttaatgtaagctcctggggactcattcagttgccatctcgatgcatcttgaatgattttgtgtatagattatgtcatccatcaaggagggtaaaggttgcagggagagcgccccggcactagactacccgcctcttattttagtctgagtcagtgtcatgcgcgttaccgatttctcttttgaattgcccgaatccctgattgcccactatcccatgcctgaacgcagtagctgtcgtttactgtcgctggacgggccgacgggcgcgctgacgcacggtactttcaccgatttactcgataagctcaaccccggcgatcttctggtttttaataatacccgcgtgatcccggcgcgcctgtttgggcgtaaagccagcggcggcaagattgaagtgctggttgagcggatgctcgacgaaaaacgcattcttgcgcatattcgcgcctcgaaagcgccaaaacctggcgcagaactgctgctgggcgatgacgaaagtattaacgcaacgatgaccgcgcgccacggcgcactgtttgaagtcgaatttaatgatgatcgtttggtactggatatcctcaacagcatcggccatataccgctgccgccgtatatcgaccgtccggacgaagacgctgaccgcgaactttatcaaacagtttatagcgaaaaaccgggcgcggttgcagctccgaccgctggtctgcattttgacgagcctttgctggaaaaattacgcgccaaaggcgtggagatggcgtttgtgacgttgcacgttggtgcgggcaccttccagccggtgcgcgtcgacaccattgaagatcacatcatgcactcggaatacgctgaagtgccgcaggatgtggtagacgcggtactggcggcgaaagcgcgcggtaaccgggtgattgcggttggtaccacctcagtacgttcgctggaaagtgcggctcaggcagcgaaaaacgatctcattgaaccgttctttgacgatacccaaatctttatctatccgggcttccagtacaaagtggtcgatgcgctggtgacgaacttccaccttccggaatcgacgctgattatgctggtttcggcatttgctggttatcaacacaccatgaatgcctataaagcggcggtagaagagaaatatcgcttttttagttacggtgatgcgatgtttatcacgtacaatccgcaggcaattaatgagcgcgttggggagtaattccgcggcgctggtttaaacgttggactgtttttctgacgtagtggagaaaaaatgaaatttgaactggacaccaccgacggtcgcgcacgccgtggccgcctggtctttgatcgtggcgtagtggaaacgccttgttttatgcctgttggcacttacggcaccgtaaaagggatgacgccggaagaagttgaagccactggcgcgcaaattatcctcggcaacaccttccacctgtggctgcgcccgggccaggaaatcatgaaactgcacggcgatctgcacgattttatgcagtggaaaggaccaatccttaccgactccggcggcttccaggtcttcagccttggtgatattcgtaaaatcaccgaacagggcgttcacttccgcaacccgatcaacggcgacccgattttcctcgacccggaaaagtcgatggagattcagtacgatcttggttcggatatcgtcatgatctttgatgagtgtacgccgtatcctgctgactgggattacgcaaaacgctccatggagatgtctctgcgttgggcgaagcgtagccgtgagcgttttgacagtctcggaaacaaaaatgcgctgtttggtatcattcagggcagtgtttacgaagatttacgtgatatttctgttaaaggtctggtagatatcggttttgatggctacgctgtcggcggtctggctgtgggtgagccgaaagcagatatgcaccgcattctggagcatgtatgcccgcaaattccggcagacaaaccgcgttacctgatgggcgttggtaaaccagaagacctggttgagggcgtacgtcgcggtatcgatatgtttgactgcgtaatgccaacccgcaacgcccgaaatggtcatttgttcgtgaccgatggcgtggtgaaaatccgcaatgcgaagtataagagcgatactggcccactcgatcctgagtgtgattgctacacctgtcgcaattattcacgcgcttacttgcatcatctcgaccgttgcaacgaaatattaggcgcgcgactcaacaccattcataaccttcgttactaccagcgtttgatggcgggtttacgcaaggctattgaagagggtaaattagagagcttcgtaactgatttttaccagcgtcaggggcgagaagtaccacctttgaacgttgattaatattaataatgagggaaatttaatgagcttttttatttctgatgcggtagcggcaacgggtgcaccggcgcaaggtagcccgatgtctttgattttgatgctggtggtattcggtctgattttctatttcatgatcctgcgtccacagcagaagcgcaccaaagaacacaaaaagctgatggactccatcgctaaaggtgatgaagtgctgacgaacggtggcctggtcggtcgcgtaaccaaagtagcggaaaacggctacattgctatcgcactgaatgacaccactgaagtagttattaaacgtgacttcgtagctgccgttctgccgaaaggcaccatgaaggcgctgtaattaaaatttttccctaagggaattgccgtgttaaaccgttatcctttgtggaagtacgtcatgctgatcgtggtgattgtcatcggtctgctgtatgcgcttcccaacctgtttggtgaggatccggctgttcagatcactggtgcgcgcggagtcgccgccagtgagcaaacgctgatccaggtccagaaaacgttacaagaagaaaaaataactgctaagtctgtggcactggaagagggcgctattcttgcgcgcttcgactccactgacacccagctgcgcgctcgtgaagcattaatgggcgttatgggtgacaaatacgtcgtggcgcttaaccttgccccggcaacgccgcgctggctggcagctattcatgctgagccgatgaagctcggccttgacctgcgtggcggcgttcacttcctgatggaagtggatatggacaccgcgcttggcaaactccaggaacaaaatatcgatagcctgcgcagcgacctgcgtgaaaagggcatcccgtataccaccgttcgtaaagaaaacaactacggcctgagcatcactttccgcgatgctaaagctcgtgatgaagccattgcgtatctgagcaagcgccatccggatctggtgattagcagccagggcagcaaccagctgcgtgcggtaatgagcgatgctcgtctgagtgaagcgcgtgaatatgcggtgcagcagaacatcaatatcctgcgtaaccgtgtaaaccaacttggcgtggcggagccggtggttcagcgtcagggtgctgaccgtatcgttgttgaactgccaggtattcaggacactgcgcgtgcgaaagagattctgggtgcgacggcaacgctggaattccgtctggtaaacaccaacgttgatcaggccgctgcggcatccggtcgcgtaccgggcgactctgaagtgaaacagacccgcgaaggtcagccggttgtgctgtacaaacgcgtaattctgaccggtgaccatatcaccgactccacttccagccaggacgaatacaaccagccgcaggttaacatctcgctcgatagcgcgggtggtaacatcatgtctaacttcaccaaggacaacatcggcaaaccgatggcaaccctatttgtggagtacaaagacagcggtaagaaagatgcaaacggtcgtgcggttctggtgaaacaggaagaggtgattaatatcgccaacatccagtctcgtctgggtaacagcttccgtattactggcatcaataacccaagcgaagcgcgtcagctttcactgctgctgcgtgccggtgcgttgatcgcgccgattcagattgttgaagaacgtaccattggcccaaccctgggtatgcagaacattgagcaggggctggaggcttgccttgccggtctgctggtttctattctgttcatgatcatcttctataagaagtttggtctgattgcgaccagtgctctgattgccaacttgatcttgattgtcggtattatgtcgctgttgccaggcgcaacgctgagtatgccaggtatcgcgggtatcgtcttaacccttgcggtagcggtcgatgcgaacgtactgatcaacgaacgtattaaagaagagttgagcaacggacgtactgttcaacaggcaattgatgaaggttatcgtggcgcattcagttccatcttcgatgcgaacatcaccacgctgattaaagtcatcatcctgtatgcagtgggtaccggggcaattaaagggttcgcgattactaccggtatcggtgtggcgacgtcgatgtttaccgcgattgtcggtacgcgtgccatcgtaaacctgctatatggcggcaagcgcgtcaagaagctgtcaatctgaggagtgcgatgtggcacaggaatatactgttgaacaactaaaccacggccgtaaagtctatgactttatgcgctgggactactgggctttcggcatctctggtctgctgttaatcgccgctatcgttattatgggcgtgcgcggctttaactgggggctggattttaccggtggtacggttattgaaattacgctcgaaaaaccggctgaaattgacgtaatgcgtgatgcattgcaaaaagccggttttgaagagccgatgctgcaaaactttggtagcagccacgacatcatggtccgtatgccgcctgctgaaggcgaaaccggcggtcaggtgttgggcagccaggttctgaaggtgattaacgaatccaccaatcagaatgcggcagtgaagcgtattgagttcgtcggtccgagcgtgggggcagaccttgcgcaaaccggtgcgatggcgttgatggcggcgctgctgtctatcctcgtgtacgtaggtttccgctttgagtggcgactggcggcaggggttgttattgcgctggcgcacgacgttatcattacgctgggtattttgtcgttattccatatcgagattgacctgaccattgtggcatcattgatgtcggttatcggttactcgcttaacgacagtatcgtggtatcggaccgtattcgtgaaaacttccgcaagatccgtcgcggtacgccttacgaaatctttaacgtgtccttgacccagacgctgcaccgtaccttgatcacatccggtactaccttgatggttatcctgatgctgtacctcttcggtggtccggtactggaaggcttctcgctgaccatgcttatcggtgtttccatcggtactgcatcttccatctatgtggcatctgcgctggctctgaaactgggtatgaagcgcgaacacatgttgcagcagaaagtggaaaaagaaggggcggatcagccgtcaattctgccttaatcaagtttcagctgatgttgaaaatcccggtcagaagatcgggattttttttgatgtaaggtgattgcgaaaatccccgcatcttgggaaactgcgcgtaaccctacatttcatccaggtaactttttcatggctatcatcccaaaaaactatgcgcggttagaaagcgactatcgcgaaaaagcattaaaaatctatccgtgggtctgcggtcgctgttcccgcgagtttgtttattccaacctgcgtgaacttaccgttcaccacattgatcacgaccatactaataacccggaagatggcagtaactgggaattactttgtctctattgccacgatcatgagcattcgaaatacaccgaagcggatcagtatggtacgaccgttatcgcaggggaagatgcgcagaaagatgtcggtgaagcgaagtacaacccattcgctgatttgaaagcgatgatgaacaagaagaagtgataaaaaatgccggatatgaaatccggcattctcacaattagaagttgtaacctactaccagataaccaccccagccggtagagcgaacgttgaagttgccgttgccgaagttcagttctgcatcgtcattccactgaccaccgttatgccagtaacgggcaacgacagagtagtgccagtgatcgtaattcagcgccagaatatggctggacgcaatagagttattggtacgtgttttaataccgttgttcgcataaccgctgtcatcgcccaggtcggaaccccagtcgaagttggtgaagccgatgtagctcaactggccgccccacagatcggtaatcggcacaaagtacttcactttgaaacggtaaccgtcccactcgttttcgttcgctgcgccgtagttctgccactggtatttcgcatagacgttcatggacaggctcatcggcagaccagtatcgatgtcggtacccagacccatgtaccaggtgctctggcggccatctttattacgacccatgtcgtaaatgtagttgttcgcgaagtaccactctttgaacggaccgaagctaaggtcagtattggtcagcttgtcaatggagaaacgcggttcgatttccataaacagcggagaaccgtggttccagataccttttgcatcggagttaccgccgaagaataccggcgcatccgcataaccatagaagtcgaaccagtcttttttagcgaatgcttcgtactcaaggtaggtatcgttgcggagctgcggtccgaaacgggtgtgatagcttccgacaacgttaacgctctggtgccaccagtcggaaagatactgcggtttgtcgttttcagctgcgttgacagtaaaagacgaagagagcgccagtaccgcaccggctgccagtaatgtttttttcatatgtatgccactgtttgaaaatcccttgcgggagtgaaaaaggcgcaaattgcgtttctaaatatttcgtatacagaggagcctattataaaaatcattgctcacaaaaatatgtttcgtttcacagttctatcatttacgtaatcgattgcgttcacgtttacacacattcgggcggggattgtactgactttcacccttgttgcaaacttttactatcaatccaggtgatgtaagcggagtaacaaaatgacggggaagatgttgcgggacgcacaatatcgccccgcaatacgtttactgcataacaggttgaatgtcgtggatacgtacaaagcctaactgatccacagacataccctttaactgtaacggaatatcaacatcgctgggggcgaggacgctggcaggtgcgttaatcaattgattctgcacattgatttcctgaaagttgtctattgttccctgaatttgcccatattcaacggttccgctgaatgcgggtaaagggtcattagattcgccctgaatacgtagcgtcagggtggtgccatctgtatcaggcgtaatattcaccagcgacatacgtaaagtaccgatctggctttccagtcttgctggtgtttttgctccaggcagaaggtaaaccccactgctggattttgcattcagcctgttttgctgagtgattttgaccgtttctttattgagctgcgtcatctcctggttcagcgtgctgacgctgtgtttcatctgtcgcacttcactttgctgcacacaggcgctaaggctgaacaggcttcccagcaggagcagtcgaaaaacgttagtattcataggtcgtccctttctcgtcgcaattagcctaatggtagagggtaaaagcagtgaaagcatcgatcctttatctcaaaagcgttgcgcctttgttgtatcgtcagttcagggtaaaatagatttctgttaaccacctggtcaggacgccgtatgcattgcccattctgtttcgccgtggacactaaggtaattgactctcgtctcgtgggcgagggttcatccgtacgccgccgtcggcagtgtctggtgtgtaatgaacgtttcaccacctttgaagtggcggagctggttatgccgcgtgttgtaaaaagcaacgacgtgcgtgaaccgtttaatgaagagaaattacgtagcggaatgctgcgggcgctggaaaaacgtccggtgagttccgatgacgtcgaaatggcaatcaatcatataaaatcgcagctgcgcgccaccggtgagcgcgaagtgccgagcaagatgattggcaatctggtgatggagcaattgaaaaagctcgataaagtcgcctatatccgttttgcctctgtctaccgcagtttcgaagatatcaaagaatttggcgaagagatcgcgcgcctggaggactaagccgtgcaggacgagtattacatggcgcgggcgctaaagctggcgcaacgaggacgttttaccacgcatcccaacccgaatgtcgggtgcgtcattgtcaaagatggcgaaattgtcggtgaaggttaccatcaacgcgcgggtgaaccgcatgccgaggtacaggcgttgcgcatggccggcgaaaaagccaaaggcgcaacggcgtatgtcacactcgaaccctgtagccatcatggtcgtacgccaccgtgttgtgatgcattaattgctgcgggcgtggcgcgcgtggttgctgcaatgcaagaccccaatccgcaggtcgctggacgtggactttaccgtttgcaacaggctggcattgacgtcagccacgggctgatgatgagtgaagctgagcaattgaataaaggctttctcaagcggatgcgcaccggctttccttatattcagttaaaacttggcgcatcgcttgatggtcgcacggcgatggcgagtggcgaaagccagtggatcacttcacctcaggcgcgacgcgacgtacaacgactgcgcgcgcaaagtcatgccattttaaccagcagcgccacggtgctggcggatgatccagccttaacagtgcgttggtctgaactggatgaacaaactcaggggctctacccgcaacaaaatctccgtcagccagtacgtattgtgattgatagccaaaatcgcgtgacgccggaacatcgcattgtgcagcagcccggcgaaacctggttcgcgcgtacgcaggaagattctcgtgagtggccggaaacggtgcgtaccttgctgattccagagcataaaggtcacctggatctggttgtactaatgatgcaactgggtaaacagcagattaacagcatctgggtggaagcggggccaacgctcgctggcgcattgctacaggcgggtttagtcgatgagctgattgtctatatcgcacctaaactattaggcaacgacgcccgtggattatgcacgctgccagggcttgagaaattagccgacgctccccaatttaaattcaaagagatacgtcatgtaggcccggatgtttgcctgcatttagtgggtgcatgatctcccggctcgaaagggaagcagcgcacgaaatattatgctaaaatccgcccccctgcggggccatactcgaacccgaaggaagaaaatgaacattattgaagctaacgttgctaccccggacgctcgcgtcgccatcaccatcgcgcgtttcaacaactttatcaatgacagcctgctggaaggtgcaattgacgcactgaaacgtatcggtcaggtaaaagatgaaaacattaccattgtttgggtgccaggtgcctatgagctgccgctggcggcgggtgcactggctaaaaccggtaaatacgacgcggtgattgcgctgggtacggttattcgtggtggcactgcccactttgaatatgtcgctggtggtgcaagcaacggcctggcgcatgttgcccaggacagcgaaattccggttgcttttggtgttctgaccactgaaagcattgaacaagcgatcgaacgtgctggcaccaaagctggcaacaaaggtgcagaagctgcactgaccgcgcttgaaatgattaatgtattgaaagccatcaaggcctgaaattagtaaggggaaatccgtgaaacctgctgctcgtcgccgcgctcgtgagtgtgccgtccaggcgctctactcctggcagttgtcccagaacgacatcgctgatgttgaataccagttcctggctgaacaggatgtaaaagacgttgacgtcctgtacttccgtgagctgctggccggggtggcgactaacaccgcatacctcgacggactgatgaagccgtacctgtcccgtctgctggaagaactgggccaggtagaaaaagcagtactgcgcattgcgctgtacgagctgtctaaacgtagcgatgtgccatacaaagtggccattaacgaagcgatcgaactggcgaaatcgttcggcgcagaagacagccataagttcgtcaacggcgtactcgataaagcagcacctgtgattcgccctaacaaaaagtaatatccaggccggtagattcacggaagaccgttccgcgatcgccggccttttcttttttacctgctgaggcgtaacgtatggcatgtggcgagttctccctgattgcccgttattttgaccgtgtaagaagttctcgtcttgatgtcgaactgggcatcggcgacgattgcgctcttctcaatatccccgagaaacagaccctggcgatcagcactgatacgctggtggcgggcaaccacttcctccctgatatcgatcctgctgatctggcttataaagcactggcggtgaacctaagcgatctggcagcgatgggggccgatccggcctggctgacgctggcattaaccttaccggacgtagacgaagcgtggcttgagtccttcagcgacagcttgtttgatcttctcaattattacgatatgcaactcattggcggcgataccacgcgtgggccattatcaatgacgttgggtatccacggctttgttccgatgggacgagccttaacgcgctctggggcgaaaccgggtgactggatctatgtgaccggtacaccgggcgatagcgctgccgggctggcgattttgcaaaaccgtttgcaggttgccgatgctaaagatgcggactacttgatcaaacgtcatctccgtccgtcgccgcgtattttacaggggcaggcactgcgcgatctggcaaattcagctatcgatctctctgacggtctgatttccgatctcgggcatatcgtgaaagccagcgactgcggcgcacgtattgacctggcattgctgccgttttctgatgcgctttctcgccatgttgaaccggaacaggcgctgcgctgggcgctctctggcggtgaagattacgagttgtgtttcacggtgccggaactgaaccgtggcgcgctggatgtggctctcggacacctgggcgtaccgtttacctgtatcgggcaaatgaccgccgatatcgaagggctttgttttattcgtgacggcgaacctgtcacgttagactggaaaggatatgaccattttgccacgccataaagatgtcgcgaaaagtcgcctgaaaatgagtaatccgtggcatctgcttgctgtcggattcggaagtggattaagcccgatcgttcctggcacgatggggtcgctggcggcgattcccttctggtatctgatgacttttttgccctggcagctctattcgctggtggtaatgctggggatctgtatcggcgtctatctttgtcatcaaacggcgaaagacatgggcgtgcacgatcacggcagtattgtctgggacgaatttattggtatgtggattacgctcatggcgctgccgaccaatgactggcagtgggttaccgccggatttgtgattttccgtattctggatatgtggaagccgtggccgatccgctggtttgatcgcaatgtacatggcggcatggggatcatgattgacgatattgtcgccggggtgatctccgctggcatcctgtattttatcggtcatcactggccgctgggtattctgtcgtagttgtgcaccgatgcctgatgtgacgcttgtcacgtctcatcaggcctgcatacctatttaaatcctacgaccggatgcggtttatacggcgtttccagctcggcgatctgttccggcttcaaggtgatatccaccgcgtttagcagttcatcaagctgttcctcccgagaagttccgataatcggtgcggcaatgcccggtttactcaacaaccaggccagcgcaacttgtgctcgcgttgcaccaagttcttcactgacgcccgttaagcgttctacaatttgtgcgtcattttcattgctttcttggtagagatttttccccacttcatccgacaccagccgtgcggtggtttctccccaaggacgcgtcagacggccccgcgccagcgggctccatggaatcaccgctacgccttcctgataacacagcggcagcatctcgcgctcttcttcacgataaatcagattgtagtgatcctgcatactgacaaactgcgcccagccgtgctgtttttgtagttccagtgcttgagcaaactgcgaagcgtgcatggatgacgcgccgatataacgcgctttcccggcttttaccacgtcgttcagggcttccagcgtctcttcgatcggcgtgttgtaatcccagcgatgaatttgcaggatatcgacataatccatgccgagacggcgcaggctgtcgtcgatagagcgcaaaatttgtgcacgggataatccttccggtaaatcaccaacgcgatggaacactttggtcgcaacgaccacgtcttcacgacgggcgaaatcccgcagtgcgcgaccgacgatctcttcgctgctgccatcggaatagctattggcggtgtcaaagaaatttatgccgccttccagcgcacgtttaatgatgggacggctgctctcttccggcagtgtccatgcgtgattaccgcgatctggctcgccaaaggtcatacagccgaggcaaagtcgggaaacacgaaggtcggtttttcctaaggggttgtattgcatgctgccactcctgccatgaataatttcttaagcatagcaggagtagagtagggattatgccagccaggccttgattttggcttccataccggcggcatcgaggccgagttcggcgcgcatttcttcctgagttccttgtggaataaagaagtcaggcaggccaatgttcagcacgggtactggtttacgatgggccatcagcacttcgttcacgccgctacctgcgccgcccataatggcgttttcttctacggtgaccagcgcttcatggctggcggccatttccagaattaacgcttcatcaagcggtttcacgaaacgcatatcgaccagcgtagcgttcagcgattcagcgactttcgccgcttctggcatcagcgtaccaaagttaaggatcgccagtttctcaccacgacgcttcacaatgcctttgccaattggcagtttttccagtggcgtcagttccacgccaactgcgttgccgcgcgggtagcgcaccgcggacgggccatcgttatagtgatagccggtatagagcatctggcgacattcgttttcatcgctcggggtcataatgaccatttccggtatgcagcgcaggtaagagagatcaaaagcgccctggtgggtttgaccgtcagcaccaacaatgcccgcacggtcgatggcgaacaggaccggaagcttttgaatcgccacgtcatgcagcacctgatcataggcgcgttgcaggaaggtggagtagatcgcaacaatgggtttgtagcctccaatcgccagacccgcagcaaaggtcactgcgtgttgctcggcaattgccacgtcgaagtagcgatccgggaatttacgtgaaaactcgaccatgccggaaccttcacgcatcgccggagtaatcgccatcagcttgttatctttcgctgcggtttcgcacaaccagtcgccaaagatttttgaatagcttggtaaaccgccgctacttttcggcagacaaccgctggagggatcaaatttaggcacggcgtggaaggtgattgggtctttttctgccggttcataaccacgaccttttttggtcatgatatgcaggaactgcgggcctttcaggtcgcgcatgttcttaagcgtggtgataagccccagcacatcgtgaccgtccaccgggccgatgtagttaaagcccagctcttcaaacaacgtgccaggcactaccatgcctttaatatgttcttcggtacgtttgagcagctctttaatgggtggcacgccagagaaaactttttttccgccttcgcgcagtgaagagtaaagcttaccggaaagcagctgcgccagatggttgttgagcgcgccaacattttcggaaatcgacatttcattgtcgttgagaaccaccagcatatcaggacggatatcgcccgcgtgattcatcgcttcaaacgccatgccagcagtaatcgcgccatcgccaatgacacagacggtgcggcgatttttgccttctttctcggcagcaactgcgatcccaattccggcactgatggaggttgatgaatgcccgacgcttaatacgtcatattcgctttcgccgcgccacgggaacgggtgcaggccacctttctgacggatggtgccgattttgtcgcggcgcccggtcaaaattttatgcggataagcctgatgccccacatcccagattaactggtcaaacggggtattgtagacatagtgcagcgccacggtcagttcgaccgtgcccagcccggaggcgaagtgcccgctggaacggctcacgctgtcgagtaaatagcggcgcagttcgtcgcagagtttcggtaaactctctttcggcaacagtcgtaactcctgggtggagtcgaccagtgccagggtcgggtatttggcaatatcaaaactcatcaggggcctattaatacttattgtttatttattacgctggatgatgtagtccgctagcgcttccagtgccgaggtatcgagtgactgttcagccagttgtttcagcgactgacgggcatcgtcgatcagatcccgggctttcttccgggcttgctcaagacccagaagtgcagggtaggtacttttaccaagttgctgatcggcaccctggcgttttcccaacgttgcagtatctcctaccacatccaggatgtcatcctgaacctggaaggcaaggccgatgctctctgcgtacttgtcgagtactggcagagcacgacgccctttatctccggcgcttaatgcaccaaggcgaacggcggcgcgaatcaatgcgccagttttatgacgatgtatacgctcaagcgcgtccagaggtacgcgtttgccttccgcgtctaaatctaatgcctgaccaccgcacattccggcaataccgctggcgctcgccagttcagaaatcatcgaaattctgtcgcgatccgacacttccggcatatctgcatcgcttaaaatcgagaacgccagcgtttgtaaagcatcgccagcgagaatcgcgtttgcttcgccaaacttcacatggcaggtcggcaaaccgcgacgcagatcgtcatcatccatcgccggtaaatcatcatgaattaatgagtaagcgtggatacactctacggcggcagcgggtgcgtccagtgtgtttgtgctaacgccgaacatatgaccagtggcataaaccaggaaaggtcgcaggcgcttaccacctaataatgcgccatactgcatggtttcgaccacgggagtgttctgaaagggcagtggggcgataaaacggctcagcgcctggttggcctgcttaacgcaggcttcgagttgctgcggaaagtccattactcattgtccggtgtaaaaggggttagagaggcgtcttcattgtcagacagcagaatttgtacgcgctgttcggcttgttgtaatttggcctgcccctgacgtgccagctgcacgccgcgttcgaactcgttcagcgcctcttccagcggcaggtcgccactttccagacgggttacaatctgttccagctcgctcagcgccttttcaaagctggcgggagcctcatttttcttcggcataatgaatgtctgactctcaatatttttcgccccgtcatggtaacggactcagggcaaatagcaaataacgcgcaatggtaaggtgatgtgcgcagcaaagcgatgttagtggtatacttccgcgcctggatgcagccgcaggtgtgggctgctgtatttttccctatacaagtcgcttaaggcttgccaacgaaccattgccgccatgaagtttatcattaaattgttcccggaaatcaccatcaaaagccaatctgtgcgcttgcgctttataaaaatccttaccgggaacattcgtaacgttttaaagcactatgatgagacgctcgctgtcgtccgtcactgggataacatcgaagttcgcgcaaaagatgaaaaccagcgtctggctattcgcgacgccctgacccgtattccgggtatccaccatattctcgaagtcgaagacgtgccgtttaccgacatgcacgatattttcgagaaagcgttggttcaatatcgcgatcagctggaaggcaaaaccttctgcgtacgcgtgaagcgccgcggcaaacatgattttagctcgattgatgtggaacgttacgtcggcggcggtttaaatcagcatattgaatccgcgcgcgtgaagctgaccaatccggaagtgactgtccatctggaagtggaagacgatcgtctgctgctgattaaaggccgctacgaaggtattggcggtttcccgatcggcacccaggaagatgtgttgtcgctcatttccggtggtttcgactccggtgtttccagttatatgttgatgcgtcgcggctgccgcgtgcattactgcttctttaacctcggcggcgcggcgcatgaaattggcgtacgtcaggtggcgcattatctgtggaaccgctttggcagctcccaccgcgtgcgttttgtcgctattaattttgaaccggtcgtcggggaaattctcgagaaaatcgacgacggtcagatgggcgttatcctcaagcgtatgatggtgcgtgccgcgtccaaagtggcagaacgttacggcgtacaggcgctggttaccggtgaagcgctcggccaggtgtccagccagacgctgaccaacctacgcctgattgataacgtctccgatacgctgatcctgcgtccgctgatctcttacgacaaagagcacatcatcaacctggctcgccagattggcaccgaagactttgcccgcacgatgccggaatattgcggcgtgatttccaaaagcccgacggtgaaagcggttaaatcgaagattgaagcggaagaagagaagttcgacttcagcattctcgataaagtggtggaggaagcgaataacgttgatatccgcgaaatcgcccagcagaccgagcaggaagtggtggaagtggaaaccgtcaatggcttcggcccgaacgacgtgatcctcgatatccgttctatcgatgaacaggaagataagccactgaaagtcgaagggattgatgtggtttctctgccgttctataaactgagcaccaaatttggcgatctcgaccagagcaaaacctggctgttgtggtgtgagcgcggggtgatgagccgcctgcaggcgctctatctgcgcgagcagggctttaacaatgtgaaggtgtatcgcccgtaatatgtggttgtaacgtcgcatctggtcagatgcgacgtttaccgcatccgacactactcgtaataattataaatccctgccgccatcaccagttgtgatgccacttcatgggctttctcgcgcccaaccagcaggtcgataattttcagaccaaagtcgatagctgtacctggcccctggctggtcagcaattttacccgtgcatcccagacgacgcgcttgtcctgccattgttcggcgggtattttgtctttcagcgtcgggaagccggtcatattgccaatcgggaagatatcgtgcgggaccagcacggtggctggcgcggcgcaaatagccgcgacgatacgcccggaacggtggaactgtttaacggtttcaaccagcagggtgctatcgcgaaaacactctgcgcctttgatgccaccaggcagcacaatcacgtcatattcgccatcagccacttcaaccagcggcgcatccgccagcagcttcacgccgcgcgagcaggtaatcgccaggttaccatcgctggcgacgctggcagtggtgactttgataccgccgcgaaccaagaggtcgatagtggtgacggcttcagtctcttcactaccaggggcgaggcaaaccagtgccgatgcgctcatattcactctcctttctttttaccatttcaaacaggcgggtgttttccggtacggcaatcccatgcgcgcgggcgcggcgtaagagaaaaccattgatatagtcgatttcggtgtggcgcagcgcgcggatatcctgcaacatcgacgagatattttccgctgtggcatcaatcacctgcatcacgtaatcacgcaaatcttctgctgaagtatgatgcccttcgcgttcgatcactgccgcgacttcttcgcatatctgcataatttcttgcggatgatgacgtaattcaccattcgggcaattccaggtggcggtcagtggattaatcacacagttgactgccagcttgcgccacagctcggcgcgaatattgttatgccacgcgacgtcaggcaatacggtttgcaaaatatccgccagataactgtaatcgccgtcctgttgccgtgccggaccaatatgcgtgataccgtttgccacatgaataatgacattgccgtcgcggcgagcggcatgggtggtggtgcccatcagtaatggctgctgaatgttttgcaactcttcgatggtgcccatgccgttgtgaattaacagtattggcgtggttacaggcagtgtggacgcgaggcttttgacggcatcggaaacctgccatgctttcagcgtcaccaggagcagatcgctggtggcgagaaaatcgggatcgttggcggtcagagactcgttaaatatcgaaccatctgtctcaaccagattcacgctacaataaggttgcggtacgcgcagccagccctgaacttcgtgaccctgtttacaaagtgctgtaagccataattgccctaaggcaccgcatcccaatacggtaattttcattgttcctcctcacccgcaaccactccgggtgttcaataaggctatcccttaattgtgcatgctgttgcgactatgcacaattaagggatacgtcctggtgcgggactgtcggttatttaactttgcgggtattatgcttcgcatcaaaaatgaagggagaggaaaagatgccatctttcgatattgtctctgaagttgatcttcaggaagcacgtaacgcggtcgataacgcgagccgcgaagtggagtcccgttttgacttccgtaatgttgaagcttcatttgagctgaatgacgccagcaaaaccatcaaagtgttgagcgagtccgacttccaggtcaatcagttgctggatattctgcgtgccaagctgctgaagcgcggcattgaaggcagttcactggatgtaccggaaaatatcgttcatagcggtaaaacctggtttgtggaagcgaaactgaaacagggcattgagagcgcgactcagaagaaaatcgtcaaaatgatcaaagacagcaaactgaaagtgcaggcgcaaattcagggcgatgagatccgcgtaacgggtaaatctcgtgatgatttacaggctgtcatggcgatggtacgtggtggcgatctcggtcagccgttccagttcaaaaacttccgcgattaatcgcgacaacctgcgctttgttcatgtcagatgcggcatgaacgcctgattcggcctacaaaggtttgtaactcaggaacttagtaggcctgataagcgtagcgcagcaggcaatttcgcctcgcttttatgcctggcgaattgcctgttcaacctcaaagcgattcgtcactttgctgtcgattttcacataagctgaatgttcttcttctgcaatcaacacttctttgatgccttcagtttccagcaaacgcacttttaacgcctcgtttgcggcaatgttcgccgggatttcaatgcgcaagctgctgacatacggcggttctttcatggtactggcgactgccagccacactgcggccagcattgcgccagcgagaaatacgccctgaccgtcaaacatgccgtcaatccagccgcccagcgaaccgccaatcgccacgccaagaaactggctggtggagtaaacacccatcgccgtacctttgtaacctgctggcgattctttactgataagtgaaggcagaagggcttccatcaaattaaacgccacaaagaaaagctgcacgccgaccaccagttgccagaactgcgtttgtgcgttccacaacacaatttccgcgaccacgatcaacccgacgcaaaagacaaagacttgcttcattttgcgcttaacttcagcgtagataatgaaaggcacgaccgagccaaaggcgattaacatcgttgccaggtagaccttccagtgttcagccgccgggaaccccgcatcagccagctgtccgggcagggcaacaaaggtcgacatcagcaaaatatgcagacacataatgccaaagttgagtttcagcagccgcggttccgccagcactttactgaaactgcctttcaccattccggactcacgattaagtacgtgagtgctactgttgggcacaacccaaatggtcaacgcaatgccggttgttgccagaatagcgatcatccagaacagcacgtgcagcccaagtttgtgagtgatgatcgggccaagcaccatcgcaatggcaaaggtaatgccaaagctcacgccgataaacgccatcgctttggtgcggttttgttcgcgcgtgagatcggaaagcagcgccataacggcagcggcaatcgcaccggagccttgtagcgcccggcccagaataattccccagatggagtcagagagcgcagcgataacgctaccggcggcaaacaccgccagcccaccgacaattaatggtttgcgaccaatgcggtctgaaagcaggccaaacggaatctgaaaaacggcctgagtcagaccataaataccaatggcaataccgattaatgcttcgctggcaccttgcagagccatgccgtacgtggtcagaaccggcagaaccatgaacatgcccagcatgcgtaatgaaaatacggtccctaaaccccaggtcgcgcgccgctcacctggcgtcattttataatcgttcattaccacctctgttttaaattcgcgactagtgtaaagcggcaaacgaatggggtaaacatgcggattttttagtaaatatttcgagagggatatgattctaatgctaagaaaaaaggtgccgtagcacctttttaactgagaggttgtgttaccacacagcagccagcagcgtatgcgagtccggcaccataaaatcaacggacatcatcaccgagagggcagtgatggcgatgatagagaaaccgaacagcttgcgcgcccagattctgtcatcagcaactttatagccgcgcagagccatgcctaaccaccagacgctcaccgcagcggcgaccaccagatatttatacccagcgtagccgccaagagagagcatcagcgtggcaacggcaaaggcgatgatatacagcgtgatgtgattcttcgccaccgaaatgcctttcaccaccggcagtaccggaatgtttgccgcctgataatccttaaagcggaaaatggctatggcataagagtgaggcatctgccacaggctgaagatagccagcaggatcgctgcgccgctatcgaactcgccggttaccgcacagtaaccgatcaccggaggcgcagcgccggagagcgaaccaatcaatgtgccgtagacagaatgacgtttcatgtacaggctataaacgccgacataaaccacaaagcccatcacccccagccagcaggccagcggattcgcgccaaaccacagcagcataaagccagcaatacccagcaaggtggcgtacaccagcgagacagcaggagagatcaggcctttcaccagcacccgattcttcgtcctttccatctttcggtcgatatccctgtcgatgtagttgttaaacacacaacccgacgccacaaccagtgacaccccaaccagcgtgtagataaacaggggataatcaatgctgccctttgaggccagcaagaatcccccaatcaccgagatcaggttgccaaagatgatgcctggtttcgttacttgcaggtattgcttaaatatcataaccgccgctcttagtgcatcatcatgttgtagttgaggttccacataatccaaatggagcccacaaccaggatggcgatgattagcacggtgaagacaaatgccgtcatattccagccttcatctgatttggtattcatgtgcaggaagcacaccagatgcaccagaatctgtaccactgccattgccaggattgttcccagaattacggccggagaggcagcccctgtcatcaccatccagaacggaattaccgtcaggattatcgacaggataaagcctgtcatgtaggtctttacgctgccatgggatgcgccgctgcttgcgttagaatgactcattacatcgcccccatcagataaacaacagtgaacacacagatccaaaccacatccaggaagtgccagaacaggctcaggcacatgatgcgggtacggttagtgctggtcaggccgcgacgggcgatttgcaccatcagcaccgccatccagataagaccggaagtgacgtgcagaccgtgcgtgccgaccagcgcaaagaatgctgacaggaagccgctgcgatccggacccatgccgttaacaatcaggtgatggaattcatagatttccatcccgataaatccggcaccaaacaaccatgtcaacgccagccaggagacaacctggcttttgttgtttttgtacatggcgatagccgccatgccgtaggtgatggagctgaacaacagcaagaaagtttcaaccagaacgaacggcagttcgaaaatgtccttacctgtcggcccacctgcggtgccgttcaccagaacggcataggtagcaaacaagatagagaacagaatgcagtcgctcatcaggtagatccaaaatccgaagattttggttccgcctgcatcgtggtgcccgtgttcgtgcgcgtgggcagtcgcgtgcgtcaaagtatcagttgccatttttcagccctgccttagtaatctcatcgaaatgctggttttccagtttttcgatttctgccaccggcacgtagtaatccacgtcctcgtcgaagcttttcacgatccaggtgatgatcatgcctgcgaagccaacaatcgccagccaccagatatgccagatcatggcgaaaccgaagatggtggagaaagccgcaatgacgataccggcaccgctgttttttggcatatgaatttcttcatagtggtcaggctttttgtacgcttcgcctttctctttcatttcccagaatgcatcacgttcgtgaacgtgcggcacaacggcaaagttatagaacggaggcggggaagaggttgcccactccagcgtacggccaccccacgggtcgccagtcaggtcacggttctggtcgcggtcacgaatagaaacgtacatctgaataacgaggcagagaatacccagcgcaatcagtaccgcaccgctggctgcaatcatcagcatggtgtggaactgcgggtcaatctgctggctcaaacgacgggtcatgcccatgaagcccagcgcatacagtggcataaaggcaacgaagaagccgatgatccagaaccagaacgcgcgtttaccccaggtttcgttcagtttgaaaccgaacgctttaggccaccagtaggtcatccctgcgaagcagccgaagaccacgccgccgatgatcacgttatggaagtgcgcaatcaggaacaggctgttatgcagaacgaagtccgcgcccggtactgccagcagcacgccagtcatcccgcccaccgagaaggtgacgataaaaccgatggtccacagcatcgcagaatggaacacgatgcggccctgatacatggtgaacagccagttgaagatcttcaccccggtcgggatggcgataatcatcgtggtgataccaaagaaggcgtttacgttcgcgcccgcacccatcgtaaagaagtggtgcagccagacgatgaacgacagcacggtgatacagacggttgcccataccagcgaggtataaccaaacagacgtttacgcgagaaggttgccgcaatttcggagaacacaccgaatacaggcaggatcaagatgtaaacttccgggtggccccaggcccaaatcaggttgatatacatcatcatgttgccacccatatcgttggtaaagaaatgggtgcccagatagcgatccagggtcaacaacgcgacggtaaccgtcagaattgggaaggaagcaataatcagtacgttcgcgcacagtgatgcccaggtaaatactggcatcttgaacatggtcatgcccggtgcgcgcatctttagaatggtaacgaagaagttgataccggtaagcgtcgtacctataccggatagctggagactccatatccagtaatcgacaccgactcccggactgtactctattcccgatagcggtggataggccagccagccggtctgcgcaaattcgcccacgccgagagaaacgttaaccagaatcacaccaacaacggtaaaccagaagcttaagttgttgaggaacgggaacgcaacgtcacgcgcgccgatctgcagcggaaccaccaggttcatcagaccgataacgaaaggcatcgccacgaagaagatcataatcacgccgtgcgcggtgaagatctgatcgtagtggtgaggtggcaggaagcccgcttcgcccgccgaggcaagggcctgctggctacgcatcataatggcgtcagcaaaaccacgcagcaacatcacaatcgccacgatgatatacatgataccgaggcgtttatggtcgacggaggtcagccactctttccacaggtaggtccacttaccgaagtaagtgatcaggccaacgagcgccagacctcccaaaataatgccagcgatcgtaaccatgacgataggttcatggaacgggactgcatcaagtgataattttccgaacatctttattcttcctcaacccctttaatgggcggattccgcgtggctcatgtccatgccttccataccttcatgtgcgctgtgctcaccttctggctgggtcatgtccatgctcttaccgtgagccataaacttgttaatcacatcggcaaacaagtctggtttcacgttggagaaatattccacctggttgtattcgctaggcgcggccagtttttcgaacgtagccatgtcagacatggtgttcggcgactgtttcgcttttgcgacccattggtcgaatgcggcgcgatccggtgttgcaatagctttgaacttcatgcctgagaagcccgggccgctgtagctggcggagataccgtcataagtaccgggttcgttggcgatcagatgcaggcgagtctgcataccggccatggcataaatctggctacccagacgcggaatgaagaaggagttcatcacggagttggaggtcactttgaagtacaccggagtgttcgccgggaaagcgatttcattcacggctgcaatgccctgttccgggtagatgaagaaccatttccagtccatggaaaccacttcgatggtaatgggcttctcgtcgtgtgccagcggcttgctaggctcaagagcgtgagtggttttccaggtcagtaccgcaaggaagatgatgattaagataggtaccgtccagaccacagcttccactttattggagtgtgaccagttcgggctgtacttagcatctttattgctcgcacggtacttccaggcgaaaccaacagccatcaagattgcgggaataacgacaatcaacatcaggccaaatgccgtcagtatcagtgaacgttgctccagaccaatctgtcctttgggatctaacagcgcagaattacagccactgagcaatacagtgcctgcaaataatgacaaccatcccaaacttttattgtatttcctgagtctcatttaacgacctcaattccacgggatctggtggcgtttaaagtgtgtgggcattttacgggaaggttacattactgtaaacatgattaaattcctgttacttggatttggctatcaggtcacatatgttgcaaaacatatcaagttgattttaagaagctgttgcaaaagggcgttataacgaaaggggagtgcagaaggagtttgggtgggcaattggtataatcaatataaaataaaacaattatttaacaaataattatcattgaggtgacaactgggtggtgagaaaataaggactcattagctgaatcgtgtaagaaaaatagaattcataaattgcgtcaataatttccaaacgctaagccgcacaaaagaacaaatattaataagcgatgctgatgtttatttagccgtaataattacggcgagtgattactacagctaaataatattacagattacgtcagatgtgtttttcgtagcgccagataatccagcaaaccaccaagcacaacgccagaaagggcgactaaaaccccgacttccagcagcgcaggcaggaaagagaagtgcgtcaaatccagcgcgtccattgtcaacagcagtaaccacacggccaacaggctgatacccgccgccagtgtccacatggcaaaggcataacctgcaggatattcggtacgggagataaagttgccatttactcgtgtatattcaagcgtctggcggcaaaccagcagcaaaataagccctggtacggcagcggcgacggagaatagatagaatgtcgaccagccatgtgcttcaacaaaccaacccgccacggggccgacataaactcgccctacagcagaaagcgctgagagcagggcaaattgagtagcggaaaatgacttattacacagcgtcattaacagcgcgacaaaggctgatgtacccatcccgccacagaggttttcgaaaaagacggctgcacccatgctgtagagatgcttatcagtaatcgacagcagccagtaaccggcgttagatgcacnnnnncattccattcattaattaattaatgaatgaatgnnnnngttttccacgcatcgaagacaatatcctgggaggcagagcaaaaagcgatcaccaccgccagtgccgccatccagcggagctgggtgcctggttcgagaaaacccatcgccgcaatggcgactaataacagaatttgcgtggcgagcagccaaccgcgccgccgcccgaaaaatgggggcgtgtagcggtccatcagtggtgaccagaggaatttaaaaacgtaagcctggcctaccagagagaagaaaccaatggttttgagatcgatattctcgaccgtcatccaggcctgtaaggtgccggacgtcagggcgagcggtagcccggaagcaaaacccaggatcagcaatatggctgaacgcggctgttgaaaaatacgtaaatattgactggacatgggcgtctacaggcccggcttgcaccgggccagagggcagaaattaacgcgcgttctgcttgatgaattcgtggatgctggtgtcctgagacatatcagcgatggtatcggtcagcacactgttaaccgcatcggcgatatttttgttggaggcctggaacgcaccttcaacgttgtagctggcacgatagtttttggtcattttgttgccattctgcgcggtagcgatgatggcgatatccgctttggtcgcgatgttgtagcgcacattgccctgggacacgtcagcatacagttggctaacgatgatttgcagattaactgggccattcggaccaaccatgtatccacgggcggtcatctgtttttccagcacttcttgcagcaggaaacgcagatcgcgggaggcggtcagggtaacgatttgattatcgcgggtgacttttgccagcgcctgatcggtacgctgatcggcaccattaatgcttacggtgacgcccatcaggcttggatcctgctgtggcagtgtaatcgtcggggaaacttcaatagttgttggcggttttgcgcatcctgcaagcataaacagagcaactaacgggaagaggatttttttgaacatgttcgggctctcagagactcttaagcgtgtttggtaaaaattcccgccatcataacattgcctacggcgaggggaagtgggtaaggcatgtaaattcatcatgttgacgaaataatcgcccctggtaaaagaaacgctgatgcgaggcctgtgtttcaatctttaaatcagtaaacttcatacgcttgacggaaaaaccaggacgaaacctaaatatttgttgttaagctgcaatggaaacggtaaaagcggctagtatttaaagggatggatgacatctcagcgttgtcggaggagatatttcatgatgatacgtgagcggatagaagaaaaattaagggcggcgttccaacccgtattcctcgaagtagtggatgaaagctatcgtcacaatgtcccagccggctctgaaagccattttaaagttgtgctggtcagcgatcgttttacgggtgaacgttttctgaatcgtcatcgaatgatttacagtactttagcggaggaactctctactaccgttcatgcgctggctctgcatacttacactattaaggagtgggaagggttgcaggacaccgtctttgcctctcctccctgtcgtggagcaggaagcatcgcgtaaaaacgcatttgcaactgtcggcgcttttccagtatgttgctaaagattttatgaaaaacggcctgcgggccgttttgttttgtctggattttgcgctttttgcccagcattcagacgaaaatcgcccgggaattgtgaaaaaatacgcgacagcgcgcaataaccgttctcgactcataaaagtgatgccgctataatgccgcgtcctatttgaatgctttcgggatgattctggtaacagggaatgtgattgattataagaacatcccggttccgcgaagccaacaacctgtgcttgcggggtaagagttgaccgagcactgtgattttttgaggtaacaagatgcaagtttcagttgaaaccactcaaggccttggccgccgtgtaacgattactatcgctgctgacagcatcgagaccgctgttaaaagcgagctggtcaacgttgcgaaaaaagtacgtattgacggcttccgcaaaggcaaagtgccaatgaatatcgnnnnncattccattcattaattaattaatgaatgaatgnnnnnccggctggcgcaccgacctatgttccgggcgaatacaagctgggtgaagacttcacctactctgtagagtttgaagtttatccggaagttgaactgcagggtctggaagcgatcgaagttgaaaaaccgatcgttgaagtgaccgatgctgacgttgacggcatgctggatactctgcgtaaacagcaggcaacctggaaagaaaaagacggcgctgttgaagcagaagaccgtgtgaccatcgacttcaccggttctgttgacggcgaagagttcgaaggcggtaaagcgtctgatttcgtactggcgatgggtcagggtcgcatgatcccgggctttgaagacggtatcaaaggccacaaagctggcgaagagttcaccatcgacgtgaccttcccggaagagtaccacgcagaaaacctgaagggtaaagcagcgaaattcgctatcaacctgaagaaagttgaagagcgtgaactgccggaactgactgcagaattcatcaaacgtttcggcgttgaagatggttccgtagaaggtctgcgcgctgaagtgcgtaaaaacatggagcgcgagctgaagagcgccatccgtaaccgcgttaagtctcaggcgattgaaggtctggtaaaagctaacgacatcgacgtaccggctgcgctgatcgacagcgaaatcgacgttctgcgtcgccaggctgcacagcgtttcggtggcaacgaaaaacaagctctggaactgccgcgcgaactgttcgaagaacaggctaaacgccgcgtagttgttggcctgctgctgggcgaagttatccgcaccaacgagctgaaagctgacgaagagcgcgtgaaaggcctgatcgaagagatggcttctgcgtacgaagatccgaaagaagttatcgagttctacagcaaaaacaaagaactgatggacaacatgcgcaatgttgctctggaagaacaggctgttgaagctgtactggcgaaagcgaaagtgactgaaaaagaaaccactttcaacgagctgatgaactagcaggcgtaatttacgtagcataacgcgctaaattcgcacaaaggcccgtcaccgccaggtggtgggcttttttttgtcatgaattttgcatggaaccgtgcgaaaagcctctttcggtgttagcgtaacaacaaaagattgttatgcttgaaatatggtgatgccgtacccataacacagggactagctgataatccgtccataaggttacaatcggtacagcaggttttttcaattttatccaggagacggaaatgtcatacagcggcgaacgagataactttgcaccccatatggcgctggtgccgatggtcattgaacagacctcacgaggtgagcgctcttttgatatctattctcgtctacttaaggaacgcgtcatttttctgactggccaggttgaagatcacatggctaacctgattgtggcgcagatgctgttcctggaagcagaaaacccagaaaaagatatctatctgtacattaactctccaggcggggtgattactgccgggatgtctatctatgacaccatgcagtttatcaagcctgatgtcagcaccatctgtatgggccaggcggcctcgatgggtgctttcttgctgactgcaggggcaaaaggtaaacgtttctgcctgccgaattcgcgcgtgatgattcaccagccgttgggcggctaccagggccaggcgaccgatatcgaaattcatgcccgtgaaattctgaaagttaaagggcgcatgaatgaacttatggcgcttcatacgggtcaatcattagaacagattgaacgtgataccgagcgcgatcgcttcctttctgcccctgaagcggtggaatacggtctggtcgattcgattctgacccatcgtaattgatgccagaggcgcaactgtgccgctatacttatccagggcggcacaacgctgtaagcggcttgcgcctgagaatggcatttgcgtcgtcgtgtgcggcacaaagaacaaagaagaggttttgacccatgacagataaacgcaaagatggctcaggcaaattgctgtattgctctttttgcggcaaaagccagcatgaagtgcgcaagctgattgccggtccatccgtgtatatctgcgacgaatgtgttgatttatgtaacgacatcattcgcgaagagattaaagaagttgcaccgcatcgtgaacgcagtgcgctaccgacgccgcatgaaattcgcaaccacctggacgattacgttatcggtcaggaacaggcgaaaaaagtgctggcggtcgcggtatacaaccactacaaacgtctgcgcaacggagataccagcaatggcgtcgagttgggcaaaagtaacattctgctgatcggtccgaccggttccggtaaaacgctactggccgaaacgctggcgcgcctgctggacgttccgttcaccatggctgacgcaaccacgctgaccgaagccggttatgtgggcgaagacgttgaaaacatcattcagaagctgttgcagaagtgcgattacgacgtacagaaagcgcagcgcgggattgtctacatcgatgaaatcgacaagatttctcgtaagtcagacaacccgtccattacccgagacgtttccggtgaaggcgtacagcaggcactgttgaaactgatcgaaggtacggtagctgctgttccgccgcaaggtgggcgtaaacatccgcagcaggaattcttgcaggttgatacctctaagatcctgtttatctgtggcggtgcgtttgccggtctggataaagtgatttcccatcgtgtagaaaccggctccggtattggttttggcgcgacggtaaaagcgaagtccgacaaagcaagcgaaggcgagctgctggcgcaggttgaaccggaagatctgatcaagtttggtctgatccctgagttcattggtcgtctgccggttgtcgcaacgttgaatgaactgagcgaagaagctctgattcagatcctcaaagagccgaaaaacgccctgaccaagcagtatcaggcgctgtttaatctggaaggcgtggatctggaattccgtgacgaggcgctggatgctatcgctaagaaagcgatggcgcgtaaaaccggcgcccgtggcctgcgttccatcgtagaagccgcactgctcgataccatgtacgatctgccgtccatggaagatgtcgaaaaagtggttatcgacgagtcggtaattgatggtcaaagcaaaccgttgctgatttatggtaagccggaagcgcaacaggcatctggtgaataattaaccattcccatacaattagttaaccaaaaaggggggattttatctcccctttaatttttcctctattctcggcgttgaatgtgggggaaacatccccatatactgacgtacatgttaatagatggcgtgaagcacagtcgtgtcatctgattacctggcggaaattaaactaagagagagctctatgaatcctgagcgttctgaacgcattgaaatccccgtattgccgctgcgcgatgtggtggtttatccgcacatggtcatccccttatttgtcgggcgggaaaaatccatccgttgtctggaagcggcgatggaccatgataaaaaaattatgctggtcgcgcagaaagaagcttcaacggatgagccgggtgtaaacgatcttttcaccgtcgggaccgtggcctctatattgcagatgctgaaactgcctgacggcaccgtcaaagtgctggtcgaggggttacagcgcgcgcgtatttctgcgctctctgacaatggcgaacacttttctgcgaaggcggagtatctggagtcgccgaccattgatgagcgggaacaggaagtgctggtgcgtactgcaatcagccagttcgaaggctacatcaagctaaacaaaaaaatcccaccagaagtgctgacgtcgctgaatagcatcgacgatccggcgcgtctggcggataccattgctgcacatatgccgctgaaactggctgacaaacagtccgttctggagatgtccgacgttaacgaacgtctggaatatctgatggcaatgatggaatcggaaatcgatctgctgcaggttgagaaacgcattcgcaaccgcgttaaaaagcagatggagaaatcccagcgtgagtactatctgaacgagcaaatgaaagctattcagaaagaactcggtgaaatggacgacgcgccggacgaaaacgaagccctgaagcgcaaaatcgacgcggcgaagatgccgaaagaggcaaaagagaaagcggaagcagagctgcagaagctgaaaatgatgtctccgatgtcggcagaagcgaccgtagtgcgtggatatatcgactggatggtacaggtgccgtggaatgcgcgtagcaaggtcaaaaaagacctgcgtcaggcgcaggaaatccttgataccgaccattatggtctggagcgcgtgaaagatcgtatccttgagtatcttgcggttcaaagccgtgtcaacaaaatcaagggaccgatcctctgcctggtagggccgccgggggtaggtaaaacctccctgggtcagtccatcgccaaagccaccgggcgtaaatatgtccgtatggcgctgggcggcgtgcgtgatgaagcggaaatccgtggtcaccgccgtacttacatcggttctatgccgggtaaactgatccagaaaatggcgaaagtgggcgtgaaaaacccgctgttcctgctcgatgagatcgacaaaatgtcttctgacatgcgtggcgatccggcctccgcactgcttgaagtgctggatccagagcagaacgtagcgttcagcgaccactacctggaagtggattacgatctcagcgacgtaatgtttgtcgctacgtcgaactccatgaacattccggcaccgctgctggatcgtatggaagtgattcgcctctccggttataccgaagatgaaaaactgaacatcgccaaacgtcacctgctgccgaagcagattgaacgtaatgcactgaaaaaaggtgagctgaccgtcgacgatagcgccattatcggcattattcgttactacacccgtgaggcgggcgtgcgtggtctggagcgtgaaatctccaaactgtgtcgcaaagcggttaagcagttactgctcgataagtcattaaaacatatcgaaattaacggagataacctgcatgactacctcggtgttcagcgtttcgactatgggcgcgcggataacgaaaaccgtgtcggccaggtaaccggtctggcgtggacggaagtgggcggtgacttgctgaccattgaaaccgcgtgcgttccggggaaaggtaaactgacctataccggttcgctcggcgaagtgatgcaggagtctattcaggcggcgttaacggtggttcgtgcgcgtgcggaaaaactggggatcaaccctgatttttacgaaaaacgtgacatccacgtccacgtaccggaaggtgcgacgccgaaagatggtccgagtgccggtattgccatgtgcaccgcgctggtttcttgcctgaccggtaacccggttcgtgccgatgtggcaatgaccggtgagatcactctgcgtggtcaggtactgccgatcggtggtttgaaagaaaaactactggcagcgcatcgcggcgggattaaaacagtgttaattccgttcgaaaataaacgcgatctggaagagattcctgacaacgtaattgccgatctggacattcatcctgtgaagcgcattgaggaagttctgactctggcgctacaaaatgaaccgtctggcatgcaggttgtgactgcaaaatagtgacctcgcgcaaaatgcactaataaaaacagggctggcaggctaattcgggcttgccagcctttttttgtctcgctaagttagatggcggatcgggcttgcccttattaaggggtgttgtaaggggatggctggcctgatataactgctgcgcgttcgtaccttgaaggattcaagtgcgatataaattataaagaggaagagaagagtgaataaatctcaattgatcgacaagattgctgcaggggctgatatctctaaagctgcggctggccgtgcgttagatgctattattgcttccgtaactgaatctctgaaagaaggggatgatgtagcactggtaggttttggtacttttgccgttaaagagcgtgctgcccgtactggccgcaacccgcagaccggtaaagagatcaccatcgctgctgctaaagtaccgagcttccgtgcaggtaaagcactgaaagacgcggtaaactaagcgttgtccccagtggggatgtgacgaagttcaagggcgcatctactgatgtgccttttttatttgtattcggtgactttctgcgtcttgtgggctgacaattgcccccgtttcttgtcacaataggcctttgcgcgcatcgatacgttgcgtgaggtacacagtcatctacagcggagtgttgttacaccatgatggacagcttacgcacggctgcaaacagtctcgtgctcaagattattttcggtatcattatcgtgtcgttcatattgaccggcgtgagtggttacctgattggcggaggcaataactacgccgcaaaagtgaatgaccaggaaatcagccgtgggcaattcgagaacgccttcaacagcgagcgtaatcgcatgcagcaacagctgggcgatcaatactccgagctggcagcgaacgaaggctatatgaaaaccctgcgtcaacaggtgctgaatcgtctgatcgacgaggcgcttctggatcagtacgctcgtgagctgaaactgggtatcagcgatgagcaggttaaacaggcgattttcgcgaccccagccttccaggttgacggcaaatttgataacagccgctataacggtatcctcaaccagatggggatgaccgccgatcagtacgcccaggcgctgcgtaaccagctcactacccaacagctgattaacggcgttgccggtaccgattttatgctgaaaggtgaaaccgacgagctggcggcactggtagctcaacaacgcgtggtgcgtgaagcgactatcgatgttaacgcgctggcggcgaagcagcctgtgaccgaacaggaaattgccagctactacgaacaaaacaaaaacaatttcatgacgccggaacaattccgcgtgagttacatcaagctggatgccgcgacgatgcagcaaccggttagcgatgcggatatccagagctactacgatcagcatcaggatcaattcacccagccgcagcgtacccgttacagcatcatccagaccaaaactgaagatgaagcgaaagcggtacttgatgagctgaataagggcggtgattttgctgcattagccaaagaaaaatctgccgatattatctctgcccgcaacggcggtgatatgggttggttagaagatgccactatcccggacgaactgaaaaatgctggtctgaaagaaaaaggccaactgtctggtgttatcaaatcttcggtcggtttcctgattgtgcgtctggacgacattcagccagcgaaagtgaaatcgttagacgaagtacgtgacgacattgcggcgaaagtgaaacacgaaaaagccctcgatgcgtactacgcgctgcagcagaaagtgagcgatgcggcaagcaacgacaccgagtctctggccggtgcagagcaagctgccggcgttaaagccactcagacgggttggttcagcaaagataacctgccggaagagttgaacttcaagccagttgccgacgctatcttcaacggcggtctggtaggtgaaaacggcgcgccgggcatcaactctgacatcatcaccgtagacggcgaccgcgcattcgtgctgcgcatcagcgagcacaaaccggaagcggtgaaaccgttggcagatgttcaggaacaagttaaggcactggttcagcacaacaaagctgaacaacaggcgaaagtggatgctgagaaactgctggttgatttgaaagccggcaaaggtgcggaagctatgcaggctgccggtctgaaatttggcgagccgaaaaccttaagccgttccggtcgtgacccgattagccaggctgcgtttgcactgccactgccagcgaaagacaaaccgagctacggtatggcgaccgatatgcaaggtaatgtggttctgctggcgctggatgaagtgaaacaaggttcaatgccggaagatcagaaaaaagcgatggtgcagggtatcacccagaacaacgcacaaatcgtctttgaagctctgatgagtaacctgcgtaaagaggcgaaaatcaaaattggcgatgcgctggaacagcaataatcctgaagccgcctcgcaaaaaaatgctttgcagctgtaacaagaaaaggtcgctttcgcggccttttccatttctgaacattgccatttgtttactgttttcactgccgttaaggtgattccactgttaacaaacaaggagaaaacagtatgaaacacggaattaaagcactgctcattaccctgtccctggcctgtgccggaatgtctcatagcgcgctggcggcagcttctgtggcgaaaccgacaacagtagaaaccaaagcggaagctcctgcagcacaaagtaaagcagcagtaccggcgaaagccagtgacgaagaaggcacccgggtcagcattaataatgccagcgcggaagagttagcccgcgcgatgaatggcgttggcctgaagaaagcgcaggcgattgtcagttatcgcgaagagtacggtccgtttaaaacggtggaggatctaaagcaggtgccggggatgggcaattcgctggtggaacgtaatctggcggtattaaccctgtaattaatttgcatagtggcaattttttgccagactgaagaggtcataccagttatgacctctgtacttataacagttcttataacaacaacgtaaggttattgcgctatgcaaacacaaatcaaagttcgtggatatcatctcgacgtttaccagcacgtaaacaacgcccgctaccttgaatttctcgaagaagcccgctggcatgggttggaaaatagcgacagttttcactggatgacggcccataacatcgctttcgtcgtggtcaatatcaatattaactatcgccgcccggcggtattaagcgacctgttaaccattaccagtcagttgcagcaattaaacggtaaaagtggcatcttaagccaggtcattacactggagccggaaggacaggtggtagcggatgcgcttattacgtttgtttgtattgatcttaaaacgcagaaagcattagctctggaaggggaattgcgcgaaaagctggagcagatggttaagtaaacgttttgtggtgccggatgctcaagccgcatccggcgacacccggaataattacttcaacccggttttctgcttcatcgctgccatcaccgtcggtttatcggccagataatgattcaaaccgttggcacgtaaattacacgccgcacaatgaccgcaaccgtcgcctttaatgccgttataacaggtcagcgtttcgttacggactaaatccagcttgccgtaataatctgccagcgcccaggtttccgctttatcaatccacatcagcggcgtttcaaaacgaatatctttcgccatgcccaaactgacggcatggtttagtgctttcacaaactcatcgcggcaatccgggtagccggagaaatccgtttcgcagacgccggtaattacggcttctgcttttacctgatacgcatatattgccgccagtgtcaggaacaaaatattacgccctgggacaaacgtattcgggataccatcggcttcaggttcataatcaggcaccggaatgctgtcacgcgtcaggctgctgaccgccagctcgttgagcagcgttacatcaagcaccttatgcgcgcgtgcccccagtttcagcgccagttcgcgtgccacgtcgatttctgcgcgatggcgttgaccgtaatcgaacgtcacgcaatggacttcatcatattgttgtaatgcctgcaccagacaggtggtggaatcctggcctccactgaacacaacgacagcacgtttcatagataatcctgcttgaacaataaaaacgttatggtaacgcctgcgattaacccggaccagctattcattgcgacggcgcgggaagccaggcttcggtaaattcaaaccagccgcgcggtgtcagtcgcacaccgttcacgccgggaggggcgctaatgcgatagtgatagttgaacagcggcgtcagcgtcgcatctgccattaactggctaaaaaccgctttcagggcattaaatcggttttcctcatcaggcattacttgcactgcgtccagtgtcgattgcaaatgtgcatatgctggagcgtcgaaaacatgtggccacagtggatcgcaacgcagccattgctccagggtatattccggtgcttcgccaattaatctgtcgcccatcatgaggtctgcgtgtgccagtagggtcgtgtcgtcccagttttttgcgttatgaaaaataattgtgagttcacagccttccgctgccagtgtcgcctgtaggcgttctgccatggtatgaagttctatcggtaggtgataaaccagcgtcaaggttttcggtagtttaacttcatccggtacttgccaatgcggaatagtccagcctggcagtaatgcatgactggcagtgatcaggttttctccgacttctaacgtttgtaataaaccggattgatgaataatggagattacttttcgcgcctgccagagggacagtcggagacttttgcgcaatgttaaatagcaaaaacctaaactgatgccgctactgacctggctgacccgttgcagctcctccggtttgccaatggtgatttgcacgggatgccgacaactggttcccatatctttttcgaaaagcggcggagttatccagtactcaaccgctttaagcagcggatgacgtaaatggtaataatcatggctctccaggcgcaccagttccgctgtgaattgtgttaagcgaaaaggacctgtgccgatcagtgggaattgcggatgcgccagatggctgcaatagctcgccagtcggtgcgcaagccagtaatcggggcgatgtaaaaagaaggtcagacactgcggatgggtgacttcaatacgcttcacgctaataaataattgatccagtgctggcagttgtaacagcatcaataaccgctggtgtaagtgggaggcttttactgcatcgccgttatgccagtgtaaggttgagcgaagataaaaatcccagcgtaacccgtcagtagaggtttcccagtgatgtgctaaatcgccaatcgggcgctgagtattattatcgaagcgggtcaggccggaaaatatctgcccggccagatgctgctcggcacggccgggcaaaaagcccggttgtagcggttcgagcgggcgatagtagggaatacgcaacgtgggcgtatcgttttgccattgtccgcccataaacggctgtaacagagtgcgcagctcacctggggccagttgcgccagctccagcacatcttgctgctttccggtttccagcgcctgttccatcatcgcattgcgtagcgattctggcgtgaccagaaagcgtaattgtccgcgctttccgcgtcctgactgcgcctgccactccagccatcccgcctcctgtgcctgacgcaacagcgtacgaacatggcgttcgctgcaaaaacagcgttcggccagttcgctgacggtgacggtttgcggctttccggcggaaggttgccacagacgttgatactggttaagacggttgagcagtcgcatataaacccggaacaatattatttaactattcactattacttccgtatatatcaggtgatactcaatcaccattaaccgtgtcacagagtggagaaagaaatggctcgtctggcagcatttgatatggatggcactttattgatgcctgaccatcatttaggtgagaaaaccctctctactttggcgcgactgcgtgaacgcgacattaccctcacttttgccacggggcgtcatgcgctggagatgcagcatattctcggggcgctatcgctggatgcatatttgattactggcaacggaacgcgcgtgcattctctggaaggtgaacttttacatcgtgatgatttacctgcggatgtcgcggagctggtgctgtatcagcaatgggatacccgagcaagcatgcatatcttcaatgacgatggttggtttaccgggaaagagatccctgcgttgttgcaggcatttgtctatagcggttttcgttatcagataatcgatgtcaaaaaaatgccactcggcagcgtcaccaagatctgcttctgtggcgatcacgacgatcttacacgcttgcagatccagctatacgaagcattaggcgagcgtgcacatttatgtttttccgccacggattgcctcgaagtgctgccggtgggctgcaataaaggcgctgcattgacggtgctgacccaacatttaggtttatcgttacgcgattgcatggcctttggtgatgcgatgaacgatcgcgaaatgttaggcagcgtcggtagcggatttattatgggcaatgcgatgccgcaactgcgcgcggagctcccgcatttaccggtgattggacattgccgaaatcaggctgtctctcactatttgacgcactggctggactatccacatctaccttattcccccgaataacgagatcccttccagcaccgggcaattgcccggttttttttgcgttgaatttgtcattttgtgccgtggtgcttaaaccgcacagaataaattgtcgcgatttcacctttaaaatagaattaaaagagaaaaaaattctctgtggaagggctatgttagataaaattgaccgtaagctgctggccttgctacagcaggattgcaccctctctttgcaggcactggctgaagccgttaatctgacaaccaccccctgctggaagcgtctgaaacggctggaggacgacggtattcttatcggcaaagtcgccctgctggatccggaaaaaataggcctcggcctgaccgcctttgtgctgataaaaacgcaacatcacagcagcgaatggtattgccgctttgtcacggtggttaccgaaatgccagaagtgctggggttctggcgcatggctggtgaatacgattatctgatgcgcgtccaggttgccgacatgaaacgctacgacgagttttataagcgtctggtaaacagtgtaccggggctgtcggacgtcacttccagtttcgcgatggaacagattaaatacaccacttctttacccatcgaataaatatccagaatcaagtcaggacacaacgcgtgcgattatttgctcaattaagctggtatttccgtcgggaatggcgtcgctatctcggggctgtcgccttgcttgtcattatcgcgatgctgcaactggttccgccaaaagtggttggtattgttgttgatggcgtgacagaacaacactttactaccgggcagatcctgatgtggatcgccaccatggtgctgattgccgttgtggtttatctcctgcgttacgtctggcgcgtattgctgtttggtgcgtcttatcaactggctgttgaactgcgtgaagattattaccgccagctaagccggcagcatcctgagttttacctgcgtcatcgcacgggtgacctcatggctcgtgcgaccaatgacgtcgatcgcgtcgtgtttgccgccggagaaggggtgctgacgctggtggattcactggtaatgggctgcgctgtgttgattatgatgtctacgcaaattagctggcagttgaccttatttgccctgttgccgatgccagtgatggcgatcatgatcaagcgcaacggcgatgccttgcatgaacgctttaagctggcacaggcggcgttttccagtcttaatgaccgcacccaggaaagcctcaccagtattcgcatgatcaaagcctttggtctggaagatcgtcagtcggcgttatttgccgcggatgccgaagataccggcaaaaaaaacatgcgggtggcgcgtattgatgctcgtttcgacccgaccatctatatcgcgattggtatggcgaacttgctggcgattggcggcggtagttggatggtggtacagggcagtttaacgctgggccagctcaccagttttataatgtatttaggtctgatgatttggccaatgctggcgctggcatggatgtttaacattgtggaacgtggcagcgcggcgtatagccgaattcgtaccatgctggccgaagcgccagtcgttattgatggtagtgataaggtgccagaaggtcgtggtgaactggatgtgaatattcgccagtttacgtatccgcagactgaccatcctgcgctggaaaacgtcaatttcgccctgaaacccggtcagatggtaggtatttgcgggccgactggttccggcaaaagtaccctgttgtcgctcattcagcgtcatttcgacgtcagcgagggtgatatccgttttcatgatattcctctgacgaagttacaactcgatagctggcgtagccgtctggcggtggtcagccagacaccattccttttttccgacaccgtggcgaacaacatcgcgttgggttgcccgaatgccatccagcaagagattgaacacgtagcgcggttagccagcgtacatgacgatattttgcgtctgccgcaaggttacgacacagaagtgggcgagcgcggcgtgatgctttctggcggacaaaaacagcgtatctccattgctcgagcgttattagtcaacgcggaaatcctcatccttgatgatgcgctttcagcggtggacggacgtacagagcaccagatcctgcataacctgcgtcagtgggggcagggaagaacggtaatcatcagtgcccatcgcctttctgcactgacggaagccagtgaaattattgtgatgcagcacgggcatatcggccagcgtggcaatcatgatgtgctggtacaacaaagcggctggtatcgcgatatgtatcgctatcaacaactggaggcggcgctcgacgacgctccggaaattcgcgaggaggccatcgatgcgtagttttagccaactgtggccgactctcaagcgcctgttagcgtacggttcaccgtggcgtaaaccgttggggattgcggtcctgatgatgtgggttgcggcggcggcagaagtcagtgggccgctgcttatcagctattttatcgacaatatggtagcgaaaaataacctgccgttgaaagtgggtgcagggctggcggcggcgtatgttgggctgcaactgtttgcagccgggctacattacgcgcagtcgctgctgtttaatcgggcggcagtaggcgtagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgtagcgccgcactggtgggcgcgatgctggtggcgatgttcagcctcgactggcgaatggcgctggtggcgataatgattttcccggtggtgctggtggtaatggtgatatatcagcgttacagcacgccgattgtccgtcgtgtgcgcgcttatctggcggatatcaacgacggctttaacgaaatcatcaatggcatgagcgttatccagcagttccgtcagcaggcgcgatttggcgaacgtatgggtgaggccagtcgttcacactatatggcgaggatgcaaaccctgcgcctcgacggttttctgctgcgtccgctgctgagtctgttttcatcgctcattctttgtggcttgttgatgctgtttggcttctctgccagcggcaccattgaagtgggcgtgttgtatgcgttcatcagttatttggggcgacttaacgaacccttaatcgaactgaccacgcagcaggcgatgctgcaacaggctgttgttgctggtgagcgcgtttttgagctgatggacggaccgcgccagcaatatggcaatgatgatcgcccgttgcagagcggcaccatcgacgtcgataacgtgtcatttgcttatcgcgatgacaatctggtgctaaagaacattaatctctctgtgccttcgcgcaactttgtggcgctggtcgggcataccggcagtggcaaaagcaccctcgccagtttattgatgggctattacccgctaacggaaggtgagattcgccttgatggtcgtccattaagtacgctaagtcacagcgcgctgcgccagggcgtggcaatggtgcagcaagatccggtggtgctggcggataccttcctcgccaacgtgacgctgggacgtgatatctctgaagaacgcgtctggcaggcgctggaaatcgtgcagctggcggagctggcgcgtagcatgagtgatggtatttacacgccgcttggcgagcaggggaataatctctcagtcgggcaaaagcaactgctggcactggcgcgcgtgctggtggagacgccgcaaatcctgatccttgatgaggcaaccgccagcattgactccgggactgaacaggcgattcaacatgctctggcggcggtgcgtgaacatactacgcttgtggtgattgctcaccgcttatcgactattgttgatgccgacaccattctggtgcttcatcgtgggcaagctgtggagcagggcactcaccagcaactgctggcggcccagggacgctactggcagatgtatcaactgcaacttgcgggcgaagagctggcagccagcgtgcgtgaagaggaatcattgagcgcctgaatagcgcaatatttcatcgttggtgcaaaaatgtaacgcactgtgcactgtcatagtgcgttttcattttcaatcttcttaacttcctgctctctttctcgtttttcatttctggcacaccgcttgcaataccttcttcgtgtagcagaaccattaccgaattctgaccggaggggatctatgaagctggtgaccgtgataatcaaaccattcaagctggaagacgttcgtgaagcgttatcttccattggtattcagggcctgaccgtcaccgaagtgaaaggtttcgggcgtcagaaaggacatgccgagctgtaccggggggcggaatacagcgtcaactttctgccaaaagtaaaaattgatgtggcgattgctgatgaccaactcgatgaagtgatcgatatcgtcagcaaggcggcttacaccggaaaaattggcgacggcaaaatcttcgtcgctgaattgcaacgcgtcattcgtattcgtaccggcgaagccgacgaagcggcgctgtaatctctggcacacagcaacaggaacgaaaaatgaagatagcgacgataaaaactgggcttgcttcactggcgatgctgccgggactggtaatggctgcacctgcggtggccgataaagccgacaatgcgtttatgatgatttgtactgcgctggtgctgtttatgaccgttccggggattgccctgttttatggagggctgattcgtggcaaaaacgtgctgtcgatgctgacgcaggtgaccgtgacgtttgcactggtctgtattctctgggtggtttacggctactcgctggcgtttggcgaaggcaacaacttcttcggcaacattaacgggttgatgctgaaaaacattgaactgacggcggtgatgggcagcatttatcagtatatccacgtggcgtttcagggatcgtttgcctgcattaccgtaggcttgatagttggggcgctggcggaacgaatccgcttctcagctgtgttgatttttgtggtggtatggctgacgctctcttacattccgattgcgcatatggtctggggcggcggtttgctggcttctcacggggcactggatttcgcgggtggcacggtggtgcatattaacgccgcaatcgccggtctggtgggcgcgtatctgataggcaaacgcgtgggcttcggtaaagaggcgtttaaaccgcacaacctgccgatggtcttcaccgggactgctattctctatatcggttggtttggctttaacgccgggtcagcgggcacggcgaatgaaatcgcggcactggcatttgtgaatactgtggtcgcaactgcggcggcaattcttggctggatcttcggtgaatgggcgctgcgtggtaagccttcactgctgggagcgtgttctggcgcgattgccggtctggtcggcgtgacgccagcctgtggttacattggggttggcggcgcgttgattatcggcgtggtagctggtctggcgggcttgtggggcgttaccatgctcaaacgcttgctgcgggtggatgatccctgcgatgtcttcggtgtgcacggcgtttgtggtattgtcggctgtatcatgaccgggatttttgccgccagctcgctgggcggcgtgggcttcgctgaaggtgtgacgatgggccatcagttgctggtacagctggaaagcatcgccattacgattgtctggtctggtgtggtggcatttatcggctacaaactggcggatttgacggttggtctgcgtgtaccggaagagcaggagcgagaagggctggacgtcaacagccacggcgagaatgcctataacgcgtaacaagcactgcaaaaaacagccggacggttttcacctccggctatttttttaattgtgattacgcatcaccccttcctgaacggtcgaggcaaccagcacgccgtcctgggtataaaactcaccgcgcacaaagccgcgtgcgctggacgccgaggtgctttccacgctatacagcagccattcattcaaattaaacgggcgatggaaccacatggaatggtcaatggtggcaatctgaatccccggttcgagaaaaccgatgccgtgcggctgtagagctaccggcaggaaattaagatcagaagcataaccgagcagatactgatgaacgcgcagatcatccggcacgctaccatttgcgcggatccacacctgacgatgcggttctgcgacgtgacctttcagtgggttatgaaactccaccggacggacttccagcggacgatcgcagatgaatttatctttcagcactggcggcagcaggtgcgccagcgattgggcgatttgcgtttctgaaggcaggccatcaggcgctggcgcggacggcattgttttttgatgttcgaaacccgcttctggtgcctggaaagaggcagtcatataaaaaatcggtttgccgttttgaatagcagaaacccggcgggcgctgaagctgttaccgtcacgcagcgtttcgacatcataaataatcggcttcttactatcgccagggcgaagaaagtagctgtgaaaagaatgtaccagccgctcgtcagggacggtctcttttgcagcatacaaggcctgacccacgacctggccgccaaatacctggcgtaaacctaaatcttcactctggccgcgaaagagtccttcctcaattttttccagatttaacaatgtcagtaaattttttagcgcctgactcatataactctccagtaacaaagctgccgcagcaagccaaagtgagttgagtataacgcaaatttgccactggtccgatgggtgcaatggtctgaattacgggctaattacaggcagaaatgcgtgatgtgtgccacacttgttgacgttactattttgttaaccactcttccggcgaggaaagttagcccgctggtgcattgataataaggagaagtgaatgaaactcgtgcacatggccagtggtttagcggttgcgattgcgttggcggcttgcgcagataaaagcgcggatattcagacgccagcaccggctgcaaatacgtctatttcagcaacacaacaacctgctatccagcaaccgaatgtctccggtaccgtttggatccgtcagaaagtcgcactgccgcctgatgccgtgctgaccgtgacactttctgacgcgtcgttagccgatgcgccgtcgaaagtgctggcgcagaaagcggtgcgtaccgaaggtaaacagtcaccattcagctttgttctgccatttaacccggcagatgttcagccgaacgcgcgtattctgttgagtgcggcgattaccgtgaatgacaaactggtatttattaccgataccgttcagccggtgatcaaccagggcggaactaaagccgacctgacattggtgccggtgcagcaaaccgccgtgccggttcaggctagcggtggcgcaacgactaccgtaccttcaacttcaccaacccaggtgaatccgtcttcggcagttccagctccaacgcaatattaagcgaagttaaccctctccgcccggagagggttagtagttccagcgataaagctgcaagtcgatttgcccgcttcccgacaccatcacaccttctgccagtaatgcctgtcgctgacgctgtaaatccggtccggtcagtgaaatggtgccgtggcgattaaccacccggtgccatggcaaggtgctgccttcggggagacgctttaacacaccgcctacctggcgcgcggcgcgcggcgatcccgccagtttcgccacatcaccgtaagtggtgacatagccttcgggaatagcggctacgatttgccagacgcgctggggaaatgaatcttctttttccatcttttcttcctgaggtaatttttcagcataatctggaaaaacgcccgagtgaagccgcattgcgcaagaaaccagcatctggcacgcaatgggttgcaattagccggggcagcagtgataatgcgcctgcgcgttggttctcaacgctctcaatgggggctctgttggttctcccgcaacgctactctgtttaccaggtcaggtccggaaggaagcagccaaggcagatgacgcgtgtgccgggatgtagctggcagggcccccacccatttctgcctcccaccgtttcgtcaaaaaatcccaacatggctaaactttaaccactactgacgtcgcaagaattgtctggctgcgcagtacgcttcggaggtatgtctgatgaagtatgttgatggttttgttgttgccgttcctgccgataaaaaggatgcctatcgggaaatggccgctaaggccgcgccattatttaaagagttcggtgcgcttcgtattgtcgaatgctgggccagcgatgtaccggatggtaaagtgaccgattttcgtatggcggtgaaagcggaagagaatgaagaggttgtctttagctggattgaatacccttcaaaagaggtccgcgacgctgctaatcaaaagatgatgtcggacccacggatgaaagagttcggcgagtccatgccgtttgacggcaagcgaatgatctatggtggattcgaatcaatcatcgacgagtaggtagcgtgacgggctgtgcggcgtgccgtcagccctaaaattcacaaatgttgctcggcccagcgtaagaaatcctctttcggtaatgccttgctgtagagccagccctgaccgtagtgcacgccatgctggcgtagccactcttcttgtttactggtttcgattccctccgcaaccattttcagtttcagagtttttgccattttgatgatatgcggcgtgacatttttatattccagcgcatcaacgaaagatttatcgatcttcagaatgtcgacatccagatcctgtaaatagcttaaacttgaataccctgtaccaaaatcatcgagataaatttcatggcccgcctcccggtagcgagaaattatcggggcgctggttttcggatcggcaaactcgcgttcagtgagttcaagcgcgatctgtctgggattaacctgatagtgattgatcatttcacgcagcaattgcgggattttttccgaggtgagcacggtggattcaagattgatcgaaatatgctgctgaggatgctgacgcagccagtcgcccatatcttcaaagacgcttcttataatcagtagcgtcaatggctcagaaaggcccgtttgctgtgccagcggaataaaactatctggtgacaaccaactaccgtctgtctgcggccagcgcgccagtgcctcagcaccgacaattttgccattggctaaggagacaatcggctgatagtgcacgcaaatatcacgattttcgatagcatcctgcagccgatgatgcggtgactggatacggcgcaaaatacgcagcacaaacatcgctgccagcaggccaatcaccaacccgagcggtaaccaaataaagacttgccgatgccagcctttctgcaacattttcgttgaagcccaggtgatgatcgaaatattcatctccggtaagggcaggatatcgtaaatgattccattattttcgatatgctcaccgggtgttttttgtagcctggtaataattccctgagcaagttcatcgctgctggttatgacaacgttatgggcattgccaataatggcggcatcaatttgccatgagctatagggaatgacatcaataaaggaagcggggtcgatcatgacgacataatgtgccgttcccatggcgaccatgtaacgaataatgcctaaatcgttatgcgatgttaaccagacacgataaccatctttcgaaattttacctggctcggggaaggtatcgggcgggctttcatgctccagagacgaacactggggaacgttgttatcgatataaaccacttcctgaatatagcgataactgtaagatacccgacgcatttccatgagatgggcttcgctacaggcagcgccttgccatctttccagctcttgcagcgcatctttcccttgtgtcgccaccttattggcccgaatagcgacgcgggaggaatacgtattcagctcttcaataaatgatgtttctacctgctgatgggccagccagatgcttaagccgacaggcagcaatactgaaagaatcagtactcccgaaataaggccgaccagatgtcgtgttctcaccagcatatccttattaacacagtgtagggaaagtatatctgattgtggaaaaaggctggcaggagataaggaggtagagctggtatttcatgaagtgatgggtggaagcgatcgttgtcatttgaccaggcgtagagctttacgcctggtatgtacccctaacttaagatgttgattcggcgcgagcgagggtaaaaatatcgtaaaaagatagttcacctttacggacgatcattttttgcagttgttctttatgaacatccgcgacacgcggagagttcaggatggcttcaactagcgcggcaggtacaaagcgcgtgttgtaccattcgccgttatagcaaacgcggaaatccagcacgtcgatatcttcatagcggtagcgtgggtagacatcgaaaaagaagaaaccattaagcaggataaataatacaaccagtagccagacagagcctgaaagcgtttcggactgcaacatcaccgccagggtggcaaaaaaagcaacgtacataccgataaacagccccggatgtttacggataaaactgatactaaagcggggtttgttgtcgcgtttttcgcgggtattcagagactcaatcgtttcggtcagcaggcgttgtatttcggtcatcgtttgccttcgtgatatctgcaactttccagggaacaccctattttaacgtgggaatagtagaggggaagtaacagatttgccacgattttgcataacagttgagaaaagctggttacaattttttaatgattctggctggattaccgcccacgacaacgttgtccgggacatcttttgtgacaactgcacctgaggctaccacgacgttatcaccaatggtcacaccagggttaatgactgcacgtccgccaatccagacgttattaccgatggtgacgggtttccccagttcagcaccgctattacgtgctacagggtcgatgggatgtgttgccgtgtagatatgaacgcctggtgccaacatacagttatcaccaatgcgaatagggcagacatcaagcatcacgcaatcgaagttggcgaaaaaattattgccgagaaaaatgttataaccatagtcacagcgaaacgttggctcaatataagcctctgtcacctgaccgaataaatcagcaagaatttgctggcgtaatgtgtgctcttccaccagggaatgattgtatcggtgaataagccgacgagctcgcaggcgatcgcgagataacgccccatctgccgagtgatacaactcaccagcaatcatcttttctttttctgtgctcattactgacttccggttgctgaaaatgcggcaacacagtaagacgaaaagtcagtgaagagaacgttcccattacatctgtgtgatgaagatcacatagggtatgtcttcatggcgaaaaaaagtataaaattcttaataaacagccggttatagctccgaaagcgagttatttattagcgaataaatttccatactgaggaagggatcttgtcgtacagtttattcatggtcaattcggcgaggcggtgatctgcggctgagtaaaataccgccagttcattatctgataattcgtatttatttttctcgataacacgctccagcgtgtcaattgtctgacaacgacgtaaacgcattaaataatcggttttcgttaaaggtttttcggacatacttctacccatggttgtaataattctaacaagataaactcgcaggattctctttcgtcgcattgacaaaacaacggaatagtcgattacctgacttccgccatttctgaagatcctgcatattaataccataactactgaacaacataaaggtgtcatccagatattcgtcgatctgctcaatgagcttattgtcttcattatacttaattttgtaattaagtgcgaaggtcgcaatatgctcaatcagttcattcaactggaggttgatcgccgaggttgggtcgttaacccagccatgattgctttcttcaaggtttgcaaggcagtcatgatacagggtttcacagagaaacttaagctgtgcgatatcatgtcttttgggtgagtattcatccataacgcgtccccttcttagcggttgaactaacggacacctttcgggatggaaaaaacttactgacctggacttgctctctcgtttgttagcttaactataagccactctttgtaggttttcatcgcattattacgaaaaattacaattaggaaggaagcgggacaggactcactttttcatactagcaccaacccgcagcaggtaaaagcagtttgctcgaactgttcataacatttcagaattatcgccagaagaaattggtgacactaataccaggattgctctgaatatgacgtaataaccgaggaatgaataaagaattaccgcaaataattaagaatagcctctaaatggttatggattattaaatctattagcgctacttaatataaattaactaacaatcagtattttttatgaattttatgcggggttaatactggttttcgtatgggatcctgagttggtggttcaatactccttaatgttcgtaggttatgtataaaaaaggccgcttgcgcggccttagtgattacacgttgtatcaatgatgatcgacagtatggctgtgctcgatatcttcattcttgcggctaaagcggcggcgaaccaccacaaagaataccggaacgaagaagattgccagtaccgttgcggtcaccatcccgcccattacaccggtacctactgcgttctgcgcgccggaaccagcaccagtactgataaccagcggcataacgccgaggataaacgccaacgaggtcatcaggattgggcgtaaacgcatccgcaccgcatcaagcgtcgcttcaatcagacctttaccttctttatccatcaagtctttggcgaattcgacgataagtatcgcgttcttcgccgacaaaccaatggttgtgagcaggcctacctggaagtaaacgtcattggtcaggccacggaaggtggcagccagcaacgcaccgataacccccagcggaacgaccagcataacggagaacggaatcgaccagctctcgtacagcgcagccagacacaggaacacgacaatcaacgaaatcgcgtacagtgaaggcgcctggttgccggagagacgttcctgataggacattcccgtccagtcatagccaacaccggtaggcagtttgctcgccagttgttccatcagctccattgcttcaccggtacttttacccggtgccgcctggcctaagatttccatagatggcaggccgttgtaacgttccagacgcggcgaaccgtactcccaacgagaagaggagaacgccgagaacggcaccatctgaccatcagcagcacgaacataccagtcgccgatatcatccggcagcatacggtatttcgcttctgacatgacgtaaactttcttcacacgaccgcggtcgataaagtcgttcacatagctaccgccccatgcagcgcccagagtggtgttaatgtcgttgatagaaacacccagcgcctgcgctttttcctggtcgatatcaatcttaaactgcggggtatcttccagaccgtttggacgtacgctggtcaacatatcagggtgcttcgctgcttctgcaagcaactggttacgcgcctgagtcagtttttcgtgaccaaggccagcctggtcaatcagctcaaagtcaaagccggttgcggtacccagttccacgattgcgggcaggttaaaggcgaaaaccatcgcatctttgatttgcgagaaagcacgtgttgcacgcatggtaatcgcttcaactttgttttcttcgcccggacgatcggcccagtccttcaaggaaacgaacgcaatacctgtattctgaccacgtcccgcaaagccgaagccgttaacggcgaacaccgactcaacgttgttcttttctttggtcagatagtaatgcgttacctcattgagcactttctgcgtacgttcctgcgttgcacctgctggcagctgaaccatggtcataaatacgccctggtcttcatctggcaagaaggagcttggcagacgcacgaacagataggccatgccgaccacgatgatcagatacagcaccaggtaacgccctgtactgcgcagaataccgcctacgctgtcggtgtagtggtgcgtgctcttctcgaacatgcggttaaaccagccgaagaagccttttttaccttcgccgtgatcgcctttggcaatcggtttcagcatggttgcacagagtgccggagtcaggatcaacgccaccagtaccgacagcgccattgccgaaacaatggtaatggagaactgacgataaattgccccggtcgaaccgccgaagaaggccatcggtacgaataccgctgacagtaccatcgcgatacccaccagcgcgccctgaatctgccccatcgacttacgcgtagcttctttcggtggcagaccttcttctgccattacacgctcaacgttttctactacaacgatggcgtcatccaccaacaggccgatggcgagtaccatcccgaacatcgttagtgtgtttatcgagaagccaaaggtggcaaggacggcaaatgtccccagcaataccaccggtacagcaatagtcggaatcaacgtcgcgcggaagttctgcaggaacagatacattaccaggaacacgaggatgatcgcttcgaccagcgtttttaccacttcgtgaatagagattttcacgaacggtgtggtgtcatacgggtaaacaattttcagacccgacgggaagaacggttccatcttcgccagttcagcacggattgccgcagcggtatccagcgcgttcgcaccggtcgccagcttgatccccagaccggaagccggttggccgttaaactctgcgatgatgtcgtagttctcaccacccagctcaattttcgccacatcacgcagtagcacgcgggaaccatcctgattcactttcagcaggattttgccgaactcttcagtagaggtcagacgcgtctgagcaataatagaggcgttaagctgttggcctttcaccggcggcgtaccaccgagctgaccagctgcaacctgagcgttctgtgctttgatggcggtaatgacatcaaccggcgttagctggaatttgttcagttcattcgggttcatccagatacgcatcgcgtactgtgaaccgaacaactgaacgtcacccacgcccgacgtacggctgatggcatctttcatattcgctgccacgtagtcagagatatcctcctgcgtcatagtgccatcggtgttgataaccccgacaaccatcaggaagctgctggatgatttctcaacgctcaccccttgctgctgaacttcttgcggcagcaacggcatcgccagctgcagtttgttctgcacctgaacctgcgcgatatccgcatcagtaccagactcaaaggtcagggtgatctgcacggtacccgtggagtcactgttagaggacatgtacatcaggttatcgataccgttcatattctgttcgataacctgtgtcaccgtgtcctgcactgttttcgcatcagcgccagggtaggaggcggagatcgttactgccggcggtgcaatcgtaggatattgcgccaccggcagtttgaggatcgccagcccccctgccaacatgatgataatggcgatcacccacgcaaaaatcgggcgatcgataaagaaattaggcatgtcttaacggctcctgtttaagttaagacttggactgttcaggctgagcaccgcttgcggcttgctggttattatcagcggtaacttcttgtgcttttacctggacaccaggacgcactttctgcagcccacttattactacgcgatcgcctgctttcagaccttctgtcaccagccacttatcgccgatagcctggcttgcaacgatcggacgggtttccactttgtcatccgcgccaaccaccagtacggtggcatcgccacgcggcgtacgggttacgccctgttgcgggactaaaatagcgtttggattaagcccttcttccagacgtgcacgcacgaacatacctggcagcagagtgtgatccgggttcgggaagatagcgcgtagggtgatagacccagtggtctgatcaacggtaacgtcagagaattccagcgtaccgtcctgcgggaacttaatgccgtcactggtgatcagcgacactttggctttgccgttctcttgtttcagcgtgccattcgccagttcctgtttcaggcgcaggaagtcgttgctggactgggtcacatcaacgtagatcggatcaagttgctgcacggttgccagcgcagtcgcctgaccgttctgtaccaatgcgccttccgtcacgtttgacttaccaatgcgaccactaatcggagaggtgactttggtgtaagccagattgattcgcgcagtttcaacggcagctttcgccgcagttaccgcagcattcgcctgttgcgcatcagccagagcctgatcgtactcttgcttactgatgtactgagtaccgagcaatttctgataacgattcaccgtcaattgcgcgatattggctgcagcctgggctttcgccagatcacctttcgcactgtcgtatgccgcctgataggtcgcaggatcaatctgatagagagagacacctgcttcgatgtcgctaccttctttgaaattacgcttcaggataatcccgctaacttgaggacgaacttctgcgatccggtaggcactggtgcgacccggaagctcggttgtgatctgcagaggttcagttttgactgttactacgccaacggcgggcatctgctggccaccttgttgggcctgtttgtcgtcacatcctgttagggctaagctgcctgagagcatcagaacgaccgccagaggcgtaaaccctctgtttttgttcatatgtaaacctcgagtgtccgatttcaaattggtcaatggtcaaaagttaataaacccattgctgcgtttatattatcgtcgtgctatggtacatacattcacaaatgtatgtaaatctaacgcctgtaaattcacgaacatatggcacgaaaaaccaaacaagaagcgcaagaaacgcgccaacacatcctcgatgtggctctacgtcttttctcacagcagggggtatcatccacctcgctgggtgagattgcaaaagcagctggcgttacgcgcggtgcaatctactggcattttaaagacaagtcggatttgttcagtgagatctgggaactgtcagaatccaatattggtgaactagagcttgagtatcaggcaaaattccctggcgatccactctcagtattaagagagatattaattcatgttcttgagtccacggtgacagaagaacggcgtcgattattgatggagattatattccacaaatgcgaatttgtcggagaaatggctgttgtgcaacaggcacaacgtaatctctgtctggaaagttatgaccgtatagaacaaacgttaaaacattgtattgaagcgaaaatgttgcctgcggatttaatgacgcgtcgcgcagcaattattatgcgcggctatatttccggcctgatggaaaactggctctttgccccgcaatcttttgatcttaaaaaagaagcccgcgattacgtcgccatcttactggagatgtatctcctgtgccccacgcttcgtaaccctgccactaacgaataaccctgaatctgactccaggaattttcctggacattttcgtcgttgctattctggttcactgcgtcgtgatattcttgcggtttgactttttcaggtcgttcttcaggttcagaaaccttcattcatcatgactatgttccagtattacaaacgatcacggcattttgttttttcagcatttattgcttttgtttttgtcttgttatgccagaacacggcgtttgcgcgggcgtcatcgaatggtgatctgccgacaaaagcggacctgcaggcacaacttgactcactgaataaacaaaaagatctttctgctcaggacaaactggtgcagcaggatctgacagatacattagccaccctcgataaaatcgatcgcgtaaaagaagagacagttcagctacggcaaaaagtcgctgaagcgccggaaaaaatgcgccaggcgaccgcggcgttaacagcacttagtgatgtcgataacgacgaagaaacgcgcaaaattctgagcacgctttcgttgcgccagctggaaactcgcgttgcccaggcgctggacgatttgcaaaacgcacaaaatgatctggcgtcttataacagccagctggtttcgttacagacgcagcccgaacgcgtacaaaatgcgatgtataacgcttcgcagcagctgcaacaaattcgcagtcgtctggatgggactgatgtcggcgagacagccttacgtcccagccagaaagtgttaatgcaggctcagcaggctttgctgaatgccgagattgaccagcagcgtaaaagcctggaagggaacacagtcttacaggataccttgcaaaagcaacgggattacgtgacggcgaacagcgcccgtctggagcaccagttgcagctgttgcaagaagcagtaaacagcaagcgcctgactttaaccgaaaaaacggcgcaggaagccgtctccccggatgaagccgcgcgtattcaggctaatccgctggtgaagcaggaactggaaattaaccagcagttaagtcagcgtctgattaccgcgactgaaaacggtaatcagttgatgcagcaaaacattaaagtcaaaaactggctggagcgggcgctgcaatcggaacgcaatattaaagagcagattgccgtcctgaagggcagtctgctgttgtcacgtatcctgtaccagcaacaacaaacactcccctcggcagatgaactggaaaacatgaccaaccgcatcgcggatttgcgtctcgaacagtttgaagtcaaccagcagcgtgacgcgctgttccagagcgatgcgttcgtcagcaaactggaagaaggtcacaccaacgaagtcaacagcgaagttcacgatgcattattgcaagtagttgatatgcgtcgcgaattgctggatcagcttaacaaacagttgggtaaccagctgatgatggccattaacctgcaaatcaaccagcagcagttaatgagtgtgtcgaaaaacctgaaatccatcctgacgcagcaaattttttgggtgaacagtaaccgcccgatggactgggactggattaaagcgttcccgcaaacgctgaaagatgaatttaagtcgatgaaaatcacggtgaactgggaaaaagcctggcccgccgtattcatcgccttcctcgctggtttgccgctgctgttgattgccgggctgattcactggcgtttaggctggctgaaagcatatcaacaaaaactggcttcggcggtaggttccctgcgtaacgatagccagctcaatacgccaaaagcgattcttattgacctaatccgcgcactgccggtgtgcctgattattctcgctgtcggcctgattctgctgactatgcagctcaatatcagcgagttattgtggtcgttcagcaaaaaactggcgattttctggctggtgtttggcctgtgctggaaagtgctggagaaaaacggtgttgccgtgcgtcactttggtatgccggaacagcagaccagccactggcgtcggcaaattgtccgcatcagcctcgcgttgctgccgatccatttctggtctgtggtggcagaactctccccgctgcatctgatggatgatgtgctggggcaggcgatgattttcttcaacctgctgctgattgccttcctggtgtggccgatgtgccgcgaaagctggcgtgataaagagtcgcacaccatgcgactggtcaccattaccgtgctgtcgattatcccgattgcgttgatggtgctgaccgccacgggttacttctacaccacgctgcgcctctccgggcgttggattgaaaccgtttatttggtgatcatctggaacctgctgtaccagacggtattgcgcggcttaagcgtagcggcgcggcgtatcgcctggcgtcgtgcactggcgcgtcggcagaatctggtgaaagagggcgcagaaggtgccgaaccgccggaagaacccaccattgcgctggagcaggttaaccagcagacgctgcgtattaccatgttgctgatgtttgcgctgttcggtgtcatgttctgggcaatttggtctgatttgatcaccgtgttcagctatctcgacagcattacgctctggcattacaacgctactgaagctggtgctgcggtggtgaaaaacgtcaccatgggcagtctgttgtttgcgattatcgcctcaatggtggcctgggcgttgattcgcaacctgcctggtttgctggaagtgctggtgctctcgcgactgaatatgcgccagggcgcgtcgtatgccattactaccatccttaactacatcattattgccgttggtgcgatgacggtgttcggatcgctgggcgtctcgtgggataaactccagtggctggcggcagcattatccgtaggtcttggttttggtttacaagagatcttcggtaacttcgtttccggtttgatcattctgttcgaacgtccggtgcgcataggcgacacggtaaccattggtagcttctcgggtacggtcagcaagatccgtattcgtgcgacaacgattaccgatttcgatcgcaaagaagtgattatcccgaacaaagcgtttgttaccgagcgtctgatcaactggtcgttaactgacacgactacgcgtctggtgatccgtctcggcgtagcctatggctccgatctggaaaaagtgcgtaaagtgttgctgaaggcggcgactgagcacccaagggtgatgcacgaaccaatgccggaagtcttctttacggcatttggtgccagcacgttggatcatgagctgcgtctgtatgtgcgtgaactgcgtgaccgtagccgtactgtcgatgagctgaaccgtactatcgatcagttgtgccgtgaaaacgacatcaacattgcctttaaccaacttgaagtgcatctgcacaacgagaagggcgatgaagtgacggaagtgaaacgcgactacaaaggcgacgatccgacgccagcggtagggtaataaccaaagggggcgacatttagttgccccgagattactaacaaagtgcgcgttgttcatgccggatgcggcgtgaccgccttatccggcctacgaaaccgcaagaattcaatatattgcaggagcggtgtaggcctgataagcgtagcgcatcaggcagttttgcgtttgcccacaatcttaggggacatttagcggccccatttatttctcacttttccgcctcatcatcgcgcgttaatttcttttcataatcgcgttttacaatatccagcgcgcgcagcacggtgcgggctgggatctgattttcttccagtagcacaatcaaatcgacggccagtttgacatcgtcaggggcattttccagtgacatactctctccattgctagcgggttaaacgcgctaacctgttttcgattttttccagcgcatggcggcagcgtgccaggcgcgcttcataggcttccacttcacgatgcagcgtctgctgttccacgagatcggtcgctcgtgccagacgggctctacgttcggcaaccatctcacgtagccgccgctcaaaatcctgatgctgaatacgtttacgctgccagcgggcaattttcggtggcgcactgtcccactcgcgtagcgaccaggctgtggcttcacgcgctatagcctccagttgcgccgccagatgttccgccagccaggcgacttgcggcagttgctgttgctcaacggcatgacgaagcgcagccagattatcgcccgcctcatcgagacaagcctgcagtgttgtcgcacgagtctgaaaaagatgcctgttaaaacgggcgcttagcgtggcaaattgcgctaccggggcacaacgctgacgcagcgtagcgagctgtccttccagtttttccagcagcagggcggttttcacgataagacctcaatgaaaatgataattgttatgctaaagtagccactctgtaagctgacaacactcaatatgcaacgaatcattttaatcatcattggctggctggcggtagtgctgggtacgctgggcgtggtattaccggtattaccgacgacgccgtttatcctgctggcggcctggtgctttgcccgttcttccccgcgctttcacgcctggttgctgtaccgctcatggtttggcagctatctacgtttctggcagaaacatcatgcgatgccgcgcggcgcaaaaccacgggcgattttgcttattttgattacgtttacgatttcgctgtggttcgtccagatgccgtgggtgcgcatcatgttgctggtaattctcgcctgtttgcttttttatatgtggcgaattccggtgattgatgaaaagcaagaaaagcactgaagcacaacaatcgcagttgcaattattgcgtacagccagtacattctggcgttttcgagcacaggcgcaggcggtcaaaggttaaacaactgttacttttgatacgttcaaaacgcgccgtgagtaccaccgtaacaagcaggcatacacttatgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagtggtcggcaccgaagcgcgtggcttcttgtttggcgctccggtagctctgggtctgggcgttggctttgtaccggtccgtaaaccgggcaaactgccgcgtgaaaccatcagtgaaacttacgacctggaatacggcaccgatcagctggaaatccacgttgatgccatcaaaccgggcgataaagttctggtggtggacgatctgctggcaaccggcggcactatcgaagcgaccgttaaactgatccgtcgtctgggtggtgaagtagctgacgctgcgttcattatcaacctgttcgatctcggcggcgaacagcgtctcgaaaaacagggcattaccagctacagccttgtcccgttcccgggccattaattatcgtcagtcttgcgctgctcacgctacgggcagcacaagatgtgcattcagcctcgccgttctgacggggctgtgttagcattaccccttcgtgaatccaccttccagcgtttcagagcctgccaatgagttatcaggtcttagcccgaaaatggcgcccacaaacctttgctgacgtcgtcggccaggaacatgtgctgaccgcactggcgaacggcttgtcgttagggcgtattcatcatgcttatcttttttccggcacccgtggcgtcggaaaaacctctatcgcccgactgctggcgaaggggctaaactgcgaaactggcattaccgcgacgccgtgcggcgtgtgcgataactgtcgtgaaatcgagcaggggcgctttgtcgatctgattgaaatcgacgccgcctcgcgcaccaaagttgaagacactcgtgacctgctggataacgtccagtacgcgccagcgcgtggtcgttttaaagtttatctgatcgacgaagtgcatatgctgtcgcgccacagctttaacgcactgttaaaaacccttgaagaaccgccggagcacgtcaagtttctgctggcgacgaccgatccgcagaaattgccggtgacgattttgtcacgctgtctgcaatttcatctcaaagcgctggatgtcgagcaaattcgccatcagcttgagcacatcctcaacgaagaacatatcgctcacgagccacgggcgctgcaattgctggcacgcgccgctgaaggcagcctgcgagatgccttaagtctgaccgaccaggcgattgccagcggtgacggccaggtttcaacccaggccgtcagtgcgatgctgggtacgcttgacgacgatcaggcgctgtcgctggttgaagcgatggtcgaggccaacggcgagcgcgtaatggcgctgattaatgaagccgctgcccgtggtatcgagtgggaagcgttgctggtggaaatgctcggtctgttgcatcgtattgcgatggtacaactttcgcctgctgcacttggcaacgacatggccgccatcgagctgcggatgcgtgaactggcgcgcaccataccgccgacggatattcagctttactatcagacgctgttgattggtcgcaaagaattaccgtatgcgccagaccgccgtatgggtgttgagatgacgctgctgcgcgcgctggcgttccatccgcgtatgcctctgcctgagccagaagtgccacgccagtcctttgcgcccgttgcgccaacggcagtaatgacgccaacacaggtgccgccgcaaccgcaatcagcgccgcagcaggcaccgactgtaccgctcccggaaaccaccagccaggtgctggcggcgcgccagcagttgcagcgcgtgcagggagcaaccaaagcaaaaaagagtgaaccggcagccgctacccgcgcgcggccggtgaataacgctgcgctggaaagactggcttcggtcaccgatcgcgttcaggcgcgcccggtgccatcggcgctggaaaaagcgccagccaaaaaagaagcgtatcgctggaaggcgaccactccagtgatgcagcaaaaagaagtggtcgccacgccgaaggcgctgaaaaaagcgctggaacatgaaaaaacgccggaactggcggcgaagctggcggcagaagccattgagcgcgacccgtgggcggctcaggtgagtcaactttcgctaccaaaactggtcgaacaggtggcgttaaatgcctggaaagaggagagcgacaacgcagtatgtctgcatttgcgctcctctcagcggcatttgaacaaccgcggcgcacagcaaaaactggctgaagcgttgagcacgttaaaaggttcaacggttgaactgactatcgttgaagatgataatcccgcggtgcgtacgccgctggaatggcgtcaggcgatatacgaagaaaaacttgcgcaggcgcgcgagtccattattgcggataataatattcagaccctgcgtcgattcttcgatgcggagctggatgaagaaagtatccgccccatttgatcgtaagcacagcttacgttcgtcatccttaacgtgattgagagagaaacctatgtttggtaaaggcggtctgggtaacctgatgaagcaagcccagcagatgcaagaaaaaatgcagaaaatgcaggaagagatcgcgcagctggaagtcaccggcgaatctggcgcaggtctggtaaaagtgaccatcaacggtgcacacaactgccgtcgcgtagagatcgacccgagcctgctggaagacgacaaagagatgctggaagacctggtggctgcagcattcaacgacgcagcacgtcgtattgaagaaacgcagaaagaaaaaatggcctctgtatcctccggaatgcagctgccgcctggctttaagatgccattctgatgcaaaccagcccgctgttaacacagcttatggaagcactgcgctgtctgccgggcgttggcccgaagtcggcgcagcgtatggcgttcacgctgcttcagcgcgatcgtagcggcgggatgcgtctggcgcaggcgctcacccgggcgatgtcggaaatcggtcactgcgccgattgccgcaccttcaccgaacaggaagtctgtaacatctgttcgaatccacgtcgtcaggaaaacggtcaaatctgcgtggtggagagtccggcggacatttacgccattgagcagacggggcagttttcaggtcgttattttgtgttgatgggacacctgtcaccgctggacggcatcggtcctgatgatatcgggcttgatcgtctggaacagcgtctggcagaggaaaaaatcactgaagtgatcctcgccaccaaccccacggttgaaggtgaagctaccgctaactacattgccgagctttgtgcgcaatatgacgtggaagccagccgaatcgctcatggcgtaccggttggcggcgaactggaaatggtcgatggcaccacgctgtcacactcccttgccgggcgtcataagattcgtttttaagcaaacgagagcaggatcacctgctctcgcttgaaattattctcccttgtccccatctctccctcatcctgtttttaaccttaaaatggcattattgaggtagacctacatgaaaggacaagaaactcgtggttttcagtcagaagtgaaacagcttctgcacctgatgatccattctctctattccaataaagaaatcttcctgcgtgagcttatctctaacgcctccgatgcggcggacaagctgcgtttccgcgcgctttctaacccggacctgtacgaaggtgatggtgaactacgcgttcgtgtctctttcgataaagacaagcgcacgctgaccatctccgataacggcgtggggatgacccgcgacgaagtgattgaccatctggggactatcgctaaatccggcaccaaatcattcctcgaatccctgggttctgaccaggcgaaagacagccagctgatcggtcagtttggtgttggtttctactctgcgtttatcgtggctgacaaagtgaccgtgcgtactcgcgcggcaggcgaaaaaccagaaaacggcgtcttctgggaatcggctggcgaaggtgaatacaccgttgccgacatcactaaagaagatcgtggtactgaaatcaccctgcatctgcgtgaaggcgaagacgagttcctcgatgactggcgtgtgcgttccatcatcagcaaatattccgaccatatcgcgctgccggtagagatcgaaaaacgcgaagagaaagacggcgaaaccgttatctcctgggagaaaatcaacaaagcgcaggcgctgtggactcgtaacaagtcggaaatcaccgatgaagagtacaaagagttctacaaacacatcgcccacgactttaacgagccgctgacctggagccacaaccgcgttgaaggtaagcaggagtacaccagcctgctgtacattccgtctcaggcaccgtgggatatgtggaaccgcgatcataaacacggtctgaaactgtatgttcagcgtgtgttcatcatggacgacgcagaacagttcatgccgaactatctgcgcttcgtgcgtggtctgattgactccagcgatctgccgctgaacgtttcccgtgaaatcctccaggacagcacggtaacgcgtaacctgcgcaatgcgctgaccaagcgtgtgctgcaaatgctggaaaaactggcgaaagacgacgcggaaaaataccagaccttctggcaacagtttggcctggtactgaaagaaggtccggcggaagatttcgctaaccaggaagcgatcgccaaactgctgcgttttgcttctacccataccgattcttctgcgcagaccgtgtctctggaagactacgtttcccgcatgaaagaagggcaggagaaaatctactatatcaccgcagacagttacgcggcagcgaagagcagcccgcacctggaactgctgcgtaagaaaggcatcgaagttctgctgctttccgaccgcatcgatgagtggatgatgaactatctgactgagttcgacggtaaaccgttccagtctgtgtctaaagttgacgagtcgctggaaaaactggctgacgaagttgatgagagcgcgaaagaagcggagaaagcactgactccgttcatcgaccgtgtgaaagccctgctcggcgagcgcgtgaaagatgtccgtctgactcaccgtctgaccgatacgccagcgatcgtttcgaccgacgcggacgaaatgagcactcagatggcgaaactgttcgctgcggcgggccagaaagtgccagaagtgaaatacatcttcgaactgaacccggatcacgtactggtgaaacgtgcggcggatactgaagatgaagcgaagttcagcgagtgggtagaactgctgctggatcaggcgctgctggcagaacgcggcacgctggaagatccgaacctgtttattcgtcgtatgaaccagctgctggtttcctgatgtcatgccggatgaccttcgtgtcatccggcatttttcttttcttcatctgcactttccgcaaattatcttgccattaaccgtttcagcctcaggtgcctttcttgaggcaatcgcctgttggtggtatcgtttatcgctttttcaaaaaattcgacacattttaaggggattttcgcaatgcgtatcattctgcttggcgctccgggcgcggggaaagggactcaggctcagttcatcatggagaaatatggtattccgcaaatctccactggcgatatgctgcgtgctgcggtcaaatctggctccgagctgggtaaacaagcaaaagacattatggatgctggcaaactggtcaccgacgaactggtgatcgcgctggttaaagagcgcattgctcaggaagactgccgctacggtttcctgttggacggcttcccgcgtaccattccgcaggcagacgcgatgaaagaagcgggcatcaatgttgattacgttctggaattcgacgtaccggacgaactgattgttgaccgtatcgtaggccgccgcgttcacgcgccgtctggtcgtgtttatcacgttaaattcaatccgccgaaagtagaaggcaaagacgacgttaccggtgaagagctgactacccgtaaagacgatcaggaagagaccgtacgtaaacgtctggttgaataccatcagatgactgcaccgctgatcggctactactccaaagaagcggaagcgggtaacaccaaatacgcgaaagttgacggcaccaagccggtggctgaagttcgcgcagctctggaaaaaattctcggctaatcaagccgccgcagatctgctctcgggcaggtctgctcatcctcctcaggcaatacctcttacagcaattagttcttcttcttcacttttccgctacaattatcaacaagttgaatcgataagaggcggtaatgcgtcaaactaaaaccggtatcctgctggcaaatctgggtacgcctgatgcccccacacctgaagcggtaaaacgctatctgaaacaatttttaagcgacagacgcgtggttgatacctcacggttgttatggtggccgttgctgcgcggcgtgattttgccgctgcgttcgccgcgtgtggcgaagctgtatgcctctgtctggatggaaggtggctcgccgctgatggtttacagccgccagcaacagcaggcgctggcgcaacgtttaccggagacgcccgtggcgctgggaatgagctacggttcgccatcactggaaagcgccgtagatgaacttctggcagagcatgtagatcatattgtggtgctgccgctttatccgcaatactcctgttcaacggtcggtgcggtatgggatgaactggcacgcattctggcgcgcaaacgtagcattccggggatatcgtttattcgtgattacgcagataaccacgattatattaatgcactggcgaacagcgtacgtgcttcttttgccaaacatggcgaaccggatctgctgttgctctcttatcatggcattccccagcgttatgcagatgaaggcgatgattacccgcaacgttgccgcacaacaactcgcgaactcgcttccgcactggagatggcaccggaaaaagtgatgatgacctttcagtcgcgctttggtcgggaaccctggctgatgccttataccgacgaaacgctgaaaatgctcggagaaaaaggcgtgggtcatattcaggtgatgtgcccgggctttgctgcggattgtctggagacgctggaagagattgccgagcaaaaccgtgaggtcttcctcggtgcgggcgggaaaaaatatgaatatattccggcgcttaatgccacgccggaacatatcgaaatgatggctaatcttgttgccgcgtatcgctaaagctgagcggtaaagaactgagcgccgtcgcgaagagcctcgtcggcggttttcatcatccgtgaataatgcaaaaaggcgtgcagcataccggagtagagtttgaactcacaaggttgctggtgtgccgctaacgtctggtaaagcagacagctgtcatccagcagtggatcgaactccgccccggcaataaaacagggcggaacttcgcgagtgagatcattattaaacaggcagtaatatggcgactcgcggtccgcgtcgttgcttaaatacgcctcttcatacatctgcaaatcctgttgcgttaagccatcccagacaccacccaacagacgacgagtcacggaatcccgtaatccgtaaagcccataccacagcaaaacgcccgcaactttaccgcaatcgatctgtttatcgcgcaaccacaacgcactggcgagcgccagcatggcacctgcggaatcaccagcaaaaccaatgcgggacatattgatttgataatcctccgcctgctggtggaaataacaacaggcagccacaatttcctctatcgcttgcggaaaacgcgcttcaggtgaaagggtgtaatcaatgccaatcaccgtacattggctgtagcttgccagcaggcgcatgatgcgatcgtgggtatcgagattgccgagaataaaaccgcctccatgcaaataaaatagcgtcgccgggctatctggctgcggataaaagagacgtgttttcacctgcccatattttgttggaaccctgtaagctctggttgccatttctggagcgcccacattccagaatcggcgctcaagcgtgtaatactgtcgttgctcagcaatcgctcccgttgcaggccagggcggtaaatccggctgaagagtattcacaacggtcttcatttcagcagagataaggtccagaacgggtaatttgttttccggcttcatgcaaaaattcctttcaaattacgtcattgtaaggaaccactgccatgaaaatgcgatcccgcctgctgatattgaaactggctgcgtctcgcgcgctcccgtcagattgtgttaacattcgccgctcagttaaccacccgtaaaaacaaccatgaaatttcccggtaaacgtaaatccaaacattacttccccgtaaacgcacgcgatccgctgcttcagcaattccagccagaaaacgaaaccagcgctgcctgggtagtgggtatcgatcaaacgctggtcgatattgaagcgaaagtggatgatgaattcattgagcgttatggattaagcgccgggcattcactggtgattgaggatgacgttgccgaagcgctttatcaggaactaaaacagaaaaacctgattacccatcagtttgcgggtggcaccattggtaacaccatgcacaactactcggtgctcgcggacgaccgttcggtgctgctgggcgtcatgtgcagcaatattgaaattggcagctacgcctatcgttacctgtgtaacacctccagccgtaccgatcttaactatctacaaggcgtggatggcccgattggtcgttgctttacgctgattggcgagtccggggaacgtacctttgctatcagcccgggccacatgaaccagctgcgggctgaaagtattccggaagatgtgattgccggagcctcggcactggttctcacctcttatctggtgcgttgcaagccgggtgaacccatgccggaagcaaccatgaaagccattgagtacgcgaagaaatataacgtaccggtggtgctgacgctgggcaccaagtttgtcattgccgagaatccgcagtggtggcagcaattcctcaaagaccacgtctctatccttgcgatgaacgaagatgaagccgaagcgttgaccggagaaagcgatccgttgttggcatctgacaaggcgctggactgggtagatctggtgctgtgcaccgccgggccaatcggcttgtatatggcgggctttaccgaagacgaagcgaaacgtaaaacccagcatccgctgctgccgggtgctatagcggaatttaaccagtatgagtttagccgcgccatgcgccacaaggattgccagaatccgctgcgtgtctattcgcacattgcgccgtacatgggcgggccggaaaaaatcatgaacactaatggagcaggggatggcgcactggcagcgttgctgcatgacattaccgccaacagctaccaccgtagcaacgtaccaaactccagcaaacataaattcacctggttaacttattcatcgttagcgcaggtgtgtaaatatgctaaccgtgtgagctatcaggtactgaaccagcattcacctcgtttaacgcgcggcttgccggagcgtgaagacagcctggaagagtcttactgggatcgttaagttatcgtcggttcgtaggccagataaggcgttcacgccgcatctggcattttgctctcaatgcctgatgcgacgctggcgcgtcttatcaggcctacatatccgcgcctattatccggcaaccaccgtttacctcgtcaccacctcacccgccggtggcgtttccagcagttccagcatagtacgggcaatttcacgctcacccatcactacctgattcgcaccacgttcggtgatatacgccacttcatcgtcataatgggcgcgggcaataatctcaatatccggatttttcgcgcgggcagatgccacaatctcgcccgcttcatagccgttgggaatcgtcaggatcagccattttgcacattccagatgcgccagttgcataatttcttcgttagccgcattgcccaatactgcgcggaccccgcgctcgcgcagctcatcaacacgggttcgtgacgtctcaatcaccaccagcggaatatcagaggcgagcaatttctcccccagcaggctgcctacacgaccgtaacccaccagtagcgcatggttgcaaatatccactgggatctgcttctcttcttcgattgcctcttccagcgtctgctcttccagcgtttcggtcttcgccagatatttctccagtagtgcgaacagtaccgggttgagcataatcgacaggatcgcccctgccagtaccaggttttgtccggcctgcggcagtaaattcaatgccattcctagtcccgccaggataaacgcgaactcaccaatctgcgccaggctggcggcgatggttaacgccgtgcgctgggagtgaccaaacaaacgcacaaggaacagggccgcgaccgatttaccaaacagaataattgccagcgtcgccagtactgccagcggttgctgaatcagaattaacggatcaaacaacatcccgacggagacaaaaaacagcaccgcaaacgcgtcgcgcaatggcagtgtatcgtgggcggcacggtgactcagttcagactcgttcagtaccatcccggcaaagaacgcaccgagtgcaaaggagacatcaaacagctctaccgcaccaaaggcaatccctaacgccagcgccagcaccgacagggtaaacagctcgcgggaaccggttgctgcgctgcgtgccataatccacggcaccagacggcgacctaccagcatcataatggcgataaatgcgatcaccttgccgatggtgatccccatatcgactgcaagagtggcaaagcccacatcgccctgttccatcattcctgctaccgcgggtagcaataccagcgtcaggaccatcaccaggtcttccacaatcaaccaaccgatggcgatttgcccacgctgactgtcaattaattgccgttcttcaagtgcgcgcagtaacaccacggtactggcggtggaaagacataagccgaacacgataccggtcattaacgaccagcccagcacggcggagagcgccatacccagcagcgtcgccacggctatctgggcgatcgcgccgggaatggcgatggactttaccgccatcaaatccttgagcgaaaaatgcaaaccgacgccgaacatcagcaaaataacgcccagttcagccagttccggcgcaagcttggtatcggcaacaaagcccggagtgaatggtcctgccagcacacccgctaacagatatcccaccagaggagaaatacgtagtttattggccagcatgccgaggataaaggcgagcacaaggccgccaacaatggtggtgataagcggggtggcgtgatgcattccgtctccttttcctggtggttattgtccatttttggccgggaaaaccaaaattacaggtaatagtttatgacaatttcattgatgatgtttatgaataattgttgaattttgcagaaaaatggaattagctgcaaaaaaaagcacggatcggaaaacagaaggcggtttaacagaggaaaggcttatggcgactgtaaaacgatgcagccaaagtttgcctttggctgcaatgaaatcagtctttatgccggttatcaggcaggaatatggtcaatatccccaatagtggcaggaaagcacagattttatagactaactctatgctggtgtggtcggcgataagccccagaactgccgcccccagacctcccatgccgaaagcaaaaccgaaaaacagtccagaaaccataccgatacgtcccggaagcagctcctgggcgtagaccagaatggcagagaatgctgaagcgaggataaatccaataatcaccgttaaaacccccgtccagtgcaggctggcgtagggtaaaatcagcgtaaacggcgcaacaccgaggatagagccccaaatcacatatttccgtccaattttatcccctacaggcccgccaatcaccgtacctgccgcaacggcaaacaggaaggcaaacaaatgaagctgagcattctggatagataatccgaatttttgcatcagataaaaggtgtaatagctgctgatgctcgccatatagaaatatttcgagaaaatgaggattaacagaatgctgaccgccagaacaactttattgcgcggcagtggattgataatcgtcgctttgggttttcctttattcattcggtgctgtgccgagtaccaacggctgatttgcgccaacaccacgatcgccagcagtgccgcaagcacaaaccaggcaacgttgcctttgccataaggcgcgataatcaccgccgccagcaaggggcccagggaactgccaaagttgccgccgacctgaaatatagattgcgccaggccatgacgcccgccggaagccatacgggccacgcgagaagattccggatgaaagaccgatgaaccggtaccgaccagcgccgctgccagcagaactgcgccgaaactgcccgccagcgccagcagcaccagaccacttaaggtaaagcacatgccaatcggcaacgaccacggcatcggatatttatcggtccagtagccgaccaccggttgcagtagcgaagaggcgagctggaaggtgagggttatcatgccaatctgcataaatgtcagagaaaattctgactgaagcagtggataaatcgccagaatcagcgattggatcatgtcgttcagcagatgtgagaggctgatagcacctaaaataccaaacgatgttcgggccttagtcgttgacgcagccgcgcccgccacaggctgggtttgttcactcattgccataggaaagtcactttttcagggttgcgatgtaaagaatgatcttatttgtgattattacccgactaacatacctgtatgcgccgcctgaaggaagtctcaacgcggaatacagaatttctaatctggatgcagatttatcttcaccggacgcagacttgtctatgatgtcgcgtcatactatttttcaacacgttgaaatcaggtcagggagagaagtatgaaattattacagcggggcgtggcgttagcactgttaaccacatttacactggcgagtgaaactgctctggcgtacgagcaggataaaacctacaaaattacagttctgcacaccaatgatcatcatgggcatttttggcgcaatgaatatggtgaatatggtctggcggcgcaaaaaacgctggtggatggtatccgcaaagaggttgcggctgaaggcggtagcgtgctgctactttccggtggcgacattaacactggcgtgcccgagtccgacttacaggatgccgaacctgattttcgcggtatgaatctggtgggctatgacgcgatggcgatcggtaatcatgaatttgataacccgctcaccgtattacgccagcaggaaaagtgggctaagttcccgttgctttccgccaatatctaccagaaaagtaccggcgagcgcctgtttaaaccatgggcgctgtttaagcgtcaggatctgaaaattgccgttattggcctgacgacggatgacacagccaaaattggtaatccggaatatttcactgatatcgaatttcgtaagcccgctgatgaagcgaagctggtgattcaggagctgcaacagacagaaaagccagacattattatcgcggcgacctatatggggcattacgacaatggtgagcacggctctaacgcaccgggcgatgtggagatggtacgcgcgctgcctgccggatcgctggcgatgatcgtcggtggtcactcgcaagatccagtctgtatggcggcagaaaacaaaaaacaggtcgattacgtgccgggtacgccatgcaaaccggatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctgtacacccctgaaatcgctgaaaaccagcaaatgatctcgctgttatcaccgttccagaacaaaggcaaagcgcagctggaagtgaaaataggcgaaaccaatggtcgtctggaaggcgatcgtgacaaagtacgttttgtacagaccaatatggggcggttgattctggcagcacaaatggatcgcactggtgccgactttgcggtgatgagcggaggcggaattcgtgattctatcgaagcaggtgatatcagctataaaaacgtactgaaagtgcagccattcggcaatgtggtggtgtatgccgacatgaccggtaaagaggtgattgattacttgaccgccgtcgcgcagatgaagccagattcaggtgcctacccgcaatttgccaacgttagctttgtggcgaaagacggtaaactgaacgacctgaaaatcaaaggcgaaccggtcgatccggcgaaaacttaccgcatggcgacattaaacttcaatgccaccggcggggatggctatccgcgccttgataacaaaccgggctatgtgaataccggctttattgatgccgaagtgctgaaagcgtatatacagaaaagctcgccgctggatgtgagtgtttatgaaccgaaaggtgaggtgagctggcagtaatgaaccccgtcgcggcgtcatgatatgacgccgccatttatgaatattgaaatcttgcatcgtaatcgcgatgtgtcaaaccaaatgccatcagcatataattctgcggatcaccaggctgttcttcatctgcttcaaaccaaagtgtcacgcctgagcgattgacgtggattaagagtgtatggggcgattgacggcggatttgcagatcagcgccttcgttaacaagcatgttaaatacacgcgtaacgttcaactcagcgacgttattcaatattcctttatcaaatcggatcgctttgcccaaatggatttggctcagataatcgcaccaaatcatatatagcttgttgttttcgaaatgaaactcaacattaccaaatagccagatataaaaaccatttcccatatcatttttagagtccggctcaacaaagttttgttccaaccatgccattgtttgccccagttcgacaaaatcgaattttccgttaaagacaaaattgtggaagctaacatcaacaagatggtcaaatttcatctttcgctcctttgtgaattttttacatgcttcaaaagccagcgtaatttacatcggtgcaggcgactctccagtgttgagcgaaaatttgcgatgtcgacattggaccgatctaccgcagcaacccccgtgtattgtgggatcggtgaagggattttttgtaactttcccagcgccagcagttgttgaatgatcctgctaccgtcgtggtaatcatcgtaaatagccactggcagaggctgccaggcgggggtcgatttgataaatccggaaaaaaaatacgggtccagatcgccgaaagcaaagccgtaggcgaggggaacttcaatattttgctctgtttttttattctcaaatgtacaatgaaaaccgtgaaaacaatactgccactttcccattttgccttttcgcttacggttgcatttgaagggggcaaaggtaactagcgggttattttccgccatctcaacgttcagttgttcagccaatgcaaatataagctctgtcgccagcttacgatattctttcgcgcagtgttcgaaaaaatcctgatggcggttaatctcttcaagcgatattaatctggcgatcctgataaccgggtcggcagaatgcatgccaacaacaaattcatcgagctgtgctttcagcaccagcccgaattcctcacgatacctctctgcttcgctggcaaaatgcagatgtaataccttctctctcgatgtttgccgaagtaaggcgatatccggtatctcatctgcacaagcgatacttaatgtctctgtaatcctttccacatctcatcttccgtgtgcatcacttaatcgcgacgggcgatatcagcaaatttggcatcgagtatctttgccaggtcgcttgccgccagttcgatatccagaccgcgcttgccgccggaaacataaatagtggcaaattcttgtgcgggggcgtcgataatcgttggcagacgttttttctgccccagtgggctaatccctccaaccagatatcccgtcgaacgctgcgcgaccatcggatcggccatctcaactttcttggcacccagcgcttttgctacttttttaagatccagttgacctgcgaccggcgtaacggccacggcaaggtgtttcatatcaccgttcactgcgaccagcagcgttttgtagacctgatccggattcaaacctaattttttgacgacttcatcgccaaaattggtttcagccggatcgtgctcgtaggtatggatttgaaacgaaatcttgtttttttcgagtaatttaactgcgggtgtcatggtaattttcctgccttaaacaaaaaaacgaagcaagcatacgcctgatggcggtccaaaaaaaagagtcatcttgcctaagagtattggcaggatggtgagattgagcgacaatcgagttacaccgtcgcttaaagtgacggcataataataaaaaaatgaaattcctctttgacgggccaatagcgatattggccatttttttagcgcaacatctgcggcaaattcccttctccatacaggtgtagtgcaccgactgcgaccacatagcgccccggcggcatggcgcgtaatttatcccgccaggcgagatttcgctgatgcatcagcacatcgtacagcgactgactgaacgtattgggcagcgttatttcattattttgcggcggcgcattcaaccaccagctcatcatttgttgcagcaaccgtgcattggtgtgccagtgggtcagcgtgtcgtccagcagcgccagtcctttgtcagggagctggagcaacatggcaatctggttttcagccccttccagttcaatcacgggtttatgttgttgcttcgccgcctgcaatagctggtaatcgataccgtattctgcccgcagccccagtttttgtgcctgcgtcgcctgaagaaccatcgcgatttgccacaacggttgggtagaaaagagcgacggagaaatgcccatctcctggctaatgtgctgcaggttttggagttgctcctcgctaatgcgctcttccagtgcctcgcaggcaggcaaattggcaaaaggcgtatcgctggtggaaacatccgcctcgacgatcagcgcatcggcgtttttgagctttttgagcaaacgggtgggcaggggagccatatcgtggctacccatatgaatactgccaatcagatgaaaatggcgattgccgggaagagtgatatcgatagcaggccaggtgtaatgattaccgcgcagcgcggcccaaagcgtttttacccggtacaacagatccatacgacctccctttgtgaaatatcatgctagcgcgcggggagggatggcgcaaatggagttgattgttgcacttgcgcacagtgcttgtgtgcattacaatgattgaataatggacaaggagatgagagaggaatggctcaaaagaaaaatataaggagttttcgtgatgcctggttggctgatttttttgtccattcaacgccacatcgaaagatccctgctgaaatccataccacgttatcacgaaagttggacatcattaatgctgccacttctcattgggatttacgctcccctccggggaaccgatacgaagagttatccgggaaattacaggaatactcctccattagagtgaataaacagtaccgactgatttttaaatgggttaatggcaaggccgaagaattgtttttagacccacacaactactaaaacatagctgtcgtattgacgagaaaggtaaaactatgaaacaggcaacaagaaaaccgacgacacccggagatattcttctctatgaatatctggaaccgctcgatttgaaaatcaatgagttagcagagttgctgcatgttcatcgtaatagcgtcagtgcactgatcaataacaatcgtaaactcaccactgagatggcattccgtctggcgaaagtttttgataccacagtcgatttttggctaaacctccaggcggcagttgatctttgggaagttgaaaacaacatgcgtacccaggaagaattgggacggattgaaacagtggctgaatatttggcacgccgtgaagagcgtgcaaaaaaggtcgcgtagaataatttccctataacggatgcgccaccctaaagcagcgcatccgcaatgatgtacttattccttcggtttaaaccgcagcaagcggttggcgttactcactacggtgatcgacgagagcgccattgccgctccggcaaccaccgggttaagcagtgttccagtgaacggccacaaaataccggcggcgaccggaataccaatgctgttgtagataaacgcaccgagcaggttctgcttcatgttgcgcagcgttgcgcgggaaattgcgagcgcatccgcaacacccatcaggctatggcgcatcagggtaatcgccgcggtttcaatggcaacatcactgccgccccccatcgcaataccgacatccgcctgagccagcgctggcgcatcgttaatgccgtcgcccaccattgctacctgacgtccttcactttgcagacgtttgatcgcttcggctttaccgtccggcagcacgccggctatcacctcatcaatccctgcttctttagcgatcgcattggcggtggtcgggttatccccggttagcatcaccaggcgatatcccgctttatgcaggcgttgcagcgccgccacgctatcactacgcaatggatcgcgtacagccagcagggctaccgctttcccgtcaaccgccagcagcacaggcgttgccccttgcgatgcctgagcagtaatctccgcttcgatagctttggtatcaacctgttgctcatttaacaacgcctgattacccagcaataacgcatgaccttcagcttcaccgctcacgcccagcccgcgcaatgtgcggaaaccgttgacctgcggcagctgcatatcacctgctttatcgaggatcgctcgtgccagcggatggctggaaccttgctccagcgccgccgccagacgcaatgcttgcgcttcatcaacatcagcaaacgtttttactgcgacaacctgcggtttaccttcggtcagcgtcccggttttatcgaacactacggtgtcgagcgtactggcgcgttgcagcgcgtcggcgtcccgtaccagcacgccaaactcagccgcccgcccgacgcccgaaataatcgacatcggcgtcgccagccccagcgcacacggacaggcaataatcagcaccgtggtggcaatcaccagggtgtagacaatctgcggtgccggaccaaagaaataccagattgccgcactgatcagcgcaatcaccaccactaccggcacaaatacggctgagattttatccgccagctgaccgatttctggcttactgctctgggcctggcgcaccatacgaataatccgcgacagcgtagtatggctgccaaccgcactggcgcgaaacagcacgctaccgtcctgcaccactgtcccggcatggacgctatcgccttcgcctttttgctgcgggataggttcgcccgtcagcatcgcttcatccagccacgcttcgccttgagtaatctcaccatctaccggcacacggtcgccggtcgtcaggcgcagtaacatacctggctgaacatctgccagcggcacgtttttttcaccttcgtcggtgaccaggcgcgccgtcggtggggttaaatcgagtaatttctccagcgccttagaagaacgctgacgcgcgcgcgcttccagcatatggccgagattgatcagaccaataatcatcgcgctggcttcgtaataaagatgtcgcgcttccatcgggaaccactgcggccacaggttgacgctcatcgaatagagccacgccacgccagtacccagcgccaccagcgtatccatcgtcgctgcaccgttcagcaggcttttccatgcgctgcggtaaaaatgcccgccggcgaaaaccattaccgccagggttatcaggccgataaccaaccacaggctgcggttgtcggcggtgaccatcatgttatcgccgatcatcccccagaccatcaccgggatacccaccgccagtgcgacaattgcctgccagcggaagcgcttcatcgtagcgacggcggtttcttgctggcgttcgcggcgtttagcgtcatcttcaatcgcttccgcgccgtagcccgctttttccaccgcctgcactaaatcttgtggggaggcgctgcccatcaccagcgcagtacgctccgccaggtttacccgtgcctgagtgacgcccggtacgctttgcaacgcattttgtacgcgggtgacacagctggcgcagctcatgccgctcagcagcaactgctggctgtcatcgtcatcggcggtcgctgccggaagcgcctcagaaaccgctgtcagtgcttccgacgggattgatgactccgccagcggtttagcctttgggtggcttacagatgcgtcataacccgcttgtttgatggtttcgatcagctgttctgcactggcagtcccggtaacgtgcgcttcagtgatagacacatccgcctgttcaacatccgggcgctgttcgagactttctttcacgcgtttaacgcagtgaccgcaggacaggccgtccagggtcaggtcgatagtttgtgacataaaacactcctttaagacagttttgactggctgtgataaaggttaaaccttccagcaaggggaaggtcaagaaattaataaaccaggcgggtaaaagtccgtaaagattaaaaaatcggctcgatttgcatcaggattagacatttatctctttgttttcctgtagttaagttgcgggtgctaagttaaatcaggatgcatgaaaatcggcaccggggtgaggaattacctcacgcatctataaaaaggagttaacaaaagatgttagatgcaaacaaattacagcaggcagtggatcagacttacacccaatttcactcacttaacggcggacaaaatgccgattacattccctttctggcgaatgtccctggtcaactggcggcagtggctatcgtgaccagcgatggcaacgtctatagtgcgggtgacagtgattaccgctttgcgctggaatccatctcgaaagtctgtacgttagcccttgcgttagaagatgtcggcccgcaggcggtacaggacaaagttggcgctgacccgaccggattgccctttaactcagttatcgccttagagttgcatggcggcaaaccgctttcgccactggtaaatgctggcgctattgccaccaccagcctgattaacgctgaaaatactgaacaacgctggcagcgaattttacatatccaacaacaactggctggtgagcaggtagcgctctctgatgaagtcaaccagtcggaacaaacaaccaacttccataaccgggccattgcctggctgctgtactccgccggatatctctattgtgatgcaatggaagcctgtgacgtgtacacccgtcagtgctccacgctcatcaatactattgaactggcaacgcttggcgcgacgctggcggcgggtggtgtgaatccgctgacgcataaacgcgttcttcaggccgacaatgtgccgtacattctggccgaaatgatgatggaagggctgtatggtcgctccggtgactgggcgtatcgcgttggtttaccgggcaaaagcggtgtaggtggcggtattctggcggtcgttcctggcgtgatgggaattgccgcgttttcaccaccgctggatgaagaaggcaacagtgttcgcggtcaaaaaatggtggcatcggtcgctaagcaactcggctataacgtgtttaagggctgatcatgatgaacacggaaggtaataacggtaacaaacctctcggtctatggaacgtcgtttccatcggcattggggcaatggtgggggcggggatcttcgcgctgctggggcaggctgcgttgctaatggaagcctcgacctgggtcgcctttgcttttggcggtattgtggcgatgttttccggttatgcctatgcgcgtctgggggcgagctatcccagcaatggcggtattatcgacttctttcgtcgcggattaggcaacggcgttttttcgctggcgctctcgttattgtacctgttgacgctggcggtgagtatcgccatggtcgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtttctgcgccccccagttccggggcgttcttctcctgtatcgggataaccttccttgcctatgcgggctttggcatgatggcgaacgcggcggataaagtgaaagatccggaggtcataatgccacgggcgtttctggtggcgattggcgttaccacgttgctttatatctcgctggcgctggttttgcttagcgatgtgtcggcattagagttagaaaaatatgccgataccgccgtagcgcaggctgcttctccgctcctcgggcatgtggggtatgtgatcgtcgtcatcggcgctttactggcgacggcttcagccatcaacgcaaacctgttcgccgtgtttaacatcatggacaacatgggcagcgaacgcgaactgccgaagctaatgaataaacctctgtggcggcagagtacctggggcaacatcatcgtcgtggtgttgattatgctgatgacggcggcgctgaatttaggctcactcgccagcgttgccagcgccacctttttgatctgctatctggcggtgtttgtggtggcgatccgcctgcgtcatgatattcacgcctcgttgccgattcttatcgttggtacgttggttatgttgttggtgatcgttggctttatctacagtctctggtcccagggcagccgtgcgctgatatggattattggcgcactcttactcagccttattgtggcaatggtcatgaagcgcaataaaaccgtataacatctctctgtgcgcagtacttcctgtattattgtggtggcggtcgatattcgcactggcaaaaaaacgtgcttgaatatttgttgaaaccctttaacaaagcacaggaggcgttgcgcgaacgatgaacattagcgatgtagcaaaaattaccggcctgaccagcaaagccattcgcttctatgaagagaaggggctggtgacgccgccgatgcgcagcgaaaacggttatcgcacctacacgcagcagcatctcaacgaactgaccttactgcgccaggcacgccaggtgggctttaacctggaggagagcggcgaactggtgaatctgtttaacgatccgcagcgtcatagtgccgacgtcaaacgtcgtacgctggagaaggtggcggagatcgaacggcatatcgaagaactgcaatccatgcgcaaccagctactggcgctggcgaatgcctgccctggcgatgacagcgccgactgcccgattatcgaaaatctctccggctgctgtcatcatcgggcggggtgaaaatcagttaatctccgtttgcaccgaaagaatatgctgcaaactttctaccataatgcgccccgactgaaataagccttcctggatttcgttgttaacattcacagcgtgaaccagggaggctaataacaccacttgcaagaaggcaaaaataaacgcaccgataatcataatatgcgtcagggggattttcctttgctccttcattttaaataacccacaaactgaccttccttcattaaggcgacttttcccgtatggtgataaacaatgacgttataaagacctgactgataaacagtggcatctttattgtcttcatcaattgcacataatgaatcattgagataagcaaagttcttactgctcattctaaaggtcatgccaaatcctttataaatggctttctttgccgcctgggcatgttgtgcggcttctgcatttttaaatgcctgcgcctcggatgcacttaaaatagccgtctgacgctgttgttctgcgagataacaggtgtcatggctgacgccctgcgcctggcaatctgcgatgcgggaagtgggtgaactacagccagtcagtaatataaccgccagcagggaaaacgatttaatggagctattcatcattgttaaccttaaataatgtgcgaattaatgaagaggtgaaacccggcaagcttccttgctcttatttatattgaggattgaaatattagaacgaatatcctacgccgacacctgcgccgaaatcagattgcgtatccgcagaaataccggctttaagtaccgtatgcgttccggcattaaaagatgttcctacagacaccgcagattcaccgttgaaggttcccgctcccgctgacaccatcatcacgtcaccggttttcacctgtggttgtgaggcgatagcgatggcagatgcagttcccgcattggcttctttacgattgtcctcaacttcgtttttcagagaatcgaaatggttattgagcgtgttaatttgttggctgttatctgcgacccgtttttgcgtgttggttaactgttgctgcgtttgtgcggaatcttgtctcagactttcaatttgctcatgtgcctggacagacttctgcgccagactttgcatttgtttatcgtattgagccctttctttttgctgttgtgctgccacatcggttgtcagtgcattcattttctgcccttgttccgtggtagtgcgctgattagcctcattttgagccgccagtctggcattaatcatctcctgataatgcgcggtattttgcgtatctccagtcgcggcgagcgttttttgtgtggctacgatctgcgcctgttgctctgtaatttgcgtttgctgggcgtcagttaccgcagactgtcgggcgttgatcatgctctgataacgggcaggtatctgtacaacacctgtagcggcaacggttttttgtcctgcgtcaggatctgtctggacagggggagtctgagtggtatcaggtgtttcagaagggatgtagtgatgttcagtcaaataggtatacgcagcgggactgttgtctgtgcgttctaaaaagcgggtaatcttctgctcaatctccgattgcgacatgccggagttaatggctgaaagctctgttgccgccgcttcaatggtatcaccagctaaaacaacagggctggatgttgctgaaattatgagtgccagtaaagctacgtttacagttttcattcattttctcttgttcaaaataagtcgcattgatgtttctataagaaacaaataatattgttttaagaaataaactgcgttgcaatttgatcgaaatctacgccgccatttgtgtgatgtaaagcgcatttttgtcttgtttaagcgtaaataccaccaataagaaacaaaaatagtttcttttataaataaaaaaggaaattatttcgtgctctttcaatgtaaaaaagagtaaagacttgttttgataagcgaaataatttctgtttctggactaaacgtgaagcggttcctgatgtgtgctaaaatgcgtttctttgataaatctcaatttttaagaggtttacgctaggcaggaaaatttaaatgaatgaatttgagaagatttttaatgaaatgaatctggaccgggcattgctaccgatcctttttcgttcgaaccggtcaacagtgtggaaatatttaagtggcgatagtacggctcctgcctcagctatgtcactgattatgctgttgcagttaatccagaaacgaaaccccgatctgttagccgaatggttaacgctttctgatttcaccattccgccagaagtttacctggaccaacctgattactggaaagggtgggtgtatacccaacacaaggtcaataaaaacgtcctggaatatctaaaaaaacactatccggatgaagaccaaaaaagtatgggtaaaggccgggaagagtaattttgcctctactcggctatatgccggatgcggcgcaagcgccttatctggcctacgattcgggcatattttgtaggcatgataagacgcgtcagcgtcgcatcaggcgatgaccgcacggatgatcagcgttatcccttctatcgcaatgacttcaacatgcgtacctgcaccgagatcctcgctggcgctgacaggccatgaactgtcaccgacgcgcatatgaccgcgcccgttgaccagcggagattccagaacaaaacgtcggccaatcaactgctgcccgcgctggtttaaatgactgtcgctgtgcttttgttcgcgcacccgccgcgacaaccatttccaccacagccaggcggcgagcagcgtcaggacggcaaacattaccccttgccactcccaacccagcggcagcaaccagaccaccagaccggtaatcaccgctgccacgccgctccacaacagataaccattgccgcccaacatctcggctgccagcagcaaaccgccgagacttagccagaaaatatgtggatgaacgaccattaactccatcatggctgagtccgtttgttggcgctgtctttcaccagctcagcaatcccggcaatcgaccccatcaggctgctggcctctaatggcatcatcaccactttgctgttactggacgaaccgatctgctgtaacgcttcggtgtatttctgtgcgacgaagtagttcaccgcctgaatatcaccggaggcgatggcttcagacaccattttggtggcgcgggcttctgcttcagcggaacgttcacgcgcttcagcctgtaaaaacgccgactgacgttcgccttccgctttcaggatttgtgactgtttttcaccttcggctttgaggatttccgcctgacggatcccttccgcttcaaggatgtaagcgcgtttggtacgttccgctttcatctgcgcgttcattgaagagataagctctgcgggcgggcgcacatcacgaatttcgatacgggtgactttaatcccccacgggttggtggcctcatcgacaatatgcagcagacgcgagttaatgctgtcgcgctgagagagcatttcatcaagttccattgaacccagcacggtacgaatgttagtcatggtcaggttgatgatcgccagctccagattgctgacttcataagccgcgcgcggcgcgtcaatcacctgaataaagcacacggcgtcgatggtaacgttggcgttatctttcgagataacttcctgggaagggatgtcgagcacttgctccatcatattgatcttgcgaccaatgcgatccataaagggcaccaccaggcttagacctggctgtaacgttttggtatagcgaccaaagcgttctaccgtccattgatagccctgcggcacgattttgacgcccgcgccgacaatgaccagcgcgacaaaaatgagaatcgggataaagataagcatcggaaaaacctcctgttgtaccgtccataatcagcaaaattgctgcttgattaaacaaattatacctgattactgaaagagagttcccccttattcctgcgaaggataaactgtttttagtaaaaatcagaaaaagggaacagcgatgcaggaaaatagtcctttgcttcagctacaaaacgtaggatatctggcgggtgatacgaagattcttaataacatcaatttttcgctgcgtgctggcgaatttaagttaattaccggtccttctggttgtggcaaaagtacactgctaaaaatagttgcttcattgatcagcccaaccagcggaacgttactgtttgaaggtgaggatgtcagcacactaaagccagaaatctaccgccagcaagtctcttactgcgcccagacgccgacgctgtttggcgatacggtatacgataacctgatttttccctggcagatccgtaaccagcagcctgacccggccatttttctcgattttcttgaacgcttcgctttaccggacagcattttgacgaagaatatcgccgagctatctggtggtgaaaaacaacgcatctcattgattcgtaacctgcaatttatgccgaaggttttattgctcgacgaaatcaccagtgcgctggatgaaagtaataaacataacgttaatgagatgatccaccgttatgtgcgcgagcaaaatattgccgtgctgtgggtgacacacgataaagacgaaattaatcatgcggataaggtgattacactgcaaccgcatgccggagaaatgcaggaagcacgctatgaactcgcataatattactaacgaatcattggcactggcattaatgctggtggtggtggcaatcttaattagccataaagaaaagctggcgctggagaaagacattctctggagcgtcgggcgtgcgataattcagctgattattgtcggctatgtgctgaagtatattttcagcgtggatgatgccagcctgacattattgatggtgttatttatctgctttaatgcggcgtggaatgcgcaaaaacgcagtaaatatattgctaaagcttttatctcatcgtttattgccattacggtcggggcgggaattaccctggcggtgctgattctctcagggtcgattgaatttatcccgatgcaggtgatccctatcgccgggatgatagccggtaacgccatggtagcggtggggttgtgttacaacaatttagggcaacgggttattagcgaacagcaacagattcaggagaaactgagtcttggcgcgacgccgaaacaggcttcagctatattgattcgcgacagtattcgcgcggctttaattccgacggtcgattcagcaaaaacggttggcttagtgagtttaccaggaatgatgtccgggctgatatttgccgggattgatccggtgaaggcgattaaatatcagattatggtgacctttatgctgctctcaactgccagcctgtctaccattattgcctgctatttaacctatcgtaaattttataattcgcgccaccagttggtggtgacgcaattgaagaagaaatgatgcgatgccggatgcgcagcatcgcatccggcgttgtggttcatgtgccgatcaacaaaacatcaatacaacaacgcatacagctggcggcgatacttcgacgccagtgcatcacccgtacccagcgcagcaaggatctcctggaacgttttacgcgtctgaccgtctgcggcggtgagatctttacgcagatgcccgaacagcaactccagcgcctcttcattgcgcccaacctgatgcagttgcagcgccagttgcgttgccagtgcggcatcttctggattctccgccacctgctgttgcaactgttgaatttccggcgtatctgccgcctgcttcagcagttcgatttgcgccaccagcccctggtagcgggtgtcctgatcctgtaaaggaatggttttcagcacggcttcagcatcttcagaacggttcagcgcaatcagcgtttctgccagcagcaggccgatctccccgttctgattcgacaactgccaggcgtctttcagcaatggcaaggcgtcggtgtaattgccttcctgcatcagctgcatcgcctgctgcgctttcagctcttcttcgcgcggcagcactttatccagcagggcgcggatcgcctcttccggttgcggcccctggaagccgtctaccggttgcccgttctggaacagatacacggtcggaatcgcgcgcagaccaaactgggcggcaatcatctgctccgcgtcgcagtccagcttcgccagaataaattgcccgttgtactgcgccgcgaggctttccagaattggggttaactgcaaacagtgctggctacgttcagaccaaaaatagaacagcaccggagtggtcatcgactgttcaagaacctgttgcaggttagattcgttaatgttgacaatattttctacggacatggagtcgctctctgttgtcgatattttctttgacatgggggcttaagcgcgcgcttcaactcacccctgcaatattttgtccatcacgcgccccggcagcaggcgcttaagcaccattactgcccaggtcaccagcgttaccggatagcgcatcttcggcttctcgctaataaaagcatggcgcactttgtcgaccaccgcttccggtcccaacgtaaagcgggcggcgatgccgggattttcgacaggtttatcactttgcgtctggttgacgttgtcggtgaagcgagtacgaatgggaccgggttcgatcaggctaactttaattccgctgtaacgtagctccatgcgcagtgcgtctgaccacgcctccagcgcatatttactggccgcgtaagcgccacgacccggcgtggagattaatcccatcaccgatgaggtcatcacaatacgtccttcaccgtgcggtaacatcgcgggtaacaggcgcatggtgagctggtgtgcgccgaaaaagttggcggaaaactgctgttccatctgcgcacggctgatggtggaaagggggccatacatgccgaatccggcattgttaaagatcccatacagacaattatcggtcagggcgatcacttcgtcggctgcgcgatcaacactttctggcaaatccagatcgatcaacacgccggtaaatcccatgctgttcatgcgctcaacatcatccggtttccggcaacctgccagcacatgaaaaccctggcgttttaattcgagcgcgctttccaggccaattccactggaacatccggtaattaagaccgatttttgcataactttacctgtcaggatctccgttgctttatgagtcatgatttactaaaggctgcaactgcttcgccatccagtcggcaataaacggctgggcgtcgcggttgggatgaataccgtcatcctgcatccattgtggtttgaggtagacctcttccataaaaaagggcagcagcggaacatcaaactctttggcgagtttggggtaaatggcgctaaaggcttcattataacggcgaccatagtttgcaggcagacgtatttgcattaacaatggttcagcgttggcggctttgacatcctgcaatatctggcgcagcgtttgctcggtttgttgtggctgaaaaccacgcaaaccgtcattgccgcccagttctaccagcacccagcgcggctgatgctgtttcagcagagccggaaggcgcgccagcccttgttgcgaggtgtcgccgctgatgctggcattgactaccgacgttttactctgccacttatcattcaacaaggcaggccaggccgcgctagcagacattcgatacccggcgctcaggctatcacccagaatcaataacgtgtccgctgcggcggcacggaaggttaacaggaccaggaacaggaagggcaaatgccagcggaaaacattgttgaagttcatcatcttaagaagtccgtcggtcagggggagcatgaactctccatcctcaccggagttgagctggttgtcaaacgtggcgagaccatcgcactggtgggcgagtcgggatcgggtaagtcaaccttgctggcgatcctcgccgggctggatgacggcagcagtggcgaagtgagactggtgggacaaccgctacataatatggacgaagaagcgcgggcaaagttgcgcgcgaagcacgtaggctttgtttttcagtcatttatgttaattcctacccttaacgcgctggaaaacgtcgagcttccggcgctgctgcgcggtgagagtagcgcagaaagtcgtaacggggcgaaagcgttgctcgaacagttagggttgtgtaaacgtcttgatcatcttccggcacagctttctggcggcgaacagcaacgagtggcgctggcgcgagcctttaatggtcgacctgatgtgctgtttgccgacgaacccaccggcaaccttgaccgccagacgggcgataaaattgccgatctacttttttccctcaaccgtgagcatggcaccacgttgattatggtgacccatgacctgcaactggcggcacgctgtgaccgctgcttacggctggtgaacgggcagttgcaggaggaagcatgattgcacgttggttctggcgcgaatggcgctcgccgtcgctattaattgtctggctggcgcttagcctggcggtggcctgcgtgctggcgctgggcaatatcagcgatcgcatggagaagggcttaagccagcaaagccgtgagtttatggcgggcgatcgggcgttgcgcagttcgcgcgaagtgccgcaagcatggctggaggaagcgcaaaagcgcggcctgaaagttggcaagcagctgactttcgccaccatgacctttgcaggcgacacgccgcagctggcgaacgtcaaagcggtggatgatatctacccgatgtatggcgatctgcaaactaatccccctggcctgaaaccgcaggcgggcagcgtattgctggccccacgtctgatggcactgcttaacctgaaaacgggcgacaccattgacgtgggcgatgccaccttgcggattgccggagaagtgattcaggaaccggattccggttttaatcctttccagatagccccacgcctgatgatgaatctggcggatgttgataaaaccggagccgtgcagccggggagtcgggtcacctggcgctataaattcggcggtagcgagaaccagctcgacggctatgagaaatggttgttaccccagcttaaacccgaacaacgctggtacggtctggaacaggacgaaggcgcgctggggcgatcgatagaacgttcgcaacagttcctgctgctttcggcgcttctgaccttgctgctggcggtggcggcggtcgcggtggcgatgaatcattactgtcgcagtcgctacgacttggtggcgatcctcaaaacgctgggggcagggcgagcgcaactgcgtaagttaattgtcggtcagtggttgatggtgctggtactttcagccgttaccggtggggcgataggtctgttgttcgaaaacgtgttgatggtgctgctcaaacccgtgctacctgccgctttacctcctgccagcctctggccgtggctgtgggcgctcggcaccatgacagtcatctcgctgctggtggggctgcgaccataccgcctgttgttggcaacgcagcctttacgcgtgttacgtaatgatgtggttgcaaacgtctggccgctgaagttttatctgccgattgtcagtgtggtggttgtgctactgctcgccggactgatgggcggcagtatgctgctctgggcggtgctggcgggcgcggtagtactggctttgctgtgcggtgtgctgggctggatgctgctgaatgtacttcgccgcatgacgctgaaatcgctacctctgcgcctggcggttagccgcctgttacgtcagccgtggtcaacgttaagccagctttcggcattttcgctctcctttatgctgctggcactgttgttggtgttgcgtggcgatctgctcgatcgctggcaacagcagctaccgccagaaagcccgaactactttttaatcaacatcgccacagaacaggttacgccgctaaaagcgtttctcgcggaacatcagatagtcccggaatcgttttatccggtagtgcgggcgcggttgacggcgattaacgacaagccgacagaaggcaatggagatgaggcgctcaaccgcgagctgaatctcacttggcaaaatgcgcggcctgatcataacccgatcgtcgccggtaactggccgccaaaagccgatgaagtgtcgatggaagaggggctggcgaaacgcttaaacgttgccctcggcgataccgtgacttttatgggcgatacccaggagttccgcgctaaagtgaccagcctgcgcaaagtggactgggaaagtctgcggcctaatttctattttattttcccggaaggggcattagacgggcaaccgcagagctggcttaccagtttccgctgggagaatggcaacggcatgttgacgcaactcaaccgccagttcccgaccattagcctgttagacattggcgcgattttaaaacaggtcggtcaggtgctggagcaggtaagtcgggcgctggaagtgatggtggtgctggtcaccgcctgcggcatgttgctgttgctggcgcaggtgcaggtgggaatgcgtcagcgtcatcaggagctggtggtgtggcgcacacttggtgcggggaaaaaactgctgcgcacgacattgtggtgtgagttcgccatgctcgggtttgtatccggcctggtggccgcaattggtgcggaaacggcactggcggtactgcaatcgaaagtgtttgatttcccgtgggagccagactggcgattgtggattgttctgccgtgcagcggtgcgctactgctgtcgctttgcggcggctggctgggtgcgcgactgcttaagggtaaggcgctgttcaggcagtttgcggggtgatgtgataaagccgtttatttctaccaggtagcatgaacagcgtgcacagaatcccccatcactgcgccttaacccattccgccacttccgcccactcaccgcgaaagacaactttttccgcttttttttcaagctgatagcgatacatcgggtcgtaatattcttcaagcagcggcactagccaggccagatgaccgtcggtgctgccggtggtgagttgcgttgtcagcgccgcatccagccttgcagccagttcgttatagcgttgtagtcccagccgacgtttaatcgccgaaagcccgtgatgcaggtattcgcaatactcctgccagccctgttcgtcgccataagcgtgggtaaaatcatgatgcatacgcaagaaatactcttcgttcaggcgttcaagacggatctcaaacggatcttctaccaccgcaatcgtcgcctgagtcattcgttcgcgcagacattccggcaggtgattcgaaccgatcatccggctttcatcttccagcacccacaagcgcaaattctgacgggcgtcggtttttagcatttcggcagccagcaggttttcaaaactcgcctggctaagttgtggttgtaacgtgcgaccaaaagcagaaccgcgatggcgcgccagcccttccagatcaacaccgttcggttgttgttgcactaacagcgttttgccgcagccggtacaaccgccaatcagcactatcggtttttgtgacagttcaatggtcgcctgaatcgcggtctggcgcagtgccttataaccgccttccaccagcggataatcaatccccgcgtcatgcagccagcgttgcacaatatgcgagcgctgaccgccacgggcgcagcagagaataccgtgcggattttgcaggcacgctgcccgccaggcgtccatgcgctgctgacgaatttcacccgccaccagtttatgccccagtgccagcgccgcgtctgacccttgctgtttatagcagatgccaacggcggcgcgttcatcgttattcattaacggcaggttgatagcggcgggcattgcgccttgctcaaactcgatgggggcgcgaacatcaataatgggcgtatcagcaatcagcagggcacgatagtcctgttccgtgtgtctctcttgcatagtaaaaagtgaacctcaaatcagcttgcgcgctattttacgcgccaacgcgcaaggaaacttgatttttaactgcgtgggttgccgaaaatttctaaaaatccgctgatttccggcctgcgctgggtaaacaaggtcacaatatcttctaccgctttgccgctgccaaatttgcgccatgccagactcaatggcgaaggagggcgcatcgttgggattacccggctgaccagttgttgattatcgagcattgactggcaaagtgattttggcaaaaaaccaatgccaacgcccgccagatgggcggcgattttcgtttccatatcgggaacaataatctctttttgccccggcaatcgccaggcgacgcgtttggttaaggtgcgggcgctgtcttcaatattgaccgccggaaagcgccgcaactgtgcttctgttagcggctcttcaacgttcgccagcggatgatccgccgccatgacaaagcgccattgcaccgatcctaagggatcaagactaaaggtatttgccagcgcctcggttcccgtgacgccgatagccagtgaaaaaccttcgtacaatagcgagtcccagacgcccatatagatttgtcgggagatgtgaaattgggtaaacgggtaacgttcatttagccacgccagcagcctggcaacggcctgggggttatagagcaggttgttgatgacgatattcacctggcgttccacgccatcattcacctgttgtaactcgctgggcatactttccagccagcccagccagtctctggcctgacaaagtagatgctcgccagccgccgtcaacgtcacgctgcgagtcgtgcggaaaaacagcgccactccggtattctcttccagaagtttaatgcgataactgatcgtcgccgtggttttacataatcgttctgccgcttttgaaaaacttcctgtttcagcaaccgcaatgaaagtccgcaaggtttctggatcgaacatcttcaggtatccccttttaaatccgcaagttgcgtgattttcttatcctctgatttatcagtatttttacatgataaccctgttcaatttgtggactaaatccagttttggaaaaatattccaacttttgtgttgatgttgttctcttaaggttttagattgcctgttattgaaaccaagctgaccggtcggcggtggttgaacggaattatgttacaaggacaaaaagatgaaacttcaggtattaccgttaagtcaggaagcctttagtgcttatggcgacgtaatcgaaacgcagaaacgggattttttccatattaacaatggactggtggagcgttaccacgatttggcgctggttgagattcttgagcaagaccgtacgcttatcagcattaaccgcgcgcaaccggcgaatctgccgctgactattcacgaactcgaacgtcatccgctgggtacacaggcctttatcccgatgaaaggtgaagtgtttgtggtggtggtggcgttaggtgacgacaaaccagacctgtcaaccctgcgggcgtttattaccaatggcgaacagggagtgaattaccatcgtaacgtctggcatcacccacttttcgcctggcagcgcgtcaccgattttctgaccatcgatcgcggcggcagtgacaactgtgatgttgaaagtattcctgaacaggaactctgttttgcgtgacgcctgcaaccgacttgcataagataaacgaattgttcattgtttatgctcatttgtaggtcggagttaacgtaggtatgacggaagttagacggcgcggcaggccaggacaggcggagcctgtggcacagaagggtgcacaggcgttagagcggggaattgcgattctgcaatatctggaaaaaagtgggggaagttcgtcggttagcgatatctctctcaatctggatttgccgctctccacgacctttcgcttgctgaaggttttacaggcagcggattttgtctatcaggacagtcagttaggttggtggcatataggattaggtgtctttaacgtcggtgcagcgtacatccataaccgcgatgtcctctccgtcgccgggccgtttatgcgccgcctgatgttactttccggcgaaacggtcaatgtcgcgatccgtaacggcaatgaagcggtattaattggtcagttagagtgtaaatcgatggtcagaatgtgtgcgccgctgggcagtcgtctgccgctgcatgcttccggtgcgggcaaggcgctgctttatccgctggcggaagaagagttgatgagcatcattctgcaaaccggtttgcagcagtttacgccaacgacgcttgtggatatgcccaccttgctgaaggacctggaacaagcgcgtgaactgggctataccgtagataaagaagagcatgttgtcggcctgaattgcatagcttcagcaatttacgatgatgtaggtagtgttgttgccgctatctccatctccgggccttcatcaagactgacagaagatcgttttgtcagtcagggtgagctggtcagagacaccgcccgcgatatcagcacggcgttgggactgaaagcacatctatagtgtctgtcgtatcccgctctgcggagcgggtttttttgacaaaatttgaaagttggaaaaattttccaattaatagaggtaggaataaaatggcaaaaatgagagccgttgacgcggcaatgtatgtgctggagaaagaaggtatcaccaccgccttcggcgttccgggagctgcaatcaatccgttctactcagcgatgcgtaagcacggcggtattcgtcacattctggcgcgtcatgtggaaggtgcttcgcacatggcggaaggttatacccgcgcaacggcagggaatatcggcgtatgtctggggacttccggtcctgcgggcacggacatgatcaccgcgctctattccgcatctgctgattccattcctattctgtgtattaccggccaggctccgcgcgcccgtctgcataaagaagatttccaggccgttgatattgaagcaattgctaaaccggtcagcaaaatggcggttacagttcgtgaagcggcgctggtgcctcgtgtgctgcaacaggcgtttcacctgatgcgttctggtcgaccgggtccggtactggtggatttaccgttcgacgtacaggttgcggaaatcgagtttgatcctgatatgtacgaaccgctgccggtctacaaacctgctgccagccgtatgcagatcgaaaaagctgtagaaatgttaatccaggccgaacgtccggtgattgttgccggaggcggggtaatcaatgctgacgcagctgcactgttacaacagtttgctgaactgaccagcgttccggtgatcccaacgctgatgggctggggttgtatcccggatgaccacgaactgatggccgggatggtgggtctgcaaaccgcgcatcgttacggtaacgcaacgctgctggcttccgacatggtatttggtatcggtaaccgttttgccaaccgtcataccggttcggtagagaaatacaccgaagggcgcaaaatcgttcatatcgatattgagccgacgcaaattggccgcgtactgtgtccggatcttggcattgtctctgatgctaaagcggcgctgacgctgctggttgaagtggcgcaggagatgcaaaaagccggtcgtctgccgtgtcgtaaagagtgggtcgccgactgccagcagcgcaaacgcactttgctgcgcaaaacccacttcgacaacgtgccggtgaaaccgcagcgcgtgtatgaagagatgaacaaagcctttggccgcgatgtttgttatgtcaccaccattggcctgtcacaaatcgctgcggcacaaatgctgcatgtctttaaagaccgccactggatcaactgtgggcaggcaggcccgctgggctggacgattccggcggcgctgggggtttgtgccgctgatccagagcgcaatgtggtggcgatttccggtgacttcgacttccagttcctgattgaagaattagccgttggcgcacagttcaacattccgtacatccatgtactggtcaataacgcctatctgggtctgattcgccagtcgcaacgtgcctttgatatggattactgcgtacagctcgcgttcgaaaatattaactccagcgaagtgaacggttatggcgtcgaccacgtaaaagtagcggaaggtttaggttgtaaagcaattcgcgttttcaaaccggaagatattgcaccagcctttgaacaggcgaaaatcttaatggcgcaatatcgggtaccggtagtcgtggaagttattctcgagcgtgtgaccaatatttcgatgggcagtgaactggataacgtcatggaatttgaagatatcgccgataacgcagcggatgcaccgactgaaacctgtttcatgcactatgaataagggagataaataatgttacgtttctctgctaatttatcgatgttatttggtgaatatgattttctcgcccgttttgagaaagctgcgcagtgtggttttcgcggcgttgaatttatgttcccttatgactacgacattgaagaattaaaacaggtgctggcgagtaataaactcgaacatacgctgcacaatttaccggcaggtgactgggcggcgggcgagcggggtattgcctgtattcctggccgtgaagaagagtttcgggatggcgtagcagcagcgattcgttatgctcgtgctctgggtaataaaaaaattaactgtctggtcggtaaaacgccgactggtttcagcagtgaacagattcacacaacgcttgtagaaaacctacgttatgctgcgaatatgctgatgaaagaagatattttattactgattgaacctattaaccattttgatattcctggtttccatctcaccggaacccggcaggcactgaaactgattgacgatgttggttgctgcaatttgaaaattcagtatgacatttatcacatgcagcggatggaaggtgaattaactaataccatgactcagtgggccgataaaattggtcacctgcaaattgctgataatccgcatcgcggcgaaccgggaaccggagaaattaattacgaatatctctttacggtaattgaaaattctgactacaacggttgggttggctgtgaatataaaccccaaaccaccacggaagccggtttacgctggatggatccgtaccgttaaaacgtaacgctattcagacaatgcttttttaggccgctaagttggcaggggatcgtgttgtctgaattcaggaaaagcgaaatttaaaagaggttaattatgaaactgggatttattggcttaggcattatgggtacaccgatggccattaatctggcgcgtgccggtcatcaactgcatgtcacaaccattggtccggttgctgatgaattactgtcactgggcgccgttagtgttgaaactgcgcgccaggtaacagatgcatcggacatcatttttattatggtgccggatacgccacaggttgaagacgttctgtttggtgaaaatggttgtaccaaagcctcgctgaagggcaaaaccattgttgatatgagctccatttccccgattgaaactaaacgtttcgctcgtcaggtgaatgaactgggcggcgattatctcgatgcgccagtctccggcggtgaaatcggcgcgcgtgaagggacgttatcgattatggttggcggtgatgaagcagtatttgaacgtgtaaaaccgctgtttgaactgctcggtaaaaatatcactctcgtgggcggtaacggcgacggtcaaacctgcaaagtggcaaatcagattatcgtggcgctcaatattgaagcggtttctgaagccttgttgtttgcttcaaaagccggtgcggacccggtacgtgtgcgccaggcgctgatgggcggctttgcttcctcacgtattctggaagttcacggtgagcgcatgattaaacgcacctttaatccaggtttcaaaattgcgctgcaccagaaagatctcaacctggcactgcaaagtgcgaaagcactggcgctgaacctgccaaacaccgcgacctgccaggaattgtttaatacctgtgcggcaaacggtggcagccagttggatcactctgcgttagtgcaggcgctggaattaatggctaaccataaactggcctgatacccgcaataaaaatggccgatatcagaaaatgaatcggccagcaatattaaaaaaagaaagcagccaaagatgttgcttcagtattaaaaataatatttttattttatttgttcctcatagctagattaaaacaacgttattcgatacgtgaaattaagagggatttatggaacatcagagaaaactattccagcaacgcggctatagcgaagatctactgccgaaaacgcaaagtcagcggacctggaaaacatttaactattttaccttatggatgggttcggttcataacgttcccaattatgtgatggttggcggcttttttattctcggcttgtctacctttagtattatgctggcaattatcctcagtgcctttttcattgccgcggtaatggtattaaacggtgctgcgggcagtaaatacggcgtaccgtttgccatgatcctgcgtgcttcttacggcgtacgtggtgcactgtttcccggattattaagaggcggtattgctgccattatgtggtttggcctgcaatgttacgcggggtcactggcctgcttgattctgattggcaaaatctggccgggatttttgactctcggtggcgatttcacgctgttaggcctttctctaccgggattaattacttttttactcttctggctggttaacgttggtattggttttggcggcggaaaagttttaaataaattcactgccattcttaacccgtgcatctatatcgttttcggcggtatggcgatttgggcgatttcgctggtcgggatcggtccaatctttgactacattccgggcggtattcagaaagcagaaaacagtggcttcctgtttctggtggtgataaacgcggtggttgcggtctgggcggcaccggcggtgagcgcatccgactttacgcaaaacgcccactcgtttcgtgagcaggcgctggggcaaacgctgggtttagttgtggcctatattctgtttgcggtcgccggggtatgtattattgccggagccagtattcattacggcgctgacacctggaacgtgctggatattgttcagcgttgggacagcctgttcgcctcgttctttgcggtactggttattctgatgacgactatctctactaacgccaccggtaatattattccggctggttatcagattgccgccattgcaccgacgaaactgacctataaaaacggcgtactgattgccagtattatcagcctgctgatctgcccgtggaaattaatggaaaatcaggacagtatttatctgttcctcgatattatcggcggaatgcttggtccggtaattggtgtgatgatggcgcattattttgtcgtgatgcgtgggcaaattaatcttgatgaactgtacaccgcacctggcgattataaatattacgataacggttttaacctcaccgcgttttcagtaactctggtggccgttattttatctcttggcggtaagtttattccctttatggaaccgttatcacgtgtttcatggtttgtcggcgtcatcgtcgcctttgcggcctacgccttattaaagaaacgtacaacagcagaaaaaacaggagaacaaaaaaccataggttaattaatcacgatattgaacattgagttaaaaaccaatctgtattttacaaggagtttgttatgtcttttgatttaatcattaaaaacggcaccgttattttagaaaacgaagctcgcgttgtagatatcgccgttaaagacggaaaaattgctgctatcggccaggatctgggcgatgcaaaagacgttatggatgcgtctggtctggtggtttcgccgggcatggttgatgcgcacacccatatttctgaaccgggtcgcagccactgggaaggttatgaaaccggtactcgcgcagcagcaaaaggtggtatcaccaccatgatcgaaatgccgctcaaccagctgcctgcaacggttgaccgcgcctcaattgaattgaagttcgatgccgctaaaggaaagctgactatcgatgcggcacaactcggtggcctggtgtcttacaacattgaccgtctgcatgagttggatgaagtgggtgttgtcggtttcaaatgcttcgttgcgacctgtggcgatcgcggtatcgacaacgacttccgtgacgtcaatgactggcaattcttcaaaggcgcgcagaagctgggtgaactaggccagccggtgctggtgcactgcgaaaacgcgctgatctgtgacgcactgggcgaagaagcgaagcgtgaaggtcgcgtaactgcccatgactatgtggcttcgcgtccggtatttaccgaagtggaagcgattcgccgcgtactgtacctggcgaaagtcgctggttgccgtctgcacgtttgccacgtcagcagcccggaaggtgttgaggaagtgactcgtgcacgtcaggaaggtcaggatgttacttgtgaatcctgcccgcattactttgtgctggataccgatcagttcgaagaaatcggtactctggcgaagtgttcaccgccgatccgcgatctggaaaaccagaaaggcatgtgggaaaaactgtttaacggtgaaatagactgcctggtttccgaccactctccatgcccgccggaaatgaaagccggtaacataatgaaagcgtggggcggtatcgctggtctgcaaagctgcatggacgtgatgttcgatgaagcggtacagaaacgcggaatgtctctgccaatgttcggcaaattaatggcgactaacgcagcagatattttcggtctgcagcaaaaaggccgtatcgccccaggaaaagatgccgacttcgtcttcattcagccgaatagcagctatgttcttaccaatgacgatctggaatatcgccacaaagtcagcccgtatgttggccgtactattggcgcgcgtatcacgaaaaccatcttacgtggtgatgtgatttacgatatcgaacagggcttccctgttgcgccgaaaggtcaatttatccttaaacatcagcagtaatctggccctgcaatgcccgtccttgtggcgggcattctccggttaaggtgtgtttatgttcaattttgcagtgggccgcgaaagcctgttatcaggatttcagtggtttttctttattttttgcaacacggttgtggttcctcctacgctactttctgcttttcagttgccgcaaagtagcctgcttacgctcacgcaatatgcttttcttgctaccgcactggcctgcttcgctcaggcgttctgcggtcatcgtcgcgctattatggaggggccgggcggcctgtggtggggaaccatcctgactatcacccttggcgaagcatcgcgcgggacaccgatcaacgatatcgctaccagtctggcggtggggattgcgctctccggcgtgctgacgatgttgattggttttagcggattaggccatcgcctggcacggttatttacgccgtcggtgatggtcttgtttatgttgatgctgggtgcgcaactgaccactatctttttcaaaggtatgctcgggctgccgtttggcatagccgacccgaattttaaaattcaattaccgccgttcgcgctctcggtggcggtgatgtgcctggtactggcgatgattattttcctgccacaacgttttgcccgttacggcctgctggtcggtacgataaccggctggttgttgtggtacttttgctttccttcttcgcattcgctctccggtgagttgcactggcagtggttcccgctcggcagtggcggtgctttgtcgccggggattattctgacggcggtgattacaggtctggtaaatatcagcaatacctacggtgcgattcggggcacggatgttttttatccgcagcagggcgcggggaatacgcgttatcgtcgcagctttgtggcgaccggatttatgacactgataactgtgccgctggcggtaattccattttcaccgtttgtttcatccattggtttattaacccagacaggcgattacacgcggcgttcgtttatttatggcagcgttatttgcctgctggtggcactggttccggcactcacgcgactgttttgcagtatccctttacccgtgagtagtgcggtcatgctggtttcttatctgcctttactcttttccgcgctggtgtttagccagcaaataacctttaccgctcgcaatatttatcgactcgcattgccgttatttgtcggcatatttttaatggcattaccgcctgtgtatctgcaagaccttccattaacgctgcgtcctctgctcagtaacggcttactggtcgggattttactggctgttcttatggataatcttattccgtgggaacgcatcgaataatttgttgaaaaaggattgataatgaaaattgtcattgcgccagactcgtttaaagagagtttaagtgcagaaaaatgttgtcaggcaattaaagccgggttttcgaccatatttcccgatgcgcactatatctgtttgccgatagcggatggcggcgaagggacggtggaggcgatggtcgccgcgacgggcggcaacatcgtgacgcttgaagtctgcgggccgatgggcgaaacagtgaatgctttttatggccttaccggcgacgggaaaacggcggtgattgagatggcggcggcaagcggcctgatgctggtcgcgcctgaaaagcgtaatccgttgctggcgtcaagttttggcaccggagagctgattcgtcatgcgctggataacggcattcgccatattattctcggcattggcggcagtgcgacggtcgacggcggtatgggcatggcgcaggcgctcggtgtgcgtttccttgatgctgacggtcaggtgctggcggctaacggcggcaatttagcgcgcgtggcaagcattgagatggatgaatgcgatccgcgtctggcgaactgccatattgaagtagcatgtgatgttgataacccgctggtaggggcacgcggcgcggcggcggtgtttggtccgcaaaaaggggcaacgccggaaatggtcgaagaactggaacaggggctgcaaaattacgcccgtgttttacaacagcaaactgaaattaatgtctgccagatggcgggcggcggcgctgcgggcggtatgggcattgcggcggcggtattcctcaatgcggatattaaaccgggtattgagattgtgttgaatgcggtcaatctggcgcaggcggtgcagggtgcagcactggtgatcaccggggaagggcgcatcgactcgcaaacggcaggcggtaaagctccgctgggcgtggcgtcggtggcgaagcagtttaatgtcccggtgattgggattgctggcgtattgggtgatggcgtggaagtggtgcaccagtacggcattgatgcggtattcagcattttgccacgtctggcacctttagccgaagtgctcgccagcggtgaaaccaatctcttcaacagtgcgcgaaatattgcctgcgccattaaaataggtcagggaattaaaaactgactattacctttaaagcggatgcgatttatatcgcatctttttttacctgaattgactacaaaaaaagccacggtataaaccgtggcaaaatccaacatagctaaaaataatcaggcgagtggtatgacttaaatctctacgtcgcggttgcaatctttcgagtaaatatagctgaacgcttcaccacgccctacgccataaccagcctgtaaagaataagcgcccataaagatgtaatcgccttttttcaccgggatccagttattgtcgaggttataaaccccctgaccggaaagaatataggcaccgtgttcctgaacatgggtttcgatataaccgtggctggcacctggtgcaaaagagaggatatgcatgttcatatcaaaacctaactctttgggcagaaaatccagcagaataacatcgtccatgccttcataatgaatgcgttccagttcgctggcattgccagaaaccagccacggcgcatgaccttctaccggaatatagcgacgcttatataaaaagatttggctgtcttcggcctgggcgttaacaaacgtcattaaggagcctggcgggcaataaagatagccaccttcgcttaagacaaatgttttcccttcggctttggcagtgatatttccagagatcacatacaggaacgtttcaatgccttcgccaccgaagccctgttggttgccgccgttttgatgcagtgtgaccagataatcaacaaaagaggcacccagctttggcgtggagaggattgtcgcgtcacaattttcaaagcccggaataatattttttaccagaccgtctggtgttaacagtgcgaaattaccgtgtttaacaatcgcacggttagccagtaaatcttcgcggtaaccggtgacgttatttaaatatcccatttataactccttatttctgccaggcaagttgataaagcatgagtgccaacgttttgaccccttcggcaaggtcggtaatattggtgcgttccgccgggttatggctgatcccgttgatgctgggaatgaaaatcatgcaggtcggcacgcgaggcgcgaaaatttgcgcgtcgtgcccggcaccactgtgcatcacccggtaattcagtttttcgctttcacacaattctgtcagggtggcgaccagctccttattcatcggcacgggttcttcgtccatccataaatcgatatcaataccaatatccatttcatcgcaaatcgcccgcatgtcgttttctaactgttgggtgaaatcgcgcagcacggtagcgtcggtatgacgacaatcaatggtgaacgtggttttacccggcactacattcaccgtattcgggcgcggctctactttgccaaaggtcagaaccagcgggtcgcccatctttttcgctttttcgacagactgatggcaaatgcgactgaaagcgtaaaccgtatcacgacgataacccatcggcgtggtgcctgcatggtttgattcgccattcagcgtcaccgtataacgacgctgcccgacaattgcattcaccacgccaattgattgcccattactttccagcacacagccctgttcgatatgcagttcgacaaaggctttaatatcctgacgcggagttagtggggcgttcggcagagtaaatccgcaagccttcatcgcatcgacaaaactatttcctttggcatcacagatattccgcacgtcgtcaggattcgccagcccaaaaatatttttactgccccagaaaacatacgggaagcggctgccttcttcttctgccatcgccaccacttcgaccgtacgtaacggcgcgccgtattgcgttttcagccagtcaatagccagccacgccgccagcgcaccgaattgcccgtcgaggttaccgccgttaaccacggtatcgatatgcgaaccgctcagaaccacttcctgtggatattcggtgccactcaggcgaccgtataaattccccacttcatcgaaacgtgtttccagcccgcttgctgccattctttttttaaactgctgctgggtttccagccattccggcgaataaagtaaacgggtcatcccacccgctgggtcagcgccaaaagaggaaagccagggcagcgtttcttctatagcttgacggaaatgtgtaatcataagaaagtcctgtctcaataattattgcgcaaagggatttttcgtttcgtatgacgtgttataaagcgcgtcggaaattaaatactggtaaatatcatcaacaatttcgatgccttcgacggcggcttttcgttgtttaatatcctgatcctgtccgggataataaacctgattaaaaccgggcgcgggggtaatggtatttaattcgcgcatggtctggctaagatgttgacggaataattcgctggaggagaaaaagttcgggttaataactatatgtaattgccccaaattacgcccggcgtgtaaatcgtcatacatcgaactaacctgtcgcccgaacggtaagccgagtaagacgcctgagaggacgtcaatcatcatcatcaggccataccctttcggcccagcggcggggagcagagcatgtaccgcgaacggatcggttgttggtgcaccgtttttatcgactgcccaggtatccgggatagacatattgcgcgagcgggcgtcgagcacttttccccatgcctgtacggtagtcgccatatcaaaggtaaggatctcgtcgccttctcccggcgcggcaaaggccagtgggttagtgccgtagtaaatttccgcgccgccaaacggcaccaccattggatcggactggcacagcgaaatgccaattaatccggcgcgggctgcctgctgcacaaaataagagattgcgccgctgtgacccatccggctgataccgaccaccgcaacgcctttttgctgggcggttttgatggcatgttccatacccattttcgctgcgacctgtccggcggcattgtcggcatgtaaaattgccgagcacggtccggtttcctcaagacgaaactccggttcgcggttggtgccgccttttgaaatgcgttcggcgtagtattcaacgcgcaccgcgccatgagagtggatccctctggcatcggcgtaaaccaatacttcagccacggttgcagcgtgctcacgttttaacccagcctggcagagtttattctcgattagctggtggagtgtttcccgactgattttcatctgtcttcctttttaacgacgatgtgaagcatgactgcaattaacatacagggaaaatatctggattatgtgatccagacaggcaaaaaaatatagttagaatttatttgataatccgctcgcttttaacctggtttttaaaacaaccacgcttattaaaaaataacgcgtaatagcccggcggttatttgaattcttttgttaataatccctgtgtgatattcatcaccttatttactcgttgtcatcgataccgtaatcgccacattaacactgctcgtgcaattgccatgggtgcaatttttaaggagttgttatgatccacgcctttattaaaaaagggtgttttcaggattcggtcagtttaatgattatttcacgaaaactcagcgaatcagaaaatgttgatgatgtttccgtaatgatgggtacgcccgccaataaagcgttattagatactacaggtttctggcatgacgattttaatcacgccacgccgaacgatatttgcgtggcaattcgtagcgaagcggcggatgcggggatcgcgcaggcggttatgcagcagcttgaagaggcgctaaaacaactggcgcagggttcaggcagcagccaggcgttgacgcaggtgcgtcgctgggacagtgccagtcagaaattacccgatgccaatctggcgctgatttcagtggctggtgagtatgcggcggagctggcgaaccaggcgctggatcgcaacctcaacgtgatgatgttctccgataacgtcacgctggaagatgaaatccaacttaaaacccgcgcgcgggaaaaaggcttgctggtgatggggccagactgcggtacgtcgatgattgccgccacgccgctggcttttgctaacgtgatgccggaaggcaacattggcgtcataggcgcttccggtaccgggattcaggagctgtgctcacagattgcgctggcaggggagggaattactcacgcgattggtcttggcgggcgcgatctcagccgtgaagtgggcggcatcagtgcgctaacggcgctggaaatgctcagtgcagacgagaaaagcgaagtgctggcatttgtttcaaaaccacctgccgaaactgtgcgtctgaaaattgttaatgccatgaaagcaactggcaaaccgacggtggcgctgtttttaggttataccccggcggtggcccgcgacgagaatgtctggtttgcctcctcgctggatgaggccgctcgtctggcttgtctgctttcacgcgtcactgcgcgacgtaacgcgatagcgcctgtcagcagcggatttatttgcggtttgtataccggcggtacgctggctgctgaagcggcgggattacttgccggacaccttggcgtggaagccgacgatacccatcaacatggcatgatgctggacgccgacggacatcagatcctcgacctgggcgatgatttttacaccgtcgggcgtccccatccgatgatcgacccgaccttacgcaacctgttaattgccgatctcggcgctaaaccgcaagtgcgcgtgttgctgcttgatgtcgtgattggcttcggtgcgaccgccgatcctgccgcctcgctggtgagcgcctggcaaaaagcctgtgccgcgcgttcagacaatcaaccactgtatgccattgccacggtgacaggcactgaacgtgacccgcaatgccgctcgcagcaaatcgccacgctggaagatgcggggatcgcggtagtgagttcgctaccggaagccaccttgctggctgcggcgttaattcatccgctcccgtcagccacacagcaacacacaccgtcattactggaaaacgtcgccgtgattaacatcggattacgcagctttgcgctggagctacaaagcgccagcaaaccggttgtgcattaccaatggtcgccagtcgccggcggcaataaaaaactggctcgtttattagaacgtttgcaataaggggttcccatgtttacatcagtggcgcaagccaatgctgcggttatcgaacaaattcgtcgcgctcgtccacactggctggatgtgcaaccggcttcttcacttatcagcgaactaaacaagggcaaaacactgcttcacgccgggccgccaatgcgctggcaggagatgaccgggccaatgaaaggggcgtgcgtgggcgcatgtctgttcgaaggctgggcgaaagatgaagcgcaggcacaggcaatgctggagtagggggaagtgaacttcattccttgtcaccatgtgaatgctgtcgggccaatgggtggcattacttctgccagtatgccgatgctggtggtcgagaacgtgaccgacggcaaccgggcgtactgcaacctcaacgaaggtatcggaaaagtgatgcgttttggcgcttacggcgaagatgtcctgactcgccatcgctggatgcgcgatgtgttaatgccagtattaagcgcggcgctggggcgcatggagcgcggtatcgatctcacggcaatgatggcgcagggcattaccatgggcgatgagttccatcaacgcaatattgcttcctctgcactgttaatgcgtgcgctggctccacaaattgctcgcctcgatcatgataaacagcacattgcggaagtgatggatttcctcagcgtgaccgatcagttcttcctcaacctcgcgatggcctactgcaaggcggcgatggatgcaggcgcgatgatccgcgcaggcagcatcgttacggctatgacccgcaacggcaatatgttcgggattcgggtcagcgggctgggtgaacgctggtttacggcgcctgtaaacactccgcaaggtctgtttttcaccggcttctcgcaggagcaggcgaacccggatatgggcgatagcgcgattaccgaaacctttggtatcggaggtgcggcaatgatcgccgcacctggcgtaacgcgctttgtcggtgcgggtggcatggaagcggccagagcggtatctgaagagatggcggaaatttaccttgaacgcaatatgcaattgcagatccccggctgggatttccagggggcgtgcctggggctggacattcgtcgcgtggtagaaaccggcattacgccactcatcaataccggtatcgcccataaagaggcggggatcgggcagattggcgcaggcaccgtgcgggcaccgctggcgtgctttgaacaggcgctggaagcactggctgaaagcatggggattggttgaggaacgcacaatgacgatcatccatcctctacttgccagccgtagcgcaccgaattatcgccagtcctggcggttagcgggagtgtggcggcgggcgattaacctgatgacggaaagcggcgaactgttaacgctgcatcgtcaggggagtggtttcggccccggcggatgggtgcttcgccgcgcgcaattcgatgcgttatgcggtggattatgcggcaatgaacgaccacaggttgtggcacaagggattcgtctcgggcgtttcacggttaaacagccacagcgttattgtttgctacgtattacgccgcctgcgcatcctcaaccgcttgccgttgcatggatgcaacgcgcggaggaaaccgggcttttcgggccactggcattggcggcaagcgatccgctgcctgctgaattacgccagtttcgtcactgttttcaggccgcgctcaatggcgttaagaccgactggcggcactggctgggtaaaggccccggattaacgccaagtcatgatgacacgctgagcggaatgctgctggcggcctggtattatggcgctttagatgcgcgctccggtcgcccgttttttgcctgttccgacaatcttcaactcgttaccactgcggtgagcgtcagttatttacgttatgccgcgcaaggatatttcgcctcgccactcctgcactttgttcatgctctgagttgcccgaaacgtaccgcagcggcgatcgattcgctgctggcgctggggcatacgtcaggggccgatacgctgctggggttctggcttggccaacaattattacaagggaaaccatgaaaacactggttgtggctcttgggggcaacgccttactccagcgcggtgaggcgctgacggcaaaaaatcaatatcgcaatattgccagtgctgtacccgcgctggcgcgcctggcccgttcttatcggctggcgattgttcacggcaacgggccgcaggtggggctgctggcgttacagaatctggcgtggaaagaggtagaaccgtatccgctggatgtactggtggcggaaagccaggggatgattggctatatgctggcgcagggcttgagcgcacagccgcagatgccgcctgtcacgacggtgctgacgcgcattgaggtttcgcctgatgatccggcgtttttacagccagagaaatttattggtccggtttatcagccagaagaacaagaggcactggaagcggcttacggctggcagatgaaacgtgatggtaaatatttacgccgggtggtagcgtctccgcaaccgcgtaaaattctcgacagcgaagccatcgagttgttgctcaaagaggggcatgtggtgatttgcagtggcggcggcggtgtgcctgtggcggaagacggggcagggagtgaagcggtgattgataaagatctcgccgctgcgttgctcgccgagcagattaatgccgatggactggtgatcctcaccgatgctgatgcggtatatgaaaactggggaacgccgcagcaacgtgccattcgccgtgccacaccggatgagttagcgccatttgccaaagccgatggttcgatggggccgaaggtaacggcggtgagtggttatgtcagaagccgtggtaaacccgcgtggattggggcgttatcgcggattgaagagacgctggcgggcgaagcggggacttgtatttcgctgtagtgattggggtatttggcaagaattaaggctctgagaaagattccaaaccccaaataagaacgcggacagtcccctcgcccctgtggggagagggttagggtgagggggaaaactgcttgcgcattagcttttaagcaggtttgtgcaccaggttaactgaacttgctctgcgcccacatcacgccgctggcatactccggcggcagcagtgggattaaggcttccagcgtcgcggtcagacgcgatgtgtcgctgtcggtcaaattcaaatgccccactttacggcccggacggacttctttgtcgtaccagtgcagatgcacaagcggcagtttcagccagtcataattcagatcgctaccaatcagattgatcatcaccgacggattattcactactggttgcggtaacggcagatcggtaatcgcccgcagatgtagctcaaactggctgatgctggcaccgttttgtgtccagtgcccactgttatgcacacgcggagccagttcgttgatcagcagaccttgcggcgtgacaaaacactccatcgccatcacgcccacatagctcagctcctgcataatcgccgacaacatctcttcagcttgcgcctgttgctgtgcattggcctgcgggaaagcgacgctggtgcgcaaaatgccgttctgatgcaggttatgcgtcagcggataaaacacggtgctgccatcaaagccgcgcgcgccaaccagcgacacttcacctgagaagtttatgccctgctcgacaatacattcgccgtagcattcagccggtaactgttcggtttcatcggcgcgtaaacgccattgaccgcgtccgtcatagccaccagtgcgacgtttaacaatcgccagctcacctaaacgatcaaacaccgcaggccactcgctgtgttcggaaagtaactgccacggtgcggtcggcaggtggagcttatcgaaaagctgcttctgagtcagacggtcagcaataatcgggaacacatcgcggttcacaaaggccggatggcgcgccagctcgcgggttaatgcggtttccggccagcgttctatctcagcggtaatcacgctttgttgaaaaggcaccgccgccggttcagcgtccagcccgactggccagacagcaatgcctaacggttcgcctgcctgacgcagcatacggcctaactgcccgttaccgaggacgcaaacctgtttcatgccgcacctcgcgggtccgggttttccagcacttcatcagtttgtgctttgcgccattcattcagacgctggtgcagttctttatcatgagtcgcaagaatttgtgctgccagtaacgccgcgtttgccgcgccagctttaccaatcgccagcgtacccaccggaatgccgcgcggcatttgtacgatggagtagaggctatcgacaccgctcagtgcggcgctctgtactggcacgcccagcaccggcaccagcgttttggcggcaatcatgccaggcaggtgcgctgcgccgcctgcgcccgcaataatcacctgataaccgttctcttcggcgctttcggcgaagctgaacagtttatcgggggtgcggtgagcagaaaccacttcaacgtggtgcgggacattcaggatttcgaagatttcggcggcgaactgcatggtagcccagtcgcttttggaccccatcacgatggcgacacgcgccggattattgcgggaagacatgcgtcttaaaactcctgtggtgcacaactctcggctttagagggcacagagaatagcacggaaagagtgcaaggaaaacggttgcgtaggcggaattaaccgtcagttgttgagtttttaatttgttctgcgtgttgattatgcgctctggctgaactggcaaagaatgcccatatcaacacaatgctccatggaaaaaagcaaataccgacaatcaatataaatctttctacaaaacgttggttatgggggcgggtgagtactaaataaatgagccagaaatagactatccaggaaatgaccgccgcagctaccagtgacaatgcgccaaaatagaagccgacaagaccgaaccagctaatacacagtggcgctcctgccgtaagggcgatgccagaaatcaaaaatccgttgcagcgttgcataataatattccctgttgttatttcactcagagattattaccttgctgattttaaaaaagatatacaggttgcgttagttcggtgctttttcagaatctgtccattcgtggtcagaaaggaaaatgaatcagctcaacgtcatccgccgtgactttcaccatcgaaccttctgtatgccaggcacccagtaccacgcgaaaagcaggttgctgattggcgataagttcatgcaccgccgggcgatgggtatgcccgtggatcagccattgcacttgatgtttttccatcgcactgaccaccgcgttttggttaacgtccatgatcgccagcgatttactgctgttggcttctttgctgttcgcgcgcattcgcgcggcaatgcgtttgcgcacaaacaacggcagggcgagaaatagcgtttgcagccagggtttgtggactttggcgcgaaaagcctgataacccgcgtcatcggtgcacagcgtgtcgccatgcataatcaacacccgacgaccataaagttcgagcaccttttcttccggcaataacgtcatgccgctttcacgggcaaagcgtttgccgagcagaaaatcacggttgccatgaatgaaataacagggaacgccggaatcggataccgctttgattgctgcggccatctggtgatgaagtgggttgggatcgtcgtcgccgatccaggcttcaaacagatcgccaagaatatacagcgcatcggccttgcgggcctcccccgctaaaaaacgcagaaaaccggcggtgatcgccggttcttccacgcagagatgaagatctgcaataaagagtgtcgccacgattactcgctaacggtcacgctttcaatgataacgtcttcttttggcacgtcctggtgcataccgctacgaccggttgccacacctttgattttgtctaccacgtccatgccttcaaccacttcagcaaatacgcagtagccccaaccttgcaggctttcgccagagaagttcaggaagtcgttatcaaccacgttgatgaagaactgggcagttgcagagtgcggtgcctgagtacgggccattgccagcgtaccacgggtatttttcagaccgttgttcgcttcgtttttgatcgggtctttggtggctttttgtttcatgcccggttcaaaaccgccgccctgaatcataaagccgttgataacacggtggaaaatggtgttgttgtaaaaaccttcgcggcagtagtccaggaagtttttaactgtttcaggtgctttatcgtcaaaagttttgatgacaatatcgccgtgattggtgtggaaagtaaccatttttgcatcctgttccgtttgattggtgcttcaacccggttcgggtcatatatagggtggtgttatagcataannnnncattccattcattaattaattaatgaatgaatgnnnnngggtggtgttatagcataaccgcacgatcggatcatctcgcaatgtatgctgattcgcgcgggaaatatgggtattatacgcaactcaattacccacacatgtctaaacggaatcttcgatgctaaaaatcttcaatactctgacacgccaaaaagaggaatttaagcctattcacgccggggaagtcggcatgtacgtgtgtggaatcaccgtttacgatctctgtcatatcggtcacgggcgtacctttgttgcctttgacgtggttgcgcgctatctgcgtttcctcggctataagctgaagtatgtgcgcaacattactgatatcgacgacaaaatcatcaaacgcgccaatgaaaatggcgaaagctttgtggcgctggtggatcgcatgatcgccgaaatgcacaaagattttgatgctttgaacattctgcgcccggatatggagccgcgcgcgacgcaccatatcgccgaaattattgaactcactgaacaactgatcgctaaaggtcacgcttatgtggcggacaacggcgacgtgatgttcgacgtcccgaccgatccgacatatggcgtgctgtcgcgtcaggatctcgatcagctgcaggcaggcgcgcgcgttgacgtggtcgatgacaaacgtaacccgatggacttcgttctgtggaagatgtcgaaagagggcgaaccgagctggccgtctccgtggggcgcgggccgtcctggctggcacattgagtgttcggcaatgaactgcaaacagttgggtaaccactttgatatccacggcggcggttctgacctgatgttcccgcaccacgagaacgaaattgcccagtccacctgtgcgcacgatggccagtatgtgaattactggatgcactccggtatggtgatggttgaccgcgagaagatgtctaaatcgctgggtaacttcttcaccgtgcgtgacgtgctgaaatactacgatgcggaaactgtgcgttacttcctgatgtcgggtcactatcgcagccagctgaactacagcgaagagaacctgaaacaggcgcgtgcggcgctggaacgtctctatactgccttgcgcggcacagacaaaaccgttgcgcctgccggtggcgaagcgtttgaagcgcgctttattgaagcaatggacgacgatttcaacaccccggaagcctattccgtgctgtttgatatggcgcgtgaagtgaaccgtctgaaagcagaagatatggcagcggcgaatgcaatggcgtctcacctgcgtaaactttctgccgtattgggcctgctggagcaagaaccggaagcgttcctgcaaagcggtgcgcaggcagacgacagcgaagtggctgagattgaagcgttaattcaacagcgtctggatgcccgtaaagcgaaagactgggcggcggcagatgcggcgcgtgaccgccttaacgagatggggatcgtgctggaagatggcccgcaagggaccacctggcgtcgtaagtaattgcgctattgccggatgcgagttttcgcatccggttatcgtctgcgccaccacaacattcccatcagtagcatccccggcaaccacacccacatcaattcagaaataatcacctgatgcccgtacggcgtggtgtaacgagacaatgcaaacggcgcgactttaatcacctgccagggagcgaaaaagcgttcatctgaccacggccacagccagccaacccctttaccgccagtggttaccgaatccagcaagctgtgcgatagcaacgagacggttaaaaacagccagcagcgaatcagcccagccctgaaccatcgacgtccaatcagcacacataacagcgggacaacaaacgcaaacaccagcgaatgggtaaacccgcgatgaccaaaaacattgccgtaagcaacgccaaatttaaacgacaatacatcagcatcgggcagcatcgccaggatgattccggcaaataacagacgcggagggatggctttcgaacccaaccctaaaccaatgcataggggaacggcggcgtgcgtaataacggttggcatgatggtcgcttcggcaaaatgtcgatgctatcagcatggatgaacggggcgtagagggcaaaagtctgaaaagagaaccggcctgttgatacaggccgggaaagggatcaggcaacaacctgtacgctgtgacctgcaaaactcactgtctgaccggcgacaattttgcagcgtttgcgcgtttcaaccgcaccgtcgactttcacctggccttctgctatcgcgattttcgcctgcgcgccgctttcgctccagccttccagtttcagcaagtcgcacagctcaacgtgcggatgtttacctaaagaaaatgtcgccatgttactcaccctgtggatcatgatattcaacgcacgcctgtagcgtgttttcaatcagcgtggcaaccgtcatcgggccaacgccgcccggaacaggcgtaatgtatgaggcgcgtttagccgcgtcttcaaacacgacgtcgcccacaactttgccattttccagacggttgatgccgacatcaatcacaattgcgccttctttgatccagtcaccaggaataaagcccggcttgccgacggcaacgatcagtagatcggcattttctacgtggtgacgcagatttttagtgaaacggtgagtcacggtggtggtgcaacctgccagcagcagttccatgctcattgggcgaccgacgatattcgatgcgccaatcaccacggcgttaaggccgaaggtatcaatgttgtaacgctcaagcagcgtgacgataccgcgcggggtacagggacgcagacgtggcgcgcgctggcacagacgaccgacgttgtaaggatggaaaccgtccacgtctttgtccggatgaatacgttccagcactttgacgttatcaatacccgccggtaacggcagttgaaccagaatgccatcaatggtgttgtcggcattcagcgcatcgataagctccagcagctccgcttcgctggtggtttccgggaggtcataagagcgggagacgaacccgacttcttcacaagccttgcgtttgcttgcgacataaatttgcgatgcagggttactgcccaccagcacaacggccagtcctggtgcccgcagtccggctgcaatacgcgcctgaactttttgagcaacttcagagcgcacctgctgcgcaatcgttttaccgtcaataatctttgctgccatcagagagaggattccatctgttacgtaggtcgaaggggatgcgtctattttgtcagaagcgtggcgcgctgtcagttttcgttttctgaaaagtaaaaccttctgtacctggctgattcacacctatcatgataaccgtcgttggtttgccgccatagtgagctacatcagatgcggtcgtacacttgttcagcaactggttcaaaagccattgactcagcaagggttgaccgtataattcacgcgattacagcacaccgtggtatcaatgcgcccttagctcagttggatagagcaacgaccttctaagtcgtgggccgcaggttcgaatcctgcagggcgcgccattacaattcaatcagttacgccttctttatatcctccataattccacagtgggacatatttgggacattatcaccaaaaatgtcgtctattttccttgcatgctctgtcaaatgattaggcgcaaggtgagcatacctacgaaccatttctatggactcccatccgcccatttcctgaagcacagataatgggacgcctgactggatcagccagcttgcccaggtgtgtctgaggtcatggaaacggaaatcttcaattcctgcacgacgacaagctgatagccatgatgtcttgctgtcgatgcgcatcttcctgaccgcaggcgttgatgttccatctgctcgcttagccgccttggtatgtacaaacacccatttgtgatgcttgcctatttgatcacgcaacactttacaggcggtatcgttcagcgccacaccaatggcgcggtttgatttgctctcttctggattcacccaggcaactcgtcgctgcatgtcgatttgttgccattccagatttatgatgttcgactttctcagaccagttgccagcgcaaacttgacgacagatttcagtggttcggggcactcatcaataaggcgttttgcttcctccttttccagccatctgactcgcttgtttctgaccgctggtatcttgatgacaggcgctttttccagccacttccagtcgcgttctgcagcacggagaatggcctttatcatggcaagatgctttgcctttgtctgagttgatactggctttggttcataaacaggcggttctttacctttcctgatggcggcctgaactttctgtttccatatttctttcgtctttctgttatgcattctgcttacagcagagtaaatctttgcctccgagatatctttaagccttataccctcaaaatgttcaagccagaactcaatccggcttttatctgaatcgagagattttttatcagctttttcctcaagccatcttaggcaggcctcttcaaaagtgacatcaggtaaatcccctagcttttctactcgccagagttctgcttttcgcttgtcgtgcaactcctgagcttgccgcttgtcctttgtgccaagagattccttaattcgtttcccgcccgggagcgaatacgaggcataccatatttcatttctgcggaagagtgacattttctttcctctgttatgccatcacccgcgctcacctggacagtatgcagcggagactgaagcgccgcaatgcaagcttgccgtgttgtgaggtaaggagattttggcttggttggatctttacgtgttgcctgtaggcggcctgttcgtatccagttggtggcggttggtctggatatcttaagaaactgacaggcctcatcgagtgtgaggctgtatggctccattatttcacctcttgctgtgtcattgttgaaaaatggataccagctcgttgctgccagacgatccaaccgagagtcatatcccatgccatgtattcgttatcgccgttttttactctccgacgatctactaagtcaccgaaacgcttttccatgaataattcataggcttcgcgttcatctggctctacttccagagatacgagtgcgatttcataagcacggcgctcaatatcgtctcgaacctctaggctgctgattcgttctttgatttctttaatcagttctttattggtaaatgtggtcattatgctccagcctccggtgcttttggcattactgcccagtgagtgatattgacgttttcaaggtccccgacctgaaatgtccactgccattctccggtttctttttgtccccaggtgtaccagagagaacgccagccaatcagccagccttctccattagcatcaaataacagaacactttcatttgctggtggcagttcagctgacactggtattattttgttttccagtgccgcacatttagcttcaagcgcgtcgaatttacgtaacaggtactcagcatttgtttcattcactttcagatctcgcggtacacatttcccgcgaagaaacccttccatttcgaaaacattcatgcgcatttgcgtaactccgataaatcgttaaaacgttccataaacatcccgtagacatgacccggtgccagtggaatcacgttgaacatctctgttgccgggatgccttccagtacaggccagaaagagccatcatcaagcccgagatcgcggcgttcggttgccagcatgatgagatcggcatatttcacgggtgtactcataactgggggtaacccgtatttctcacggattacggcgtctattttttcttccatccgtttatagtcaggaagaaggcgtttcagcggcgcggggatgtcctggcaatacgcttctgttgcatcatgcattaacgcttcaaaagcaaattcctgcggcaccagctggctgcaaagcaccgcatgttgggcgacactgtagaagtgtgaaagatgaccggcaaagcgacagatatttgaaagggaaaccgcgatatcgttaatcacgatgtcgtctttatttatcctgtcataataaaaatgcttcccggaaaaagttttaataaatgacattttgttctccgcgtatatgtgctgcaccacgctgaattctggtaaaaggaagccctcaccatccggcgattattgagtcaattacgtttccataaatgcccccgcaggggcatttgcagtaatgaaatcaggcggtgaaagtaccaataaaggtttctactttgctgtctttgaatttctcaacaagcagatcacgaaattcgttagccatttcttcctgcactgcttccagctgaataatgcgcagaaccagtacaggacgatcgccagtgataatgctgaggcgtaatttaaacggacgttctttcaggccttcaaacggaacgcatttaaattcaaatgccactggcataatatctttggttttcgcttcgacagactccatcagggagcgtttgccgctgaagtcattgtcttcaaaatcagcggtctggtttgcttcaatcgtgattttacggacagccgcagccgcttttgttgcctgaatggcgtcaccattagcatcaaagcccacaaggtagtcggcccagtcttcaatccattctgccagtgacttctgggagttacgctcgccgttaacagacaacagagcagagaacggtgctgtctttttcagtttgagagtggcggtgttatctgcgtgacctggttcatcaatagtacccaggttaagcacactgacggcacgcatattatcggcatcgataaagcagcgggtgccttcatctgcaagatctttagaataacgggtaaagtcatcgatgctggcagtggaaagcgcaccacggaaacggaagcgatttaaattaaatttttccagatcatgaatgcggaaattctcaggcaatgccacagcatcggcaccaatcttactgataatttcattaacaccctgagcagaaataagggcatggatttgattaattgcggttgcgtctaagttctgagacataataagtcctcactatataaagatattcagtgatgagataaataatcagtttattacgaacgatattaacgactgctgcgcggagttttccgtcaggttcaccggcaagagtcagtaattgtccctggtcttcctgcagaatagtcaggcgaccaccgcgattgacatacatcggcgtttcggtggtgtcttcttcggaaattttcccgcggttagttgggcgaacatatgagagtttgtgtttgattttcacacggttctcatcaaacggttcgatttccagattgagtgagaccttccctttggttttcgtgttcatcacaccggaagcgacctcactgagaactgcgccgattttggtttcaaatacgccgccgtccagctccccgataaatgcctgcacatcagtactgcgttcgctagccattttgctgctcctcatcatatcgaccctgcaaggtcggttggtttctccacaaaacagagaagaacacctgcggtggcagccgcccggatggattgggttatgagcccgtcgtccggtgatgctcttctctgttttgcaaaaaaggacggtaccagccggaagcaagggtacaaactggtaccgccaggactacacacagcataaagttgtggtgccgggtgcctcccggtgcctggcgaaggttgcacaccaggcgggtgggtatccacagaaggtcgactgtcagcctcaaccttaacccgcgtgcgctgagccgcattcaccacaacgctaaggattctctctggttgaaaatacttagctgttatgtgcctgcttttagccacatcaggcgaggtggacctggttattccccaacaacaaggattcggttaatctggatatccccaacaacaataagagtattcaatgtgatcgctgaattaacggcagcaatgacggctattcgtgaaacagcccagattgcaaaactaatgaacgaggcaaaaactcaagctgaagtaaatgcggctattggtgagctgaactcaaagcttgcgtctattcagcgcgaatgcgtgtctctcgttgaactggtgggctcttatcaagaaataaatgcttctctcaaagctaaaattgcagaattcgaaaactttgaggctcagacggaaggctatatccttaaccaacttgagtcgggtacttttgtatactcgaaggaggtaatcgtgaacggtggcagcataaccatgcatctttgcccaaaatgttttggacaaaagatagtatcgatacttcaaccattcccggttagcgaagatgagctttttcataaaagcaggtgcctccactgtgaaaataagtttctgatgaataaaaatccggattacgtatcgcctccatccattgaggagttgtccagaaaacttaacggcaatctgtagattactactgttgtggatatccagattgttaaagagctaagcgtcctgtagggcgcttttttgttgctaacgaatcatccggtcattcatacgccaccggcggctacttcgtgggcgtcctgcctgtccgtgatagcttacattatgttgctacttaaagtagcaaaaatcaacaacaaaaagtagatatttgttgttgtctatgatttttctataattaattgaaagttaaatgtttttgctgatttactatgctgtaaactgaaaatatcgcacgaagttggagtaggtattgagcatagtgaattatgaggagggagttttttatgagattaatcagggagaaagaagagtaaagcccggttatgcggccgggcacatgcattactttgtaagttctagaactcgttgagccagccctttaaattgttcgttaaaggcgtctctgcttgatttcattgtatttaaggcatgcccaaattgccctgaatcgcgaatttgctgatcactgatggagaaaacaggtgtcgctagttgttggcttattgcgattaatgagttgaaatcggaaatatgcgcaagatcataggctgataaatctccactgactgttgttttgttaattgcatgttgcactttatctcgtggaattatgcaggtaattttttctagatttggcactaagatcgaatcaacagcatcacggatagctgccatccatttttcgaaagattttacaggtgctcctttacgcggcctgtatctctgctgaatcatacctagaaactgcggtgcatttttaattgattgtgaagagttaccatcattattttctttaaataatgctaattctttgtgnnnnncattccattcattaattaattaatgaatgaatgnnnnncctcagtttgcgattgaaggtctgctcaattacgcgatggcaatggataacccgacattgaacaaattgagtgaagaaacccggttacagatcatcccttaccttgtgagttttgcctttgctgattattccaggtctgcggcaagtaaggctcgctgtgagcattgtgctggtactggatttcatagtgtattgcgcgaagtggtgaaacactccagaagcggggaatctgttatcaaggaagagtgggtgaaggaattatgtcagcattgccatggtaagggagaagtcagcacggcttgcagagggtgtaagggtaaaggcattgtcctggatgaaaaaagaacccggcttcatggcgcgcctgtttataagatttgtgggcgttgcaatggaaaccggtttagtcgtttaccgaccacactggcacgacgtcatgtccagaagctggtaccagacctgactgattatcagtggtacaaaggatatgcagacgtcattgataaactggtaacaaagtgctggcaggaagaagcattcgctgaagcacaattgagaaaggtgacgagataagtgattttcaccgaagatggcgacatgatgcttgcatttctcaaaaaatatggataagattttcccaacgatgggctttgtatgtctaccgttgatgagtccaagaacccgccgccgagcgggttaaattattttttcttacacggggatatggatgttataccgagatcttttgcctattttctcagaaagacccatatttaaagctcctgaggctgaaagaatacttcgtgagcaatattctatcgccgcccccactcctgtaattcaggagatttattatggattggcaggttatgacagatttcaggagctttatggggatcttaatattgaccaaatcgaatggaaattgattgaacttcccactaaaaattttttaactatcggggataatgctacttaccctgattttttgcatgaggtcgttgaagatttcacaacccgtaaaggcgatgtatttatggatgatgaaataaaagcgcattggtgtaattttggcacatggtgtgaacctccattttttatagatcgagctttgctgaaaagtaatacaacagggcttcatttaatggaagggcatacaagagttggaaccctgttaggggcagttaagtataacttcgttaagcttgctaatactcataaaatttattatgcgcaagcaaaagaatgtattaaataagttgagtgaaattactgttttttttttaacaatacttaccgcgttctcgcggtttttttataaattaaacattggtgcagtacggtaaacacgctggtggtcgtgaatactgactttttatcttgctggctttttagacaagagttattggtatgtcatgttaaccatgaaggtaaaaagacatgctaaaacagcaagatatgacagaaacggcgaaagttgtttttaatgaattaaacggcaaaccggcaacagtcggggagatagcacaaaacacatacctttcacgcgaacgctgtcagttaatactgacccagctggttatggcggggctggcagattaccagttcggctgttacagacgccttcagcaatgaagggcttttaatttgtgaaaatgggcggctggtgggtgttggtagcacctgccagccattcgctcatgcttactggtcacaagcgaaccatggcccactgctttagcgcaaaagcagagtgagcctaccagagttacgcttactgatccatgaaaaacactgtaaaaataaacagtattgatttaatcaacgctgattgcctgcattttattcagtccctgcctgatgattccattgacctgattgttaccgatccgccttacttcaaggtgaaacccaacggttgggacaatcagtggaaaggggacgaagattaccttaagtggctggaccactgtctggcccagttctggcgggtgttgaaacctgccggaagcctttacctgttctgtgggcatcgcctggcatctgatattgagatcatgatgcgtgaacgtttcaacgtgcttaaccatatcatctgggcgaagccgtccggacgttggaatgggtgtaataaagaaagtctgcgcgcatattttcctgccacagagcgcgttctgtttgctgaacattaccgggggccatatcgcggcaaaagtgacggctatgtggcaaaagaaagggaactcaaacagcacataatggcaccgctgatatcgtatttcagggatgctcgtgccgaactgggtataacggcaaaacaaattgccgaagccacaggtaagaaaaatatggtttcccactggtttggtgccagtcagtggcagttgccgaatgaggctgactaccggaagttacaggcactgttttcccgtatagcggcagagaagtttcaggaacaacaactggaacaaccacaccaccagttggtggcatcttatgattcactgaatcgcaaatattctgaattgctggatgagtttaaatctctccggcgctatttctccgtatcagtctccgtgccttataccgatgtctggatgcataaacccgttcagttctacccgggtaaacatccgtgtgagaaaccggcggatatgctcaggcaaataatcaatgccagtagtcgacccggcgatctggttgctgatttctttatgggatccggttccacaataaaagcagcaatggcgctggggcgtcgggcgttaggtgttgagcttgagacagagcggtttaatcagaccatccaggaaatcagtatgttatcagcaaatacaattttgtgaattaattcaattattggtgggatgtctgtgccgtataatgattacagatacagtgtatcctgcaatgcagcagggctgatgtggtgggttgtacatagcctgcaaaggattggcttcattaattcatcgttgatacaagcgagtcacggttgaccacgccaacggctcatcggtaaaaatccgacaccgtgtcttcttaactcacttattgtttccacccatgtttttggatacctgctgtagctgtcagattagcgcgataatctgacagctttttttttacaacgaatccttctgatctgcttttgcggggcttttttgtatccgctccatgcccggcgtataagcggaggttggtcagttttctaaaaattgaaatacctcacaattcagccagttaatggttgtttgtctggcgaagagtttgtaaataaaaaaacgcatggtgaatccccctaagcggcggggcgaatcagcagtcagttctgggataatcgcgggttcgtatgctgatgccggactcaccgggaggcacccggcaccatgcatcatggtcatccccttgtatgatacccctctccggaggggtattttttggataaaaaagcccgcgctgggaggcacgggcggcaaggaataaaacgtgaagaaattttcacaggcgcataataatccgatgttgccagattttgcaactgcatcatctggttattatgtgagctggaaaatcagattctgtatggactgaagccatgctgttatttagggccaaagagctggctttttcccgccttctctccagtaacgattaatgagaaaagaatgaaatgcttttcctggggaggagggcagtagaaaaaagaacccgccagcaaaaatatgggggatgaacagcttttgctactcaggttgctggcgggtatggttcttcatgaaataagaatgttacgcggtatttttaatgaaaatgataattattgtcaattggttgtgcgtattttttcatacatgactggtaaaggtgattcaggccatcagagttttgctgatggccttttttctttccggtagcacaggtctgttggggcgggatatgtatcagatggaaaaaatatcaacaggcattgcctacggcacctccgcaggcagtgctggctactggtttttacaatggcttgatcaggttagtccgtctcagtgggctgcgattggtgtactgggaagtctggttctgggctttctgacttatctgacgaatctgtacttcaaaatcagagaagacagaagaaaggctgcgagaggagagtaatataatggtccaaaactatgaaatgattgtgaaagggatccgcaattttgagaataaagttacggtaactttagcattacaggacaaagaacgctttgacggtgaaatttttgacctggacatctcgctggaccgtgttgaaggtgccgcgctggagttttatgaggcagcagccagaaggagcatcagacaggtcttcctggatgttgctgccgggttatgtggaggggatgagcagtcgccggaaaagcgccccataattttagaggcgcagagtgtgtggataacctacaaaggaaaactgccgggaagaattactggttcactgaagactccgccgaaatggtaatttcaccagcatatttttcctccagtaataccgccagccacttgaaagaattttgttgttgctgggaccatttgggattgattgattcaagctggagcgatgccagtgttggttgcatttgttccttgggaattgagaatgccagatatgaaaatgcgacagcaagggcatttacatcatcccgaagcctggaaatgcagtcgagcaactcctgtagagaaatggtgctattgtccataaacaatcctctctattgtatttaactattccttgcctgattcaacaggccgggacagataaacatatccagggttcagaaaccgataaatcctgataaatatccatgaacgcaaaaatcagatacagcctgtcggctactgtactagtgctgattggtgcaggcgcgtctgctcctcaaatacttgaccagtttctggacgaaaaagaaggtaaccacacaacggcataccgtgatggttccggcatctggaccatctgtcggggtgccacgatggtggatggaaaacccgtttttcccggtatgaaactgtcgaaggaaaaatgcgaccaggttaacgccatcgaacgtgataaggcgctggcatgggtggaacgtaatattaaagtaccactgaccgaaccacaaaaagcgggtatcgcgtcattttgcccctataacattggccccggtaagtgtttcccgtcgacgttttataagcggcttaatgccggtgatcgtaaaggtgcctgtgagtcgattcgctggtggattaaggacggtgggcgtgattgccgcacacgttcaaataactgctacggacaggttattcgtcgtgaccaggaaagcgcattagcctgttgggggatagatcagtgagaagagtagccgcgattatctccgctctggttatctgcatcatcgtctgcctgtcttgggctgttaatcattaccgtgataacgccattacctacaaagccctgcgcgacaaaaatgccagagaactgaagctggcgaacgcggcaattactgacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcagtgcagatagagttgctcatatcgatgggcaactcatgcaattattttgagcaatacacccgcgcttccagcggagtataaatgccaaaagtgatgaaaccgagcaatccatttacgaatgtttgctgggtttctgttttaaccacattttctgcaccaccacaaatttttgctgcatcgacagttttcttctgcccaattcccgaaacgaagaaatgatgggtgatggtttcctttggtgttactgctgtcggtttgtttccaacagtaaacgtctgttgagcacatcctgtaataagcattgccagagcggcagaaaacaacatttttttcatcttattatcctgcattgttaaaaacggcagaatcctatgtgacaacaattaaacgatagttaaatggattgatgaaaattaaaactacacaggtgggctcagactattggaggaagttggggacactcagaatcctgtggaatgaaataaaccggtctatccgtccattacccttttagctgcgctgtatcgtcgccgtattcccgcattaaccatgaccgtagcccgacggggaattccttctgcgtgagtgtgcgggaataattaaaaacgatgcacaccgggtttttaccgcgttaatgattcgcgggtttatcccggtgcgatggtggaagaaacaggaagctgtattacagaaagtgctactactgtatcccgatgcgatgtatgtaatgtgagtcagataatggcacaggatgtggtgatgtggcagtctggaacacaggatatattgtcagaataagacccgtaggaataaaaatgaaaagacgccttttactactttttctgttatctgtcctggcagtgggatgctcgcagcaaaaagctgatgagccccggcaattagtgacggtgtatccacgatatccggaatatgctgcagcaaattatatcaaggggctggttgaggttaagttcgatattggtgctgatgggactgtgacacggatcgtttttctccgctcagagcctcataatttgtttcgtgatgaagtggtgaaggccatggcgaaatggcgatttgaaaagaatcgcccctgtcagggagtgaagcgacaatttatctttacgccgtcacgtccctgatgcttccaggtagagaggggctggaagcaggagaaaaatgaaagagccagcggttatatttttgtcatggctgacgaggaatgatggaagaaggcgttgtatgccacacaacgcctcactgttcatttcttctttttctctagtggaacccgatgaataagagttgcactggtttccgatgagatggcgatatactcgggcaaagtatgctggcagttttccaactggtcaaaaatacctgctctcgtctgttgcaatgcctgcagcatgcggcggcaatgcgccttgcttttgctaaccatctttccttcctctatcagtcgctgcgtgaactcatcatggaataccaggtaaatgcggatgttatcggttttggctacgcagcatagtacaaaacggacaggtgcatcccgggacgggggaggcgtcacatgtccctgtgatggttgttccgggtaatgcactgtgtggggcataaaaatgtccgataattttactttctaccgcagttagttgattcgttggtcctggtagcacattgggcgaggatttaaatgccaggcaactgaaggatgatgttgcaagggagatagcgagaatatttctgattttcatttgatgatgcctctgtgtgaaatgacggtaaacgacgcacttgtgccggcacataatagcaagcaccataatagatcagattcgattcttgctgtaagtgataattattctcgtttttcgggtcctttccggcgatccaacaggctacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtcaacaaaaagcagctggctgacattttcggtgcgagtatccgtaccattcagaactggcaggaacagggaatgcccgttctgcgaggcggtggcaagggtaatgaggtgctttatgactctgccgccgtcataaaatggtatgccgaaagggatgctgaaattgagaacgaaaagctgcgccgggaagttgaagaactgcggcaggccagcgagacagatctccagccagggactattgagtacgaacgccaccgacttacgcgtgcgcaggccgacgcacaggagctgaaaaatgccagagactccgctgaagtggtggaaaccgcattctgtactttcgtgctgtcgcggatcgcaggtgaaattgccagtattctcgacgggatccccctgtcggtgcagcggcgttttccggaactggaaaaccgacatgttgatttcctgaaacgggatatcatcaaagccatgaacaaagcagccgcgctggatgaactgataccggggttgctgagtgaatatatcgaacagtcaggttaacaggctgcggcattttgtccgcgccgggcttcgctcactgttcaggccggagccacagaccgccgttgaatgggcggatgccagttactatctcccgaaagaatccgcataccaggaagggcgctgggaaacactgccctttcagcgggccatcatgaatgcgatgggcagcgactacatccgcgaggtgaatgtggtgaagtctgcccgtgttggttattccaaaatgctgttgggtgtttatgcctacttcatagagcataagcagcgcaacacacttatctggttgccgacggatggtgatgccgagaactttatgaaaacccacgttgagccgaccatccgtgatattccttcgctgctggcgctggccccgtggtatggcaaaaagcaccgggataacacgctcaccatgaagcgtttcaccaatgggcgtggcttctggtgcctgggcggtaaagcggcaaaaaactaccgtgaaaagtcagtggatgtggcgggttatgatgaacttgctgcctttgatgaggatattgaacaggaaggctctccgacgttcctgggcgataagcgtattgaaggctcggtctggccaaagtccatccgtggctccacgcccaaagtgagaggcacctgccagattgagcgtgcagccagtgaatccccgcattttatgcgttttcatgttgcctgcccgcactgcggggaggagcagtaccttaaatttggcgataaagagacgccgtttggcctcaaatggatgccggatgatccctccagcgtgttttatctctgtgagcataatgcctgcgtcatccgtcagcaggagctggactttactgatgcccgttatatctgcgaaaagaccgggatctggacccgtgatggcattctctggttttcgtcatccggtgaagagattgagccaccggacagtgtgacctttcacatctggacggcgtacagcccgttcaccacctgggttcagattgtcaaagactggatgaagacgaaaggggatacgggaaaacgtaaaactttcgtaaacaccacgctcggtgagacgtgggaggcgaaaatcggcgaacgtccggatgctgaagtgatggcagagcggaaagagcattattcagcgcccgttcctgaccgtgtggcttacctgaccgccggtatcgactcccagctggaccgctacgaaatgcgagtatggggatgggggccgggtgaggaaagctggctgattgaccggcagattattatgggccgccacgatgatgaacagacgctgctgcgtgtggatgaggccatcaataaaacctatacccgccggaatggtgcagaaatgtcggtatcccgtatctgctgggatactggcgggattgacccgaccattgtgtatgaacgctcgaaaaagcatgggctgttccgggtgatccccattaaaggggcatccgtctacggaaagccggtggccagcatgccacgtaagcgaaacaaaaacggggtttaccttaccgaaatcggtacggataccgcgaaagagcagatttataaccgcttcacactgacgccggaaggggatgaaccgcttcccggtgccgttcacttcccgaataacccggatatttttgatctgaccgaagcgcagcagctgactgctgaagagcaggtcgaaaaatggggggatggcaggaaaaaaatactgtgggacagcaaaaagcgacgcaatgaggcgctcgactgcttcgtttatgcgctggcggcgctgcgcatcagtatttcccgctggcagctggatctcagtgccctgctggtgagcctgcaggaagaggatagtgcaacaaccaacaagaaaacactggcagattacgcccgtgccttatccggagaggatgaatgacgcgacaggaagaacttgccgctgcccgtgcggcactgcatgacctgatgacaggaaaacgggtggcaacggtacagaaagacggacggcgagtggagtttacgaccacttccgtgtctgacctgaaaaaatacattgctgagctggaagtgcagaccggcatgacacagcgacgcaggggacctgcaggattttatgtatgaaaatgtccaccattcccacccttctggggccggacggcatgacatcgctgcgtgaatatgccggttatcacggcggtggcagcggatttggtgggcagttgcgggcgtggaacccatcgagtgaaagtgtggatgcagccctgctgcccaactttacccgtggcaatgcccgcgcagacgatctggtacgcaataacggctatgccgccaacgccatccagttgcatcaggatcatatcgtcgggtcttttttccgactcagtcatcgcccaagctggcgctatctgggcatcggggaggaagaagcccgtgccttttcccgcgaggttgaatcggcatggaaagagtttgccgaggatgactgctgctgcattgacgttgagcgaaaacgcacgtttaccatgatgattcgggaaggtgtggccatgcacgcctttaacggtgaactgttcgttcaggccacctgggataccagtccgtcgcggcttttccggacacagttccggatggtaagcccgaagcgcatcagcaacccgaacaataccggcgacagccggaactgccgtgccggtgtgcagattaatgacagcggtgcggcgctgggatattacgtcagcgaggacggctatcctggctggatgccgcagaaatggacatggataccccgtgagttacccggcgggcgcgcctcgttcattcacgtttttgaacccgtggaggacgggcagacccgcggtgcaaatgtgttttacagcgtgatggagcagatgaagatgctcgacacgctgcagaacacgcagctgcagagcgccattgtgaaggcgatgtatgccgccaccattgagagtgagctggatacgcagtcagcgatggattttattctgggcgcgaacagtcaggagcagcgggaaaggctgaccggctggattggtgaaattgccgcgtattacgccgcagcaccggtccggctgggaggcgcaaaagtgcctcacctgatgccgggggactcactgaacctgcagacggctcaggacacggataacggctactccgtgtttgagcagtcactgttgcggtatatcgctgccgggctgggtgtctcgtatgagcagctttcccggaattacgcccagatgagctactccacggcacgggccagtgcgaacgagtcgtgggcgtactttatggggcggcgaaaattcgtcgcatcccgtcaggcgagccagatgtttctgtgctggctggaagaggccatcgttcgccgcgtggtgacgttaccttcaaaagcgcgcttcagttttcaggaagcccgcagtgcctgggggaactgcgactggataggctccggtcgtatggccatcgatggtctgaaagaagttcaggaagcggtgatgctgatagaagccggactgagtacctacgagaaagagtgcgcaaaacgcggtgacgactatcaggaaatttttgcccagcaggtccgtgaaacgatggagcgccgtgcagccggtcttaaaccgcccgcctgggcggctgcggcatttgaatccgggctgcgacaatcaacagaggaggagaagagtgacagcagagctgcgtaatctcccgcatattgccagcatggcttttaatgagccgctgatgcttgaacccgcctatgcgcgggttttcttttgtgcgcttgcaggccagcttgggatcagccgcctgacagatgcggtgtccggtgacagcctgactgccccggaggcacccgcgacgctggcgttatccggtgatgatgacggaccacgacaggcccgcagttatcaggtcatgaacggcatcgccgtgctgccggtgtccggcacgctggtcagccggacgcgggcgctgcagccgtattcggggatgaccggttacaacggcattatcgcccgtctgcaacaggctgccagcgacccgatggtggacggcattctgctcgatatggatacgccaggcgggatggtggcaggggcatttgactgcgctgacatcatcgcccgtgtgcgtgacataaagccggtatgggcgctggccaatgacatgaactgcagtgcagggcagctgcttgccagcgccgcctcccggcgtctggtcacgcagaccgcccggacaggctccatcggcgtcatgatggctcacagtaattacggtgctgcgctggagaaacagggcgtggaaatcacgctgatttacagcggcagccataaggtggatggcaacccctacagccatcttccggatgacgtccgggagacactgcagtcccggatggatgcaacccgccggatgtttgcgcagaaggtgtcggcatataccggcctgtccgtgcaggctgtgctggataccgaggctgcagtgtacagcggtcaggaggccattgatgccggactggctgatgaacttgtcaacagcaccgatgcgatcaccgttatgcgtgatgcactggatgcacgtaaatcccgtctctcaggagggcgaatgaccaaagagactcaatcaacaactgtttcagccactgcttcgcaggctgacgttactgacgtggtgccagcgacggagggcgaaaacgccagcgcggcgcagccggacgtgaacgcgcagatcaccgctgcggttgcggcagaaaacagccgcattatggggatcctcaactgtgaggaggctcacggacgcgaagaacaggctcgcgtgctggccgaaacccccggtatgaccgtggaaacggcccgccgcattctggccgcagcaccacagagtgcacaggcgcgcagtgacactgcgctggatcgtctgatgcagggggcaccggcaccgctggctgcaggtaacccggcatctgatgccgttaacgatttgctgaacacaccagtgtaagggatgtttatgacgagcaaagaaacctttacccattaccagccgctgggcaacagtgacccggctcataccgcaaccgcgcctggcggattgagtgcgaaagcgcctgcaatgaccccgctgatgcttgacaccgccacccgtaagctggttgcgtgggatggcaccaccgacggtgctgccgttggcattcttgcggttgctgctgaccagaccagcaccacactgacgttctacaagtccggcacgttccgttatgaggatgtgctctggccggaggctgccagcgacgagacgaaaaaacggaccgcgtttgccggaacggcaatcagcatcgtttaacctgacccttcatcactaaaggccgcatgtgcggctttttttacgggatttttttatgtcgatgtacacaaccgcccagctgctggcggcaaatgagcagaaatttaagtttgatccgctgtttctgcgtctctttttccgtgagagctatcccttcaccacggagaaagtctatctctcacaaattccgggactggtaaacatggcgctgtacgtttcgccgattgtttccggtgaggttatccgttcccgtggcggctccacctctgaatttacgccgggatatgtcaagccgaagcatgaagtgaatccgcagatgaccctgcgtcgcctgccggatgaagatccgcagaatctggcggacccggcttaccgccgccgtcgcatcatcatgcagaacatgcgtgacgaagagctggccattgctcaggtcgaagagatgcaggccgtttctgccgtgcttaagggcaaatacaccatgaccggtgaagccttcgatccggttgaggtggatatgggccgcagtgcggcgaataacatcacgcagtccggcggcacggagtggagcaagcgtgacaagtccacgtatgacccgaccgacgatatcgaagcctacgcgctgaacgccagcggtgtggtgaatatcatcgtgtttgatccgaaaggctgggcgctgttccgttccttcaaagccgtcagggagaagctggatacccgtcgcggctctcattccgaactggagacagcggtaaaagacctgggtaaagcggtgtcctataaggggatgtatggcgatgtggccatcgtcgtgtattccggacagtacgtggaaaacggcgtcaaaaagaacttcctgccggacaacacgatggtgctgggtaacactcatgcacgcggtctgcgcacctatggctgcattcaggatgcggacgcacagcgcgaaggcattaacgcctctgcccgctacccgaaaaactgggtgaccaccggcgatccggcgcgtgagttcaccatgattcagtcagcaccgctgatgctgctggctgaccctgatgagttcgtgtccgtacaactggcgtaatcatggcccttcggggccattgtttctctgtggaggagtccatgacgaaagatgagctgattgcccgtctccgctcgctgggtgagcaactgaaccgtgatgtcagcctgacggggacgaaagaagaactggcactccgtgtggcagagctggaagaggagcttgatgacacggatgacgctgccggtcaggacacatctgtcaacccggaaaatgcgctgaccgggtatgaaaataacgtggtatcagcgcagccggataccgtgactgatacggctgctctggtcacggtcgtggcactggtgacgctgcatactgatgcacttcacgccacgcgggatgaacctgtggcatttgtgctgccgggaacggcgtttcgtgtctctgccggtgtggcagccgaaatgacagagcgcggcctggccagaatgcaataacgggaggcgctgtggctgatttcgataacctgttcgatgctgccattgcccgcgccgatgaaacgatacgcgggtacatgggaacgtcagccaccatgacatccggtgagcagtccggtgctgtgatacgtggtgtttttgatgaccctgaaaatatcagctatgccggacagggcgtgcgcgttgaaggctccagcccgtccctgtttgtccggactgatgaggtgcggcagctgcggcgtggagacacgctgaccatcggtgaggaaaatttctgggtagaccgggtttcgccggatgatggcggaagctgtcatctctggcttgggcgtggcgtgccgcctgccgttaaccgtcgccgctgaaagggggatgtatggccataaaaggtcttgagcaggccgttgaaaacctcagccgtatcagcaaaacggcggtgcccggtgccgccgcaatggccattaaccgcgttgcttcatccgcgatatcgcagtctgcgtcacaggttgctcgtgagacaaaggtacgccggaaactggtaaaggaaagggccaggctgaaaagggccacggtcaaaaatccgcaggccagaatcaaagttaaccggggggatttgcccgtaatcaagctgggtaatgcgcgggttgtcctgtcccgccgcaggcgtcgtaaaaaggggcagcgttcatccctgaaaggtggcggcagcgtgcttgtggtgggtaaccgtcgtattcccggcgcgtttattcagcaactgaaaaacggccggtggcatgttatgcagcgtgtggccgggaaaaaccgttaccccattgatgtggtgaaaatcccgatggcggtgccgctgaccacggcgtttaaacagaatattgaacggatacggcgtgaacgtcttccgaaagagctgggctatgcgctgcagcatcaactgagaatggtaataaagcgatgaaacatactgaactccgtgcagccgtactggatgcactggagaagcatgacaccggggcgacgctttttgatggtcgccccgctgtttttgatgaggaagattttccggcaattgccgtttatctcaccggcgctgaatacacgggcgaagagctggacagcgatacctggcaggcggagctgcatattgaagttttcctgcctgctcaggtgccggattcagagctggattcgtggatggagtcccggatttatccggtgatgagcgatatcccggcactgtcagatttgatcaccagtatggtggccagcggctatgactaccggcgcgacgatgatgcgggcctgtggagttcagccgatctgacttatgtcattacctatgaaatgtgaggacgctatgcctgtaccaaatcctgtaatgccggtgaaaggtgccgggaccaccctgtgggtttataaggggagcggtgacccttatgcgaacccgctttcagacgttgactggtcgcgtctggcaaaagttaaagacctgacgcccggcgaactgaccgctgagtcctatgacgacagctatctcgatgatgaagatgcagactggactgcgaccgggcaggggcagaaatctgccggagataccagcttcacgctggcgtggatgcccggagagcaggggcagcaggcgctgctggcgtggtttaatgaaggtgatacccgtgcctataaaatccgcttcccgaacggcacggtcgatgtgttccgtggctgggtcagcagtatcggtaaggcggtgacggcgaaggaagcgattacccgcacggtgaaggtcaccaatgtgggacgtccgtcgatggcagaagatcgcagcacggtgacggcgacgaccggcatgacggtgacacccgccagtgcttccgtagtgaaagggcagagcaccacgctgaccgtggcattccagccggatggcgcaaccgacaagagcttccgtgcggtgtctgcggataaaacaaaagccaccgtgtcggtcagtggtatgaccatcaccgtgaaaggtgttgctgcaggcaaggtcaacattccggtcgtatccggtaatggtgagtttgctgcggttgcagaaatcaacgtcaccgccagttaatccggagagtcagcgatgttcctgaaaaccgaatcatttgaacataacggygtgaccgtcacgctttctgaactgtcagccctgcagcgtattgagcatctcgmcctgatgaaacrgcaggcagaacaggcggagtcagacagcaaccggmagkttactgtggaagacgccatcagaaccggygcktttstggtggcgatgtccctgtggcataaccatccgmagaagacaaagcwgccttccatgaatgaagccgttaaacagattgagcaggaagtgcttaccacctggcccrcggaggcaattkctcatgctgaaaacgtggtgtaccggctgtccggtatgtatgrgtttgtggtgaatgatgcycctgamcaggcagaggackccgggcctgcagagcctgtttctgcgggaaagtgttcgacggtgagctgagttttgccctgaaactggcgcgagagatggggcgacctgactggcgcgccatgcttgccgggatgtcatccacggagtatgccgactggcaccgcttttacagtacccattattttcatgatgttctgctggatatgcacttttccgggctgacgtacacygtgctcagcctgtttttcagcgatccggatatgcatccgctggatttcagtytgctgaaccggcgygaggmtgacgaagagcctgaagatgatgtgctgatgcagaaagcggcagggcttrccggaggygtccgctttgrcccggacggraatgaagttatccccgcttccccggatrtggcggrcatgacggaggatgacgtaatgctgatgacagtatcagaagggatcgcaggaggagtccggtatggctgaaccggtaggcgatctggtcgttgatttaagtctggatacggccagatttgacgagcagatggccagagtcaggcgtcatttttccggtacggaaagtgatgcgaaaaaaacagcggcagtcgttgaacagtcgctgagccgacaggcgctggctgcacagaaagcggggatttccgtcgggcagtataaagccgccatgcgtatgctgcctgcacagttcaccgacgtggccacgcagcttgcaggcgggcaaagtccgtggctgatcctgctgcaacagggtggtcaggttaaggactccttcggcgggatgatccccatgttcagggggcttgccggtgcgatcaccctgccgatggtgggggccacctcgctggcggtggcgaccggtgcgctggcgtatgcctggtatcagggcaactcaaccctgtccgatttcaacaaaacgctggtcctttccggcaatcagtcgggactgacggcagatcgtattctggccctgtccagagccgggcaggcggcagggctgacgtttaaccagaccagcgagtcactgacggcgctggtgaatgccggtgtgcgtggtggtgagcagtttgaggcgatcagccagagtgtggcgcgtttctcctctgcatccggcgtggaggtggacaaggtcgctgaagccttcgggaagctgaccacagacccgacgtcgggactgacagcgatggcacgtcagttccataacgtgacggcggagcagattgcgtatgttgctcagttgcagcgttccggagatgaagccggggcattgcaggcggcgaacgaggccgcaacgaaagggtttgatgaccagacccgccgcctgaaagagaacatgggcacgctggagacctgggcagacaggacagcacgggcattcaaatccatgtgggattcggtgctggatattggtcgcccggacactgcccagggaatgctggagaaagcagaaaaggcttttgatgaggcggacaaaaaatggcagtggtatcagagccggagccaccggcgcggtaaaacctcagcatttcttgccaatctccggggagcatgggaggacagagcgaatgcgcaacttggactttcagccgccacgttgcaggccgatcttgaaaaggccagagagatggcagcaaaggactgggccgagtctgaggcatcacggctgaaatataccgaagaggcgcagaaggcttacgaacgcctgcagacgccgctggagaaatataccgcccgtcaggaagaactgaataaggcactgaaagacgggaaaatcctgcaggcagattacaacacgctgatggcggcggcgaaaaaggattatgaagcgacgctgaaaaagctgaagcagtccggtgtgaaggtgtctgcgggcgatcgtcaggaagacagtgctcatgctgccctgctgacgcttcaggcagaactccggacgctggagaagcatgccggagcgaatgagaaaatcagccagcagcgccgggatttgtggaaggcagaaagtcagttcgcggtacttggaggaggcggcgcaacgtcgccagctgtctgcacaggagaaatccctgctggcgcataaagatgagacgctggagtacaaacgccagctggctgtacttggcgacaaggttacgtatcaggagcacctgaacgcgctggcgcagcaggcggataaattcgcacagcagcaacgggcaaaacgggccgctattgatgcgaaaaaccgggggctgactgaccggcaggcagaacgggaagccacggaacagcgcctgaaggaacagtatggcgataatcctctggcgctgaataacgtcatgtcagagcagaaaaagacctgggcggctgaagacctgcttcgcgggagctggatggcaggcctcaggtccggctggagcgagtgggaagagagcgccacggacagtatgtcgcaggttaaaagtgctgccacgcagacctttgatggtattgcgcagaatatggcggcgatgctgaccggcagtgaacagaactggcgcagcttcacccgttccgtgctgtccatgatgacagaaattctgcttaagcaggcaatggtggggattgtcgggagtatcggcagcgccattggcggggctgttggtggcggcgcatccgcgtcaggcggtacagccattcaggcagctgcggcgaaattccattttgcgaccgggggatttacgggaaccggcggcaaatatgagccagcggggattgttcaccgtggtgaatttgtcttcacgaaggaggcaaccagccggattggtgtcggcaacctgtaccgcctgatgcggggctatgcggaaggtggttatgtgggcggtgccggaagtccggcgcagatgcggcgggctgaaggcattaattttaatcagaacaatcacgtggtgattcagaacgacggtacgaatggtctgccaggtccacagatgatgaaggcggtgtatgacatggcccgcaagggtgcccgtgatgaaatccaggcacagatgcgcgatggtggtctgttctccggaggtggacgatgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcaggtcagtatgttgcgtgttgggttcagcgcagagtttaaacaggtggtgaactgatgcaggatatccggcaggaaacactgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggaggcagtatcaggcgtatcccattcaggggagcggttttgaactgaatggcaaaggcaccagtacgcggcccacgctggcagtctctaacctgtacggcatggtcaccggtatggtggaagatatgcagagtctggtcggcggaacggtggtccggcgtaaggtttacgcccgttttctggatgcggtgaacttcgtcaacggaaacagagacgccgatccggagcaggaggtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtgcggttatcacggtccggcagtcgcggatgaatatgaccagccgacgtccgatatcacgaaggataaatgcagcaaatgcctgagcggctgtaagtttcgcaataacgtcggcaactttggcggcttcctttccattaacaaactttcgcagtaatcccatgacagagacagaatcagcgattctggcgcacgcccggcgatgtgcgccagcggagtcgtgcggcttcgtggtaagcacgccggagggggaaagatatttcccctgcgtgaatatctccggtgagccggaggcgtatttccggatggctccggaggactggctgcaggcagagatgcagggtgagattgtggcgctggtccacagccaccccggtggtctgccctggctgagtgaggctgaccggcggctgcaggtgcagagcgatttgccgtggtggctggtctgccggggggcgattcacaagttccgctgtgtgccgcatctcaccgggcggcgctttgagtacggggtgacagactgttacacactgttccgggatgcttaccatctggcggggattgagatgccggattttcatcgcggggatgactggtggcgtaacggtcagaatctctatcttgacaatatggaggcgactggtttttaccgtgtcgcactgacagaggcgcagccgggcgatgtgctgctgtgctgttttggttcatcggtgccgaatcacgccgccatttactgtggcgacggtgagctgctgcaccatattcctgaacaactgagtaaacgagagaggtataccgacaaatggcagcgacgcacacactccctctggcgtcaccgggcatggcacgcatctgcctttacggggatttacaacgatttggccgccgcatcgaccttcgtgtgaaaacgggggctgaagccatccgggcgctggccacgcagcttccgtcgtttcgccagaaactgaatgagggctggtatcaggtgcgcattgccgggcgtgatgcaggcgaaaatgaattatctgcccgtcttaatgaaccgctggcaaatggtgccgtgattcacatcgtgccgcgtctggcgggagctaaaagtggcggtgtgtttcaggtggtgctgggggcggcgctgattgcggtggcatggtggaaccctgtgggctggctgggtgctgcggctgtatcgggcatgtatgcggcaggggccagtatgattctgggtggtgtggcccagatgctggcaccgaaagccaggacgcccacggcagccagtacagataacggcaaacagaacacctatttctcctcactggataacatggttgctcagggcaatgttctgcctgttctgtacggtgaaatgcgcgtggggtcgcgcgtggtttctcaggagatcagcacggcagacgaaggtgacggtggtcaggttgtggtgattggtcgctgatgcaaaatgttttatgtgaaaccgcctgcgggcggttttgtcgtttatggagcatgacgaatgggtaaaggcagcagtaaggggcataccccgcgcgaagcgaaggacaacctgaagtccacgcagttgctgagtgtgatcgatgccatcagcgaagggccggttgaaggtccggtggatgggttaaaaagcgtgctgctgaacagtacgccggtgctggacagtgaggggaataccaatatctccggtgtcacggtggtgttccgggcaggtgagcaggagcagacaccgccggagggatttgaatcctccggctccgagacggtgctgggtacggaagtgaaatatgacacgccgatcacccgcaccattacgtcggcaaacatcgaccgtctgcgctttaccttcggtgtgcaggcactggtggaaaccacctcaaagggtgaccggaatccgtcggaagtccgcctgctggttcagatacagcgtaacggtggctgggtgacggaaaaagacatcaccattaagggcaaaaccacctcgcagtatctggcctcggtggtggtggataacctgccgccgcgcccgtttaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgccctgaaggaccgccataatgccgttgaggtgaactggattgacccggataacggctgggagacggcgacagagcttgtggaggacacgcaggccattgcccgttacggtcgtaacgtcacgaagatggatgcctttggctgtaccagccgggggcaggcacaccgcgccgggctgtggctgattaaaacggaactgctggagacgcagaccgtggayttcagcgtgggtgctgaagggcttcgccatgtaccgggcgatgtcattgaaatctgygatgatgactatgcsggkakcagcaccggyggkcgygtgctggcggtgaacagccagacccggacgctgacgctcgaccgtgaaatcacgctgccatcctccggtaccacgctgataagyctggttgacggtmagtggyaatccggtcagcgtggaggtycagtccgtcaccgacggcgtgaaggtgaaagtgagccgtgttcctgacggcgttgcmgratacagcgtgtgggggctgaagctgccgacgctgcgccagcgcctgttccgctgcgtgagtatccgtgagaacgaygacggcacgtatgccatcacygccgtgcagcatgtrccggaraaagargccatcgtggataacggggcgcactttgacggygaccagagcggcacggtgaatggtgtcacgccgccagcagtgcagcayctgaccgccgaagtcactgcagacagcggggaatatcaggtgctggcgcgatgggacacaccgaaggtggtgaagggcgtgagcttcctgctccgtctgaccgtracagcggaygacggcagtgagcgrctgrtcagcacrgccmggacgacggaaaccacataccgcttcacrcaactggcgytggggaactacaggctgacagtccgggcggtaaatgcmyggggrcagcagggcgatccggcrtcggtatcgttccggattgccgcaccggcagcrccgtckmggattgagctgacrccgggctattttcagataaccgccacgccgcatcttgcggtttatgatccgacggtacagtttgagttctggttctcggaaaagcggattgcggatatcaggcaggttgaaaccacagcccgctatcttggtacggcgctgtactggatagccgccagtatcaatatcaaaccgggccatgattattacttttatatccgcagtgtgaacaccgtaggcaaatcggcatttgtggaggccgtcggtcgggcgagcgatgatgcatccggctatctggattttttcaaaggcgagatagggaaaacccatctggctcaggagctgtggacgcagattgataacggtcagcttgcgcctgacctggctgaaatcaggacgtccattacggatgtcagcaatgaaatcacgcagaccgtcaataagaaactggaagaccagagtgcggcaattcagcagatacagaaggttcaggttgatacaaataataacctgaacagcatgtgggctgtgaagctgcagcagatgcaggacggacgcctttatatcgcgggtattggtgccggtattgagaacacccctgacggcatgcagagtcaggtgctgctggcggcggacaggattgcgatggttaatcctgcgaatggcaacacaaaaccgatgtttgttggtcagggcgatcagatattcatgaacgacgtgttcctgaaacgcctgacggctcccaccattaccagcggtggaaatccaccggcattttccctgacaccggacgggcgactgacggcgaaaaatgcggatatcagtggcagtgtgaatgcgaacgccgggacgctcaacaatgtcacgattaatgaaaactgtcgggttctgggaaaactgtctgcgaaccagattgaaggcgatctcgttaaaacagtgggcaaagctttcccccgggactcccgtgcaccggagcggtggccatcagggaccattaccgtcagggtttatgacgatcagccgtttgaccggcagattgttattcccgcggtggcgtttcgtggcgctaaacatgagcgggagaataacgatatttattcgtcatgccgcctgatagtgaagaaaaacggtgctgaaatttataaccgtaccgcgctggataatacgctggtttatacaggtgttattgatatgcctgctggtcgcggtcacatgacgctggagttttcggtatcagcgtggctggtaaatgactggtatcccacagccagtatcagtgatttgctggttgtggtgatgaagaaatccacagcaggtatcacgattagctgaattttcataacccatatgcgggcgccatttctggcgccttttttattgcagaaaagcgagaggtaattatgcgtaaagtttgtgcagccattttgtccgcagccatctgtctggccgtatccggtgcgcctgcatgggcgtctgagcagcaggccacactgagcgcagggtatcttcatgcccgtacgaacgctcccggcagcgataatctgaacgggattaacgtgaaataccgttatgagtttacggacacgctggggctgattacgtcattcagttatgccaacgctgaagatgagcaaaaaacgcattacagcgatacccgctggcatgaggattccgtgcgtaaccgctggttcagcgtgatggcggggccgtctgtacgcgtgaatgaatggttcagcgcgtatgcgatggcaggcgtggcttacagccgtgtgtcgactttttccggggattatctccgcgtaactgacaacaagggaaaaacgcacgacgtgctgaccggaagtgatgacgctcgccacagtaacacctctctggcgtggggagctggcgtgcagtttaacccgaccgaatccgtggccgttgatgtcgcttatgaaggctccggcagtggcaactggcgcactgacgggttcatcgtgggtgtcggttataagttctgattagccaggtaacacagtgttatgacagcccgccggttcaggcgggcttttttgtggggtgaatatggcagtaaagatttcaggtgtactgaaagacggtgcaggtaaaccggtacagaactgcacaatccagctgaaagcaaaacgtaacagcaccacggtggtggtgaacacggtggcctcagaaaatccggatgaagccgggcgttacagcatggatgttgagtatggccagtacagcgtcaccctgctggttgaaggttttccaccttcacatgccgggaccattaccgtctatgaaggttccagaccaggtacgctgaatgattttctcggtgccatgacggaggatgatgcccgtccggaggcactgcgccgttttgagctgatggtgaatgaagtggcacgtcatgccggagcgtcatcacagagtgcagcggcggcaaagaaatccgaaacggcagcagcctcatcgaagaatgcggcgaaaacctcagaaacgaatgcagctaacagcgcacaggcggcagcggcctcgcagactgcatcggcaaactccgcgacagcagccaaaaaatcagaaaccagcgcgaaaaatagcgagacagccacaaaggccagcgaaaaaaacgcaaaatccagccagacggcagcgaaaaccagtgagacgaatgccaaagacagtgaagccaacgcaaaggtgagcgaaacagcggcggcgaactcggcgaaagcatcggcagcaagccagacggcagcaaaagcaagtgaagatgctgccagagaatacgcaaaccagacagcagagccgtacagatatgttttacagccgctgccggatgtgtggataccctttaatgattcgctggatatgattacgggctattctccgggttataaaaaagtgaagattggtgataatgtggttcaggttgccagtgataaacaggttaatttcagtcgcgcatcaacggcaacatatatcaacaaatctggcgaactgaaaacggcggaaattaatgagccacgatttgaaaaagaaggtttattgattgaaggtcagcgaaccaactacatgttgaattcaacaactccagcttcttggggtaaatctgcaaatatgaatgtcgctgaggttggaactgatagttttggttttacttatggaaagtttgtttgtaatgaatcattaattgggcaaagtacaacccttaatatggcagtagtttcaacctcgggggctgtcgatgtatcaggcgataataagtgtgtgacgacatcgtgcagatttaaaacggatttggaactcctgttaaggatcaggtttgaagccttcgatggcagcgcttcatctaatcttggatatgccattgttaatacgcggtctttattggttgaaatcaccggtgtagctgccgacaggctcaccgcacgagttaacaaagatgaagctacgggctggatttttgtagaggcaacgattcaagcaagtaaagaaacttacataacctctgcaatacaatacgcaccaaaaaaaggtggtgtcgttgaatctggtgactatatttatctggccacccctcaggttgaggatggttcgtgtgtatcatcttttattatatcaggaacgacggcggcgacgcgcgcaagcgatatggttacagttccgattaagaataatctttataatcttccttttacggttctttgtgaggtacataagaactggtataaaacgccaaatgcagcgccacgtgtttttgataccggcggtcatcaaaccggagcggctattattcttggcttcggatcttcggcagatgggccagacggatttccttattgcgatattggtggatcaaataggcgtgttaacgaaaacgcatcgttgaaaaaaatggttatggggatgcgtgtaaagtcagatcagtctacatgtgcagtaagtaacgggcgtatatccagcgaaacaaaaaccacatgggaatatatccggagtacagcaaccattcgcattggtggacaaactacagcaggattacgccatttatttgggcatgtgaggaattttcgtctctggcataaagagctaacagatgcgcagcttggggaggttgtggcgtgagagatttcacgttgcgtttcagtgataaagcagatttcagggcatttctcaggaaacttaactgggaagaggacgaagagctgcagaatgccgttctggttgatgagattggttttacgttcagggagacagatgtttctgatgacggagaaccagaatacacgcgaaacgaagggtactttgttaatatccgtcttcttgacgatggatttgatgattccgtgttccgtgagtgggtggttacaccagagcgcccgctcagggagtggttttaaggatagcagatggatatcacgtcgatacttcatgcgctttgtgccgtggcggtgcaggtactggctggtctttttaccggaaactgggcttacggggcgatagccggttgtacgttcttcattgcgcgtgaacacacccaggcagaatatcgctggattgaaatgttcgggcatggcaagcggattaacatgccgtggtggggcggttttgatccacgtgcatgggatgtggcaagcctgatggattttgctgtgccggtggtggcgtgtctgctggtctggctgttggttaatcgtgggtgaaaaaggtgagcagtatatgcaacgaaggaggaaacatcattgctggcggcatggaaggcatgcagggtgttgctgaaccgtgttgatacatcaactgcacctgatattgagtggcctacgaaccctgtcagggagtaatcattgggattatgccgcagcacgtcttaagcaagaacgtgctgcggttggatgctattttttccctgaagcggaaaacattactacagtaccttgaaccttggttttaacattctcgaaatgctctgagagtatatgtgttaagccttcttcggaatcttttgtgtttgaaaagatgcctttctgattgtaaatgcgcatcagtttttgaccgaagctattgtgcacaacgccgtcaccaagaattgtggctccgtatagagttccatcgtcagttaaggcctgcgccgcattgcgtattacacagctttttgtagatatatttccaggcaggcagtgaagaaggtaaaacatggaaatggaatcaaattgaccatgtaacgccgcgggataaggatcaaaaacatcatggctaattttatgtttaatttttgattccccagcccttgtcgatgccgcgttcaggctagcttcgttcaaatccattaaagatatcagactactctcaggtacgtgagtaaggtaaaacccagttccaacgccaatatccagatggttgttacctaaatgttccagaaagtgtggaagaaggtgttcctttgtaggacatccccatgcaagccgatttgatactcccaaaacccaccagtcataaagctttagggtaagtggtgtgtaaattttagccccatcatctgtgttttttttcattagtttcaccgtattatagttttatttgtgaattaaatcaattatggcgatgaattacaaggggttaaatgctgccgcagcatagcgatattgaaatagcctggtatgcttcgatacagcaggagccgaatggctggaagaccgtcactacacagttctacatccaggaattcagtgagtatattgcgccactgcaggatgctgtagatctggaaatcgcaacggaggaagaaagatcgttgctggaggcatggaataaatatcgggtattgttgaatcgtgttgatacatcagtagctctgggtatgaagctgtttgtaactcatgttacagtaacagccattactatctcgaaggtgcaaaatgtatattgatttgatattttataaatttacttcgaatctggcacgtcaacttttgattaaagtaatatcagttttcggcgaaaaaaggaccgtgtacatgagacgatttcatacaagaataacaaaaatatgaatatgctcccaatgcaatatatgttttgcattgggagcaaatagcggaatattttgaaattattgtatttctgcttcagaatttcctgggcagtatatattttctggtttttgtggagtgatcaggtgatgtacaactgctttatctacacataaattaactccggtgagagctaatgtatgcccatcaccatttattgttagtaacgggctggaaaatttctctgccatcttacgggcattaatccagggcgttgttgggtcgtatttgtgtgctacaaacagtaaaccagagggcagaacagtatttttcaggcgagttttgttcaggtcgctatgtattggccataattcacaaaaatcaggtgaatcggaacgtccattgtcaaagttaatagccgggaaggcattcgcaagagcgtcttttcgggattttcgctcttctggtgttaattgctcatccccctgatctacacagaggattacccccgaagcattgcttgactcttctgaggctatcggagcactgagcgcagtttcaatttcattactgacaatcccctgagagaactggcgtatggcagttgcaagggttggccatgatgaacgccatagcagaaggtctgttgttaatgatatgagttcatctgaagatatattttctcccttactgtctaataaaggtttgtgatgtaattttgataatagctcatggaactgagttattgccttatctctgtctgaagaaagcgggcaactttttgtacgcgcacaccaggatgcaaagcgatcaaacgtttcctgataactctgtgcctgtttgagttgccatgtgaagttgtcctccaggtcatcgatatcgacgactccatcaagaacgatagatcttacgttgtagggaaaacgttctgcatataaggctgcaatttgagttccatacgaatacgccacggctgtcagttgtttatcccccaaggcttgcctaatacgatcaatatcgtatacagcctcgttagagccgatatggcgaatgacttcggctccggtattatggatacaggcattaattttatttaatacttgttgcttttcggttatgttttcctgagtctctgtatctgattgccggcagtttattgtcggagtggactgtccgacgcctcgaggatcaaatccaataatatcccatgactcacgaagatttgtgactggccagtcaaagttaatataaggatttatgcctggtaacccgggaccaccacttattatcaggatacttcctttatgcttgctttttgccggcaattttgtcaacgctagtttgacttgtgattttttttcataagaagcatctccgcctgtgtctgtatattttaatggaacagacaaataaccacatagtaagtcaggagacggtttttcctcaccaaaccagtggttgaattgactggccatacaggattgccactgtatctgctgggcagatacggttactggtagaagtaacgttaaaacaactttgaaatgagtaattatttttcgcattgtgtctctgaatatcggaataaagataagatttgaatatattgaggtcttgtgttgcggtaagagattacacgttatgacataggttaaatgcttacaaaattagtggatattgcctacttgtaactgtaaacaaattccccggggttatacaataccaccggggagaaaatctggttaacttcgttaaaaggtgtacttaagaccagcagtagtgatgaagttatagttttctatgcctgcaccatttttgctgtagtctgaagtgttatcattgtgatcataaagtgaagtattaccttttttattcgtaacccgattccatgcgccttcaacataaacctttgcgttaggtgttacgtaataacctgcattgactgcaacagaatagtaattttggtctttgactttactgcgataagtgattctttttcctgggtcatagtgctcatcgttatcagatgcttccacccagccgctgtatttaaatgtgccacctagctcaaaatcttcataacgataacttccagtcaagccaatgtagggcattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgcctactttcatctgtccaggttccggggttactggaatccatccagtcctgatcgaccatattgccacctcggctgtcgagagtagtccagcccgcagccccaatagatatctggggcatcaaatcccaattaattgcacctttaataattgcagcgttattgaatttccagtcgagttgactgacttttcggcctccttcttcagctagataaacgcgctcttttgtttttccgctcagagttccaagactaatgtccgcatttatgttgtcaggagtaaacgatatagtctcggtagaagcaaaagagctgatcgcaataggggttgtcagaactattcccagaagttttgcccgcataaaagttctccattcaatcgttttaatgattgaatatgtattttttatatctaacttaatgagtcaatcacatattgctccactgtttatattttgtttagtattgaatgattatcacaatgcgctatctgtttttggtttaattatctgttattgttttatgttgcggttttactgtgtggttttttatgcttttgtggtgtttttatctatttaagcgccatgcctttaaaggcatataagcgaaaatagcatgaggtttatcctcaattgctatgttttttagtacaaaaaagagggacaaaactgagacacataaggcctcacaatggcttgcaaggctttacatgttttgaggtagtgggacgtgtgagcgcagagatggcgcggtaatttgttgacttaaaatgtcgttctaggaacttctaagtcgtgggccgcaggttcgaatcctgcagggcgcgccattaaaattcaatcagttacgccttctttatttcttctataattccagagtgggacattatcaccaaaaatgtcgtctattttcctcgcgtgctcagtcaaatgattaggcgcaaggtgagcatatctacgaaccatttctctggactcccatccgcccatttcctgaagcactgataatgggacgcctgacggaatcaacctgcttgcccgggtatgccagaggtcatggaaacggaaattttcaactcctgcacgacgacaagctgatagccatgctgtcttgctgtcaatgcgcatcttcctgagcgcaggcattgatgttccatctgctcgcttagccgccctggtatgtacacccacatttgtgatgcttgcctgtttgatcatgcagcactttagaggcggtatcgttcagcgccacaccaatggcgcgatttgatttgctatcttctggattcaccctggcaacttgtcgctgcatgtcaatctgttgccactccagatttatgatgttcgactttctcagaacagttaccagcgcaaacttgacgacagatttcagtggcttggggctctcatcaatcaggcgtttttcctgattcttttgtaagtctcttgtgccattccacctcatacaggtttgcctgcaaacagtactgatattgcaccgccagatattccggctggcttcgtggttgttttcaacagtgatgaggcatcgtggcatctcgttgaagaccatcggggtaaaacggtttatgacgtggcatcaggggacgcgttatttatttctgagctcggtccgttaccggaaaatgttacctggttatccccggcaggggagtttcagaagtggaacggcacatcatggataaaggatacggaggaagaaacctcgttgctggaagcctgtaagatgtatcgggtgttgctgaaccgagttgatacatcaactgcccctgatattgagtggcctgtgaaccctgtcagagagtaatcattgggattatgccgcagcacgtcgtgcgcaagaacgtgctgcggctggatgctattttttccctgaagcggaaaacattactacagtacctttaaccttggttttaacattctcgaaatgctctgagagtatatgtgttaagccttcttcggaatcttttgtgtttgaaaagatgcctttttgattgtaaatgcgcatcagtttttgaccgaagctattgtgcacaacgccgtcaccaagaattgtggctccgtatagagttccatcgtcagttaaggcctgcgccgcattgcgtattacacagctttttgtagatatatttccaggcaggcagtgaagaaggtaaaacatggaaatggaatcaaattgaccatgtaacgccgcgggataaggatcaaaaacatcatggctaattttatgtttaatttttgattccccagcccttgtcgatgccgcgttcaggctagcttcgttcaaatccattaaagatatcagactactctcaggtacgtgagtaaggtaaaacccagttccaacaccaatatccagatggttgttacctaaatgttccagaaagtgtggaagaaggtgttcctttgtaggacatccccatgcaagccgatttgatacacccaaaacccaccagtcataaagctttagggtaagtggtgtgtaaattttagccccatcatctgtgttttttttcattagtttcactatgttatagttttatttgtgaattaaatcaattatagcgatgaattacaaggggttaaatgatgccacggcataacgaatttgaatatattgagtcttgtgttgcggtaagaggttacacgccaggacgcaggttaaatgcttacaagattaggggatattgtttgcttttaacggtaaacaaattccccggggctatacaataccaccggggagaaaatctatttaacgttgttaaaaggtgtacttaagaccagcagtagtgatgaagttatagttttctatgcctgcaccatttttgctgtagtcagaagtgttatcattgtgatcataaagtgaagtattaccttttttattcgtaacccgattccatgcgccttcaacataaacttttgcgttaggtgttacgtaataacctgcattgactgcaacagaatagtaattttggtctttgactttactgcgataagtgattctttttcctgggtcatagtgctcatcgttatcagatgcttccacccagccgctgtatttaaatgtgccacctagctcaaaatcttcataacgataacttccagtcaagccaatgtagggaattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgtctactttcatccgtccaggttccggggttactggaatccatccagtcctgatcgaccatattgccacctcggctgccgagtgttgtccagccagcagccccgatagatatctggggcatcaaatcccaattaattgcacctttaataattgcagcgttattgaatttccagtcaagttgactgacttttcggcctccttcttcggctagataaacacgctcttttgtttttccgctcagagttccaagactaatgtccgcatttatgttgtcaggagtaaacgataaagtctcggtagaagcaaaagagctgatcgcaatagggggtgtcaggactattcccagaagtttcgcccgcataaaaggtctccattcaatcgttttaatgattgagtatgtattttttatatctaacttaatgagtcaattgtatattgccccactgtttatattttgtttaacattggatttttgtcacaatgcgctgtcagttttttagtttaattgtctgtttgtgttttgtattgtggttttatgggctaattatttttttctttgtggagtttttatctattcaagtgccatgcctttagatgcatattagcgataatagcatgaggtttatcctcaattgctgtgttttttagtataaaaaagaggaacaaaactgagacacataaggcctcgcaatggcttgcaaggttttacatattttgaggtggtggaacgtgtgaacgcagagatggcgcggtaatttgttgatttaaaatgtcgttcctggagtttctaagtcgtggctacaggttcgaatcctgcagggcgagccatttcctcgccatttatttgttcccttttacaaattacaccatcactttgttgtcgcggttttgctaaataattggaacacgtcagacgaataaaatgaaaacagaaattctgctaaacaattcatcttgccaggattttgattaggaaagtgaaaaggaaaggagcaaactaagttgctccctttaatcattaatactcaaggatactctgcgcgacgggcaaatagcgcagagagaaatagagcgtgtctttaccgcaagaggaacgtttcgctaacagcgaggcgatctctgcatccggtttcggtttcgctgtaaacgttttacctttaccagcgacaaacagttcataaacaatgccgcttgctggggcggaactttggcaatcggcgctggcctgtagataacgttcacgctgttcagcggtcagtttatccacgccgctgccatcctgtacccagacattaacaccggttgctttaacttgttccagcagttggcgatagccatctggcgacatgtttccggcgaaaaaactactgatataaaccggttttgctgaaacatcgctaatcaaccgctgcgcgttgtttaaccatgttagcaaaggctgacgggcggcttcgctgcaccagttcaggtcgtcaatttccgcgctgatgtaccagccatccggcgttacgccaggcacggcgctccataatctggcttgctggagatcggcagccagcaggcgattaagatagctttccagcgctgcggacgactgtttctggtgcataaaaaattccggatcggcgttcagcccgacaatcagcttcaggccagcctgttgcgcagctgcggcacgcttaaacaataacgcgcgctgttctggctgggtgaatgcatcgccgtaacgggtccattgcaaaaccagggtatcgaagccttgcaaacgtaactgactcatcagcccctgccactgggtatcggtaacctgactatcacggttttgtggttgccagataatacctttcatcgcaaaggaaaaagggctgaccaaaagcagtgtcagcaatacgaaaatgaacttacgcatttaccagtgcactccaatggtgagaaacgcgttgttgcgctctccgttacgttgattaatcgccttaaaggtatgttgatattcgacgccgagactgactttgtgcggccaggcgtcgtagtgcgtctcgccggtccagatattccagcggaccccgacaccgccaagctgcgcgccctgagtgcctttatcacgataaccgttgtcctgaaggtgagcataaggctcaatagtctgtccgttcgccaccttctgatgccagcttacgcgataatctgccgtccacgcctgaatatcctggcggacatattgcgccgcatcgaggtacaggttttgggcaaaccagcctgaaccgttcgggtgccattcgtcgctgtatttgccgccattaaagaatgaggcgctggcgcgcagcatggtatcggatgcgccattttgcccgttcagcggcaactgctgttcgacggcgaggaaaaagatctgatcgcgcagcggcttccagcgcagaccggtgccggacatcggatttttcaccggcatcatcaccccgttttctccggtatcggcaaagacgcggctataaactgagagcaggtcgccttccagcagcatattgcgtccgaggcggtactcggcttccagttgcccgtagctacgatagcttttccctggcgctgcgccgccgacattattgttagcggtactcattgcgccggaacgcaagccgatagaagaatcgaaactgaacgtccagcggcgaccgacctcctcatgcagacggcggaaattgaagcgttgctgattttgctctggggtcagtggggttatcagcgcctgattatcaatgtcatcaatcaccagccgggcgtagtgctgcgtcgcaggcatgtcatccagacgctggttcacgtaggccagttgtcggataagtgccggatcgtccggtagccctttatgcgcctgttcgagcatttcccgcgactgtgcgatatcaccgctatcccacaaggcgtaaccgagcgctgcctgggtgttgctattattcggttccagttccagcgcggcgcgcaaatcactcaccgccgccgggacattatgacgttggcgataaattgtcgcccgcgcaacgtaagcgttggcagaaggcgcaatattgattgagcgcgtgagatcgttcagtgcgagttccggctgaccaggaatgtaacgttgcgcatgcagccaccagtagagggcattgtttcccagcccacgttgttctgcctgctgaagccagcgatcgcgagccgcaccatttcctgccgcctgggcggtattggcagcagcaagcagatcctcattgctcatgtcgtgaagactgattttctgccaggccgccagtgcggtggcgtagtcctcaacctgatacgcctgataggctaccgcacgatgttgccaggcgtccggttgtcgttgttcggcctgaagccatgcatacaacgccacaccgggtagcgtgtcccgataacactttgccagacggttccaggcggcggcatcgtaggaaggcgacatatcgcccagcaagcgaactattgccgggcaattatctgcaatacccggcaactgactttgccactgacgttgctccgccagcggtaagggtttcgataaaatcgccaccttcgccggcgttgccaggtaaggatgactttccagcagagacgccagtcgcgccattaacgtctggctgacacgcgcatcgccctggaaaggatagcgttgcagcaataaatcggcagcttcgcgtgactgttcgttctgcatcagttgccaggtcagttgatccaggcgggtaagatttgccggttcttgctgatacagcaatcgtgccagacgcagagcttcagccttgttacgggtcgctacgctaacggcataacgctcctcaagcatttcattggcggggagggtggcgagcagtttttgcgctgcgccgtactgaccttcttttaacagcaccggtagcgtcgcgccaacaacatactggcggttgtcggcaaactgtaccgtataattcgccaacgcctgaacggggttgccgctgtatttagataacagatagagccaacttttctcttgtgcgtccgtggtaaatagcggcgtattttcaatgagataatgctggaggcgtgctttttcgccacgataagccagcgcggtcgcgtaagtaatatatgactgaggatcggtgaagatcccctgtgattgcagcgccaggatccgatcatccagctgcgcggcaagaagcacgtcaaaccactgacggcgttctgccgcacttaatgtgttctgctggcgtgcttcattatatagcgtatctgcctgggaccattgtttcaggtagattgcccgttgcagcagatcggttcgcaacgtttttccttccggcgatgcagcaaacgtcgcatcgtttagttgcgctctggcgacaggtaattgtgccagccgcagggcattctgcccgacttcactgcgacaacgcagggtcggcgcagcatcgcacgctttttgctgggcaagcagttcttcaacagtcgtaacgcttttcacttcaactggaatagccaccagactgcgctcaagccggtcatctccagggtgacgtttcagttgatcctcaagcaacagccgcgcccggtcatcatgaccaaaatggcgataggcttccgcaaggtataaagtcagcggaatattatccggcacctgctggtgtatatattcaaattcgcggatggcggttgcttcgtcgttatttttctgtgccttcagcgccttatcgagacggggataaataacaaaatggcgataatcgctcagccccagctcttctgcgctggtgccgatattgtctgcgagtgcgctggtactcaataaagatgtcagcagtaaaccagaccatccgatgacgcgattaaggttattctccttcattttcggactccagttgtgcaacctgttcagtgtttaaacctgctttgagtaatagtgattgcatcgaaacttgtaattcgcgttgaattgtcaggacgcgatccaacgtttcctggctgataacgccttcggtgaccaaaaacttgccgagcggcagagaactgcgttcatggcgcaataacaacacgttaattgctgaacgattaatatgaccgagcgtggtcagtatttctgcgaacaggaactgatgcggcacatattgccgccagatttcaccggcctgctgttccgtgagccactgatgctgaactgcattgtacaacattgcccgcggatcgtgaccgcgtcggcgtgcataccagtggcgtaatccggtgacaatttgtccccgcagaacaatgacgtaacgcactttgcgtccgactttacgcgtcagggccgccagcgaaaccgggtcaataccatcttcactgccgacaattaactcatcattgtccagacgcagcggcagtaccgcataatgcaacgccacggaggccggcatttcggcaatcagcgaggaagggatctgccaggcatcgatggattcccacgccacgccgttttgctctgccagcgcctgtgccagttgctcggcgctaatcagcccctgcatcagcattgaaccgcccaggcgtagaccttcgacgcgattacgcagtgctgcatcgagttgttcttcagtgatgacctgattttccagcaggatttgacctaacggacgcaacgagcgggtatcgccagtcacgctggggaagtcatgcgttgttttatcccacgcgacgcgacgtggatcgccgtgttgaagtacctgttttaacgcgcgccagttggccatgaagttaatcaggttgccccagaaaagacgcaggacagatagcagcccctgcgtcaggccgtagtagccagtaacgaaaatcacccgctgcacgatgcggttaatcatcaagccaaagtttagccacagcagagtcattaaccatgcgctgccgctgaaaatagaaaggaaatgccaggcatcgggccacaaactttcatacgccagcaacagcaaaagctggatcatcaccagcatcgcgaggaagctgacaaagttactgattgcccctttgcggtcgcgccagagaaagtagttcagcgtcaggctggaggtccatttgtgggttttaaagccctggaaaacaatgccgatgatccagcgagatttttgccgaaccgcagtcgaaaaggtatcggggaaatattcgcgcacgcagatcatgtttgacgtccgtgcatgctgtaaaaatttacgctgctcgcgttctttggcttcgtccaccaccggaaaacggacaaaaatttccgtcatacctttctctttcaggcggaagccaatgtcgtaatcttcagtcagactctgcacgtcgaaagcaataccgtcaccgtcagctaacagtgcggtcacggcgcggcggctgaaacaggtgccgacgcctgcgctgggcacctgtccggcgagggcttcacgcaccggaacatctttgccatgcagttctgaaaactcatcaatgtaggtcatgctggtgaagtgcgtccattcgcgttcgaacggatacactgggatctgaatcagatctttacgctcgaccagatagttgaacagacgcaattccatcggtgaaatcacatcttcggcgtcatgcagaataaaaccagcaaaagcgaaattggcgctacgttcaaactgggtgatggcgtccagcacgttgttcagacagtcggctttgctggtggggccaggacgcgcgcagactaccttatgcacgttcgggaagcgagcgcacacttcgtcaacatcacgctgagtatcggggtcgttggggtaggtgccaacaaagatatgatagttttcgtagtcgagcgtggtcgccgccagctcggccatattgccgatgacgcccgtttcattccacgccggaaccataatcgctaacggtttttcatctggtttatacagttcgcggtaactcattcgcgggtagcggcgataaacactcaacttgcgtttaatgcggcgtacccagtagacgacatcaataaaaaaatcgtccagcccgctgatgaacataatgaccgctaacgttatcgcgattacttttaagccgtagagccaggtagcaaaaacatcaagaagccagtccacacaaaaaccttacattaacgctggttatgtttagggtggcgtatattaaggttttttatgaattgtgacagctttttatcattaataggtattactattgcggcatgttatttttacactggttataaaagttgccgtttgctgaaggattaagcgggtaatatgataacaaaccttgtcccccgcacatctgacgttactgcaactgtgcctttatgcgcgacaacaatcgatttcactatcgccaggccaatgccgctaccttcgccttttcgctggcgggaaggatcaacgcggtagaaacggtcaaacaatcgcggtaagtgttcgggcgcaatgggcgtaccggggttttcgacggtaacttgcaccaggtgatcgaccgtctggcagcgcacgacaattgtctctccggttggcgtataacgaagggcattagaaagcagattgcttaacgcccgacgcagcatcagcggatcgcccgcaacctgacactcgtcgccaacaaaccgcagctccacgccgcgatcttctgctaacgcctcgaaaaaatcgaacactttgccgacttcatccgccaggttgagcattttcttttcggggattagctggttgttatcggcctgagcgagaaacagcatatcgctgaccattttcgccattcgcgtcagctcttcgagattagagtagagcacatcttccagctccttctggctgcgcgactggctgagggcgatttccgtttgcgtaatgagattagtaataggtgtgcgaatttcgtgggcgatatccgctgagaaattggactggcgggtaaagacatcctcaatacgctcgatcatatggttgaacgacagtaccagctgttccagctcaatgggcacggtctgcgggtcaaggcgaacgtcgagatctttcgaggtgatattctggatttgacggctgacgctgcggatcggcgcgtgacctttatgtaccgccaacagcacgataaagacgatcaggatgctgattaccgatgcggtcataataagtttattcatcaaatcattgatgtaatgaagatgaaaatcgatcgaaagcgcgatgtagagcgtataaatcggtttgccgtcaaccagcgggccaaccggcaagttaatcatccgccagttgctgtgttccatatgcccgtgaccgtgccctggcatcatcatcgttgggccggaaaggagatacacctcgccgccctgcgcgtctttatcgggtatggcgtcacgcgtaaactcgcggatatccggcgcaccgggggagtgatacaccgttttaccgtggctatctgccagagagatcaacacattggaataaccactgacgatatcttccagcgtcattaagcgtcgggcttgcgtttcgtcagggtgattaagtacccgttcaagggtggcgctaatctcttttaaatcattaatatcctgctcggcaaaatgcacttttaccgagtggatcatgatccatgcaaaggcgaaaaacgccgcgatggtggcgaggctgataaaaaaggtcaggcgagttgccagcgaaaacgggcgctgaaatggtttactgaccatccggcacctctagcatgtaacccacgccgcgcacggtctgaatcaactttggctcaaagtcgttgtcgattttgccgcgcagccgcttcaccgccacatcaatggcgttggtatcgctgtcaaaattcatgtcccatacctgcgaggcgataagcgagcggggcagcacttcgccctgatggcggaggaaaaactccagcagagtaaattctttactggtcagagtgatgcgcgtgccgctgcgggtgactttgcggctgacgagatcgaccatcagatcggcaacctgaaactgactttcgataatcaccgccgccccgcgccgcagtagagtgcgcacccgcgccagcagttcagcaaaagcgaacggcttcaccagatagtcatccgcccccaactccagccccttgacgcgatgttcaatggtgccaagcgcggtaagcaacagaatcggcatccccttattggcggaacgcaacatgcgcacgatatcccagccgttcacgtccggcagcataatatcgaggattatcagatcataatcaccggtcatcgccagatggtagccattcagcccgttgtcggccaaatcgaccacaaaaccggcttcggttaaccctttggtcaagtattctccggttttcttttcatcttcgacaatcaacagtttcatatttcctccgcatgttgcccgggcaattctagagtagcgggatcagatggcaatcgcttattggcaaaatgacaattttgtcattttcctgtcaccggaaaatcagagcctggcgagtaaagttggcagcataaaatcaccagaaattatgagcctatgtctccttgtaaacttctgccattttgtgtggcccttgcgctaaccggttgttcactggcaccggattatcagcgtccggcaatgcccgtgccgcagcagttctcactcagccagaacggcctggttaacgcagcagataactatcagaacgcgggctggcgcaccttttttgttgataatcaggtgaagacgctgattagcgaggcgttggtgaataaccgggatttgcgcatggcggcgctgaaagtgcaggaagcgcgggcgcaatatcgtctgaccgatgccgaccgctacccacagctcaatggcgaggacagcggcagctggagcggcaatcttaaaggcgattcagccacgacgcgggagttctcgactggccttaacgccagctttgatctcgattttttcgggcgcttaaagaacatgagcgaagccgagcgccaaaattatttagccactgaggaagctcagcgcgcggtgcatattttgctggtttctaatgtcgcgcaaagctatttcaatcagcaactggcgtatgcgcaattgcaaatagccgaagaaacgctgcgtaattatcagcagtcatatgcgtttgtcgaaaaacaactgttgaccggtagcagcaatgttctggcgctggaacaggctcgcggggtgatagaaagtacccgcagcgacatcgctaaacgtcagggggaactggcgcaggcgaataatgcattgcaactgttattgggaagctacggcaagctgccgcaagcgcagacagtaaacagcgacagcctgcaaagcgttaaattaccggcgggcttgccgtcgcaaatcttattgcagcgccctgatattatggaagctgaacacgcgttaatggcggctaatgccaatattggtgctgcgcgtgcggcatttttcccgtctatcagcctgaccagcggaatatcaaccgccagcagcgatctgtcgtcattatttaatgccagcagcgggatgtggaattttattcctaaaattgagatccccatttttaatgctggacgcaaccaggccaatctggatatcgccgaaattcgccagcagcagtcggtggtgaattatgaacagaaaatccagaacgcctttaaagaagtggcagatgcgctggcattacgtcaaagcctgaacgatcaaatcagcgcccagcagcgttatcttgcgtcgctgcaaattactttgcaacgggcgcgggcattatatcagcacggcgcggtaagttatctggaagtgctggatgccgagcgttctttatttgcaacccgacaaactttacttgacctgaattatgcccgtcaggttaacgaaatttctttatataccgccttaggcggcggttggcagcaataatttttaactccaggagagaataaatgaaaaaagcactgcaagtcgcaatgtttagtctgtttaccgttattggctttaatgcccaggctaacgaacatcatcatgaaaccatgagcgaagcacaaccacaggttattagcgccactggtgtggtaaaaggtgttgatctggaaagcaaaaaaatcaccatccatcacgatccgattgctgccgtgaactggccggagatgaccatgcgctttaccatcaccccgcagacgaaaatgagcgaaattaaaaccggcgacaaagtggcgtttaattttgtccagcagggcagcctttctttattacaggatattaaagtcagccagtaacccaggtttaatgagatgaaaaaaatcgcgcttattatcggcagcatgatcgcgggcggtattatttctgcggcaggttttacctggtttgcaaaggctgaactgcccgcagaaaaaacgtcgaccgcagaacgtaaagtcttattctggtacgacccgatgtatcccaatacgcggttcgataaaccagggaaatcgccgtttatggatatggatctggtgccgaaatatgccgatgaagagagttctgcatctggtgtgcgcattgacccgactcagacgcagaatctgggggtgaaaacggcgaccgtcacgcgtgggccgctgacttttgcccagagtttcccggcaaatgtcagttacaacgagtatcagtatgccattgtgcaggcccgcgccgccgggtttatcgacaaggtgtatccgcttaccgtgggcgataaagtgcaaaagggcgcgccgcttctcgacctgaccattcccgactgggtggaagcgcagagtgagtatttactgctgcgcgaaaccggcggtacggcgacccagactgaaggcattcttgagcgactgcgactggcgggaatgccggaggctgatattcgccgtctgatcgccacgcaaaaaatccagactcgctttacgctcaaagcgcccattgatggcgtgatcaccgcgtttgatctgcgcgcgggaatgaatatcgccaaagataacgtggtcgcgaaaattcagggtatggacccggtgtgggtcactgctgcgatcccggagtccatcgcctggctggtgaaagatgcctcgcagtttacgctcaccgttccggcgcgacctgataaaacactcaccatccgcaaatggacgctgctacctggcgtggatgctgcgacccgcacgctgcaactgcgtctggaagtcgacaacgccgacgaggcgctaaaaccgggcatgaacgcctggttgcaactcaataccgccagcgaaccgatgctgctcattccgtcacaggcgctgattgataccggcaacgaacagcgggtgattaccgttgatgctgacgggcgctttgtaccgaaacgcgttgccgttttccaggcatcgcaaggcgtcaccgcgttacgctctggtctggcggaaggtgaaaaggtggtttccagcggcctgttcctgattgattctgaagccaatatttctggcgcactggagcggatgcgctctgaaagtgctacccatgcgcattgagggaatagccaatgattgaatggattattcgtcgctcggtggcgaaccgttttctggtgctgatgggcgcgttgtttctgagtatctggggcacctggaccatcattaacacgccagtggatgcactgccggatctttccgatgtacaggtgattattaaaaccagctatcccggtcaggcaccgcaaatcgttgaaaatcaggtgacttatccgctaaccaccaccatgttgtcggtgcctggcgcgaagactgtgcgcggtttctcgcagtttggcgactcttatgtgtatgtcattttcgaagatggcaccgatccgtactgggcgcgctcgcgggtgctggagtacctcaaccaggtacagggtaagctgcctgcgggagtcagcgccgagctggggccagatgccacgggtgttggctggatctatgaatatgcactggtggatcgcagcggtaagcacgatctggccgatttacgctcattgcaggactggtttctcaaatatgagctaaaaaccatccctgacgttgcggaagtggcgtcggtgggcggtgtggtgaaagagtatcaggtggttatcgatcctcagcgcctggcgcagtatggcatcagtctcgccgaagtaaaaagcgcgctggatgcttcaaaccaggaagcgggcggttcgtcgatcgaactggcggaagcggaatatatggtgcgcgccagcggctatctgcaaacgctcgacgactttaatcacatcgttttaaaagccagtgaaaatggcgtgcccgtttatctgcgtgatgttgcgaaggtccaggttggcccggagatgcgccggggcattgccgaactgaacggcgaaggcgaagtggcgggcggggtggtgatcctgcgttccggcaaaaacgcccgtgaagtgatcgccgccgtgaaggacaaactggaaacgctgaaaagcagtctgccggaaggcgtggagatagttacaacatacgatcgcagtcagctcattgaccgcgccattgacaacctcagcggcaagttgctggaagagtttattgtggtggcggtagtctgtgcgctgtttctctggcatgtgcgctcggcgctggtggcgattatttcgttgccgctggggttgtgtattgcttttattgtcatgcactttcagggactgaacgccaatattatgtcgttgggtggcattgcgattgccgtcggggcgatggtcgatgccgctatcgtcatgatcgagaatgcgcataaacggctggaagagtggcagcaccagcatcctgacgccacgctggataataaaacgcgctggcaggtgatcaccgatgcatctgttgaagtggggccggcgctgtttatcagtctgctgattatcacgctgtcgtttatcccgattttcaccctggaagggcaggaaggtcgtctgtttggcccgctggcgttcaccaaaacctatgcgatggcgggcgcggcgctactggcgatcgtagtgatcccgatcctgatgggctactggatccgtggcaaaattccgccagaaagcagtaacccgctcaatcgctttttgattcgtgtttatcatccgctgttgctgaaagtactgcactggccgaaaaccacgctgttggtggcagcgctttcggtgctgacggttctctggccgctcaataaagttggcggggaatttttaccgcagatcaatgaaggcgacttgttgtatatgccatcgacgctgccggggatttccgcagcggaggcggcgagcatgctgcaaaaaaccgacaagctgattatgagcgtaccggaagtggcgcgggtatttggcaaaaccgggaaagcggaaaccgccaccgattcagctccactggagatggtagaaacgactatccagcttaagccgcaggatcagtggcggcctggcatgacgatggacaaaatcattgaggaactggataacaccgtgcgtctgccggggctggcgaatctgtgggtgccgccaattcgtaaccgtatcgatatgctctcgactggcattaaaagccctattggcattaaagtttccggcactgtgctggcggatatcgacacgatggcggagcaaattgaagaagtggcgcgaacggtgccaggcgtggcttctgcgcttgctgagcgtctggaaggtgggcgttatatcaacgttgagattaaccgtgaaaaagccgcgcgttacggtatgacggtggcggatgtgcagttgtttgtgacttctgcggtgggcggggcgatggttggcgaaacggtggaagggattgctcgttatccaattaatctgcgttatccgcaaagctggcgcgatagcccgcaggcactgcgccagttgccgatcctcacgccgatgaagcagcaaatcactctggcggacgtggccgacgttaaagtctctaccggaccgtcgatgctgaaaaccgagaatgcgcgcccgacgagctggatttatatcgatgcccgcgatcgtgacatggtgtcggtggttcacgatctgcaaaaagcgatagctgaaaaagtgcagttaaaaccgggcaccagcgtggcattctccgggcagttcgagctactggagcgcgccaaccataagctgaaactgatggtgccgatgacgctgatgatcatcttcgtgctgttgtatctggcgttccgtcgggtgggcgaagcgttgctgattatcagcagcgtaccgtttgcgctggtgggcggcatctggttgctgtggtggatgggctttcatctttccgtggcgatgggcaccggttttattgcccttgccggggtcgccgccgaatttggcgtggtgatgctgatgtatttacgtcacgccatagaggccgagccgtcgttgaataatccgcaaacattcagcgagcagaagctggatgaggcgttatatcacggcgcggtactgcgcgtgcgcccaaaagcgatgacggtggcggtgattatcgctggtctgctgccgattctgtggggaacaggagcagggtcagaggtgatgagccggattgccgcgccgatgattggcggcatgatcaccgcgcctttgctgtcgctgtttattatcccggcggcgtataagctgatgtggctgcaccgacatcgggtacggaaataaaagcaggataccccgtttaaccgtgtggattgtgtcttgcgacgatgggcactaaatgttaaaaggtgcccctcaacaaaaaagacacacaggggaaaggcgtgaaaaacgcgtcaaccgtatcggaagatactgcgtcgaatcaagagccgacgcttcatcgcggattacataaccgtcatattcaactgattgcgctgggtggcgcaattggtactggtctgtttcttggcattggcccggcgattcagatggcgggtccggctgtattgctgggctacggcgtcgccgggatcatcgctttcctgattatgcgccagctcggcgagatggtggtcgaagagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgctgattaaagtgctggcgatcatcggtatgatcggctttggcctgtggctgctgttttctgggcacggcggtgagaaagccagtatcgataacctctggcgctatggcggtttctttgccaccggctggaatggactgattttgtcgctggcggtaattatgttctccttcggcggtctggagctgattgggattactgcggctgaagcgcgcgatccggaaaaaagcatccctaaagcagtgaatcaggtggtgtatcgcatcctgctgttttatatcggttcactggtggttttactggcgctctacccgtgggtggaagtgaaatccaacagtagcccgtttgtgatgattttccataatctcgacagcaacgtggtagcttctgcgctgaacttcgtcattctggtggcatcgctgtcggtgtataacagcggggtttactctaacagccgcatgctgtttggcctttctgtgcagggtaatgcgccaaagtttttgactcgcgtcagccgtcgcggcgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgcctggcgcatctgcgttttcgtgcagcgatgcgtcgtcaggggcgtgaaacacagtttaaggcgctgctctatccgttcggcaactatctttgcatcgccttcctcggcatgattttgctgctgatgtgcacgatggatgatatgcgcttgtcagcgattctgctgccggtgtggattgtattcctgtttgtagcatttaaaacgctgcgtcggaaataaggcgttcacgccgcatccgacaaaatgatgtcaacaatctgaaagccgctctcacccattcgatgagagcggtttttttaattactgcttaaatgcacccgccagagagcgaatatcattgccggttggcgactgatgaagtcgcagaccaaactcttcgacaatcgcaaatatgtgatcgaatatatcagcctgaatgctttcatattccagccacaccacggtgttggtaaacgcgtagatctcaagcggtaaaccgttgtcgcccggagctaattggcgcaccattaaggtcatatctttgcgaatccgcggatgattccgcagatattcgttcagataggcacgaaaggttccaatattggtcattcggcgcaggtttaataccgactccgtagaaccttgctggcgattccactcattaatttcctgatggcggctggttaaataaggctttaacaaatgcgctttattcagacgttgcatttcgtcttcatcaagaaaacgaatactggtgacatcaatactgatactgcgcttaatacgtcgcccgccagatgctgacatcccgctccagtttttaaaggagtcagaaaccagagaccaggtgggaatagtggtaatggtattgtcccagttacgtactttgacggtggttaacccaatatcgatcaccgcgccatccgcgccgtatttcggcatctccagccagtcgcccagtttcagcatatcgttcgcggaaagctgaatacctgccaccagaccaagaatcggatctttaaataccaacattagcacggcagccattgcaccaagaccgctgatcagaatcgctggcgactgaccaatcagcagcgagatcatcaaaatgccgaccagaatcgcgccgatcagtttaatcccctgaaaaatccctttcagcggtaactgagatgccgccgggaatttctgcgccagattcaaaatcacatccagcaacgagaagactgaaagcagcgcatacatcatgatccacaactgcgcgcaggtagtcagaatatctgccgcttcggtgcctttttgtagccagaataccgcctgaatattgacgataatcccctgcaaggtaaaagctaaacggtggaagagtttattctgggtaatgatttgcaaccaaagccgtgaactggcgatggcgcgtttttcgaaggtccgcagtaccacccagtgcaaaaaaatatgcaccacgacggcggtcagaaaaataataccgaaaatcatcaccatcgaggtggtgtgatcaatctcaatacccgctaaatcttcaacctgggatattaaatcctgcataacgtctcctttatacaacagcagcctatgatgacggctgaaacagggttatgcaaatcaggagaatctgaggggaaatagccgggcagatgcccggcaagggagaattacacttcggttaaggtaatgttctgcggcagacgagatttcggcagcgtagcgttaaaatcttcaacgctgtgatgacccaccggaacaaccaccagactggtgtagcctttctctttcagaccaaattcttcatcgaggatggcggcgtcaaaaccttcgatgggcaccgcgtccagacccagcgccgccacgcccagcaggaagttaccgacgttgagataaacctgttttgccatccactctgcatcatcatgcagatctttacggtgcatatcggcgaagaacttgcgacctttatcgttcgcggctttcgcttccggcgtggcaaagcggccatcggcatcttcctggtcaacaaccagcttcagccaggcatcgtccatcgcggtttttgcacagaacaccacgacgtgcgaggcatcaagcattttacgctcgttgaacacgtaattatcggcagcggatttggcaacacgcgctttaccttcttccgtgctggcaacaataaaatgccacggctgggagttggtgctggatgggctgtattgcagtagagttttgatctgctcggcctgttccggggtaagttttttgctggcatcaaatgccttagtggaatgacgctttaaggcgacagaaatgatatccataaagactccatgtgaaagtaattttgcgtgccagcagattacaaggatcgagatgaaatggtaagcgagaaaaatgcgctattgatttacggttgagtcaggacgcactcttttttgatcgcgtttagccagaccatcaaccaccagattccacgaatcgttgatcagatcgcgaagtaacgcttcagagatttcctcgccgggatacaccgaaatccagtgctttttattcatgtgatacccaagcttgatgcttgggtatatttgctgatttagcagggatttttgtggatcggacttcagattgataaaggggacgccgcgcagctccgacgacagcataaaaatcttgccgccaattttaaaaacatcgaactccgggccaaaaggccagcaaagctcgacaaagggtaactcaagagccaggcgtttcgccgtttcgtgcagtgattgcttatccataaatgttcctttaggcgaaggagaataagcaaagtatgccgcgaagttcggcgataatcgacgtttaatccgccagcgagaaccagcgtcgccagataaagcgtagaacaaaatactcaatagcgcccagcactaaaaaccacagacaaaacaataaagtgtaaagctggctaagatccatcagatggaacgtggtcaccagtttttgtgccaacgttagccccagtgcgggggcgggcagcagcaggcaagagaggaaagccatcagcaaaatgcctgctgcggtggtcaaggtttctaaagggtgtttcataacattgttaaatgtaagttaaaacaccattgtcagggatattcttctgtaaggcaattcccgacttattccccggcccagatctcacaatgctttttcaccagcccaattagcgagccaccatcggcgacgaaatcacgcattagctgcgcttcattcagaccactgacgacctgacggtgcagtgcttcaattgcgctcgatgcgccaattttatgtgcagaaggggcgattttttccagtaaacgcaaggtggcttccgttagtgaccgacgatcgccagtatgcggatcggtaatgacgccttccagcccatagcgacaggcctggaaacggttgaatttatacagcaggtaatctttctcctgatgtttaaacgggcgttccgtcagtaaccagtgggcggtggcctgaattaatcccgccatatttaccgcgtggctaagggttaacggggtatccatcacccgaacttccaccgtaccaaaatgggggctggggcgaatatcccagtgcagatctttaatgctgtcgatcatcgtggtgtaactcaggcagcgaaacagggcttcaaattgttgccagttactgacccacggcatcgggccattatcaggaaaggcggaaaaaatattcggtcgtgaggaggcaaaacgcgtatccgttccttgcatatatggcgacgcggcggaaagggcgataaagtgcggcacaaaccgtgacaagccgtgcagcaaataaatggcgtcatcgccactggcgcagccaacatggacatgctgaccaaaaacggtcgcctgctggatgagatagccaaagttttccagcgttcgttgatagcgttcgttatcgcatacctcctgacgctgccatttctgaaacggatgcgtgccaccgccgcaaatttccagatgatggtctgcggctgcctgcaatacgactttctgcatcgctgaaaattgcccggcagcctggttgatatcacggcaaacatccgtcgccagctccagcatactttcggtgatatcgtgctttacctctccggccgtgatctgatttttaaccgcgtcaatcagcattgatgagtcctggcttaagtcatagcccggcggattaaccacctgcatttccagttcaataccgagggtaaaaggttcagaaacatgaaaatcgggtaatggcataggtttctcttatattggcgttttctattcagtatagaagtgggagcggccgggtgagatgcggaagttctggaatgtttcttttttttggcgatggtgaactgatggtgactgaagcaatttggctacttttgcaatatgaccagttgcgttatagctggctggcggcgaagaattttgacgattgaggcatgcagaaaaaaacgggttcagcttcagttgattaaatgaggagtgagaagtccgaaacaggactcactgtataaataaacagttattttgctaaggaagggtaagataactgcgggtgcctgaagctttccggtttcaggtttactctgaggtctggaaagatgaagccccaggacgatatttctatcaaccctggggctacctacccaaacctgaacaatttggatggtagtcccttcttcgcatggaggcaatataaacatgctgacgaaatatgcccttgtggcagtcatagtgctgtgtttaacggtgctgggatttacgcttctggtcggagactcgctgtgtgagtttaccgtaaaggaacgtaatattgagtttaaggctgttctcgcttacgaaccgaagaagtagccgttgtgcggggagcaatccccgcatatccggttgtcaggtcagggtggtaaggcacctgctttacactttcgcccgcggtcagtgatggctgcgggcgaatcgtaccagatgttgtcaattaatcgtgttggcacagcgttatgactattttttcttttatctgccagtgcacagcaaactgctcatcctctagtcgaatgatgatctgctgtttattccagctaattatctgataatccagaaaaccttgagcggcctgtatctcacttgccttaaatgcgctctctttggcggaaaatgccagtgtcagcgccagaggaaaggctaaaccgcagtctgcaagtcgcttgtgttccgctggtgtaataatgttgtctgtcaattctcttgcggtttgtgcagagaaaatctcttcaatatcaatgccaattggttgacgggaaaccacggctaatgccgtagtcccacagtgactaatgctgccgtatacccccgcaggccacacaggttggcgtagctcgccgattgcaggcacacatttatagccatattcccgcagcgcataaattgcagcgatccgcccggctaaatgctctgttttacgtttacgtccagcgtgttgaagttgtgcgtagtgcggcagccagagtaaatcctgctcgcgaaaactcgccggatcaaactcaacaaaatgcagcgtatgtccggcaaaggggagggaggtatgcgtagttttcatgtcaaccatattagagaatgatgacaaacgcaaaactgcctgatgcgctacgcttatcaggcctacgtggtcctgcaatatattgaattggcaagatttttgtaggccggataaggcgttcacgccgcatccggcatgaactacgcgcactttgtcaacaatctgacgttagcttcagaagtgagtattaatgctcatataccacgtacgtcccggctcgttataggtatacgccccggcacctgcgatatagttggctcctgccagatcgcccgtggtctgggcattacccgcacgccacaaacgtttgtcgaacaggttgtccacgccgccggtcagactgacattcttggtcacatcccaggtcgcgctcaggccaacaatgctgtacggactgatttctttggtttccggtccaaccgctggctgacctttatagttgtacttcttcggctgctgtttgccgtaccaggtgaaggtcgtttgcatcgacaaatcttcccgtgcctgccagctcagcgttgagttcaacgtatactccgggatgatcgacaaacggtcgcccgtggttttgttttcactcttcagcatataagtgatgttattggtccacatcaccgtttcgctaaccggtacgtttaacgatccttccagaccttcaaccaccgctttcggtacgttatcccactgatagagatcggtgccgactgcgttttgccctacagccacatagcccgcttcaatcttattgcgataatcgttacggaaccaggtcacgcccgccagccagccgtcgcgtttgaactccagaccaatctccttgttgatgctggtttctgctttcaggtcatcgttaccttgcagatagcagccgcccgcgctggcatagcagccctgacctttactgtagagaatgtagtttgggttagtctggtacaggctcggcgctttataggcgcgggcgatgcccattttgagcgtgaagtcatcgcctaaaccttgcgatatgttcagcgccgggctccagttattgccgacaatactgtgatgatcgaaacgcagccccggcgttacgatggtgctgtcagtcagctccatattgttttcggcaaacagcgagaaaatttctgcttttgaatatgggctacggtcggtggcactcacgccatcaatagcaccgccggtattcgttccggtcagtgcctgggtgttggaactcaagtccttcatccgttgctgattccactctgtacccagcgtcagcgtttggttaacgaggaaatcaatcggcaggttaacttcgctgtgcagcatcacgtcatcaagatcgatatctacaaaatcctgtgccgctttttcgttaaatttcccttcggtaccgcccgccagaccttccggaatacgcgagttacgggtgtgttcgtactgcacccagttgctggtggtcacgccgttatcccagccaccgttccaggtcagcgagtagttctggcgatacaggcggttggtttcatcgccatatttcgagcgagtgtaagcgtcagagttggtgttctgcgtatcacccgcatacaggttaccctggcggctgtagcccgcttccagttcgagtgactgcagaggcgcgaagtcccagcgcaccacgccattaatatctttgttgatcaccccttcgcgcccggctggtaacgtcgtggcatacgttccggcacgcgcggactgatggccctggttgatatcccacgcgtcagcctgggttttgtcgaggttgccatacaagcggaagctgaattcgtcgcccagcggaccggtcaggctgaagttggtgcgtttggtggcaccttcctctttatgttctggcgcattgaaataagcatcccaggagccgtgccactcaccactgccttttttggtaatgatgttaaccacgccgcccgccgcgccgttgccataacgcgcagctgccggaccacgtagaacttcaatacgttcaatcatttcaggcggcacccaggaggtatcaccacgggtatcgcgctcgccacgccagccctgacgcacagagttacggctgcttaccggcttgccgtcaatcaaaatcagcgtgttttccggacccatgccgcgaatatcaatctggcggttattaccacgctgaccactggtggagttaccggtcaggttaacgccaggcatggtacgaatgatctccgatacatcgcgggcaaccgggtttttgcggatttcatctgcggtgatggtcgaaacgccaggtgcctgcaagttctgctcggcggcggtaacaacaatagtatcgtcatgtgaaacaggagtatcggtcggctcttgtgcctgtgctaccccataaatccccagattgaccaacaaggccagggaatgaatcttcttgttcattgttttattcctgcatttttgccacgaattgcaactgtcgggcatggtcgtcatcaacacgacgcatcccgctaccgcgaaaacctttgatcctgaaagacacgcagtgcagctgattaattaatgtccgcgcttcccacggcgcgccattacgctattgcaaatgcaaatagttatcaataatattatcaatatatttctgcaatcaataaaaaattgcacagtaaacatggggttatggtgtgacggcgttaaaagtaggaagtgagagctggtggcagtcgaaacatggcccggaatggcaacgtctgaatgacgaaatgtttgaggtcactttctggtggcgtgatccccagggttctgaagaatactcgacgataaagcgcgtatgggtctatatcactggcgtgaccgatcaccatcagaacagccagccccggtcgatgcagcgaattgcaggaaccgatgtttggcagtggacgacacaactcaatgccaactggcgtggcagctactgctttattcctactgaacgcgatgacattttttctgcaccatcccccgatcgcctcgaattacgcgaaggctggcgaaaactattaccccaggcgatagccgatccgctgaatccacaaagctggaaaggcgggcgagggcacgctgtttctgcactcgaaatgccgcaagcgtctctgcaaccgggatgggattgtccgcaagcgccagaaacgcctgccaaagaaattatctggaaaagtgaacggttgaaaaattcacgccgtgtatggatttttaccaccggcgatgcaacagcagaagaacgcccgctggcagttttgcttgatggcgaattttgggcgcagagtatgcccgtctggcctgcgctgacttcgctgacccatcgtcggcaacttccgcccgccgtgtatgtgttgatcgacgctatcgacaccacgcaccgcgcccacgaactgccgtgtaatgcggatttctggctggcagtacagcaagagttattaccccaggtgaaagctattgccccttttagcgatcgcgccgatcgcaccgtggtcgccggacagagttttggtgggctttccgcgctgtatgccggactgcactggcctgaacgctttggctgtgtattaagccagtcaggttcgtactggtggccgcatcggggcgggcaccaagagggcatgttacttgaacagctaaatactggtgaagttagcgccgaaggtctgcgcattgtgctggaagcgggtgttcgcgagccgatgatcatgcaggccaatcaggcgctgtatgcgcaattacaccccctaaaagaatccattttctggcgtcaggttgacggcggacatgatgcgctttgttggcgcggtggcttgatgcaggggctaatcgacctctggcaaccacttttccatgacaggagttgaatatggcattcagtaatcccttcgatgatccacagggagcgttttacattttgcgcaatgcgcaggggcaattcagtctgtggccgcaacaatgcgccttaccggcaggctgggacgttgtgtgtcagccgcagtcacaggcgtcctgccagcagtggctggaagcccactggcgtactctgacaccggcgaatttcacccagttgcaggaggcacaatgagccagcatttacctttggtcgccgcacagcccggcatctggatggcagaaaaactgtcggatttaccctccgcctggagcgtggcgcattacgttgagttaaccggagaggttgatgcgccactactggcccgcgcggtggttgccggactagcgcaagcagatacgttgcggatgcgttttacggaagataacggcgaagtctggcagtgggtcgatgatgcgcagacgttcgaactgccagaaattatcgacctgcgaaccaacattgatccgcacggtactgcgcgggcattaatgcaggcggatttgcaacaagatctgcgcgtcgatagtggtaaaccactggtctttcatcaactgatacaggtggcggataaccgctggtactggtatcagcgttatcaccatttgctggtcgatggcttcagtttcccggccattacacgccagatcgccaacatttactgcgcattgctgcgtggcgaaccaacgcctgcttcgccgtttacgcctttcgctgatgtagtggaagagtatcagcagtaccgcgaaagtgaagcctggcagcgtgatgcggcattctgggcggaacagcgtcgtcaactaccaccgcccgcgtcactttctccggcacctttaccggggcgcagcgcttcggcagatattttgcgcctgaaactggaatttaccaacggggaattccgccagctggctacgcaactttcaggtgtgcagcgtaccgatttagcacttgcgttggcagccttgtggctggggcgattgtgcaaccgcatggactacgctgccggatttatctttatgcgtcgactgggctcggcggcgctgacggctaccggacccgtgctcaacgttttgccattgggtattcacattgcggcgcaagaaacgctgccgcaactggcaacccgactggcggctcaactgaaaaaaatgcgtcgccatcaacgttacgatgccgaacaaattgtccgtgacagcgggcgagcggcaggagaggaaccgctgttcggtccggtactcaatatcaaggtatttgattaccaactggatattcctggtgttcaggcgcaaacccataccctggcaaccggtccggttaatgaccttgaactggccctgttcccggatgaacacggtgatttgagtattgagatcctcgccaataaacagcgttacgatgagccaacgttaattcaacacgctgaacgcctgaaaatgctgattgcgcagttcgccgcggatccgtcgctgttgtgcggcgatgtcgatattatgttgccaggcgagtatgcgcagctggcgcagatcaacgccactcaggttgagattccagaaaccacgctgagcgcgctggtggcagaacaagcggcaaaaacaccggatgctccggcgctggcagatgcgcgttaccagttcagctatcgggaaatgcgcgagcaggtggtggcgctggcgaatctgctgcgtgagcgcggcgttaaaccgggcgacagcgtggcggtggcgctaccgcgctcggtctttttgaccctggcgctacatgcgatagttgaagctggtgcggcctggctaccgttggataccggctatccggacgatcgcctgaaaatgatgctggaagatgcgcgtccgtcgctgttaatcaccactgacgatcaactgccgcgctttagcgatatccctaatttaaccagcctttgctataacgccccgcttaccccacagggcagtgcgccgctgcagctttcacaaccgcaccacacggcttatatcatcttcacctccggttccaccggcagaccaaaaggggtaatggtcgggcagacggctatcgttaatcgcctgctttggatgcaaaaccattacccgcttacaggcgaagatgtcgttgcccaaaaaacgccgtgcagttttgatgtctcggtgtgggagtttttctggccgtttattgccggggcgaaacttgtgatggctgaaccggaagcgcaccgcgacccgctcgctatgcagcaattctttgccgaatatggcgtaacgaccacgcactttgtgccgtcgatgctggcggcatttgttgcatcgctgacgccgcaaaccgctcgccagagttgcgcgacgttgaaacaggttttctgtagtggtgaagccttaccggctgatttatgccgcgaatggcaacagttaaccggcgcgccgttgcataatctatatggcccgacggaagcggcggtagatgtcagttggtatccggcttttggcgaggaactggcagaggtgcgcggcagcagtgtgccgattggttatccggtgtggaatacgggcctgcgcattctcgatgcgatgatgcatccggtgccgccgggtgtggtgggagatctctatctcaccggtattcaactggcgcaggggtatcttggacgacccgatctgaccgccagccgctttattgccgatccttttgccccaggtgaacggatgtaccgtaccggcgatgtggctcgctggctggataacggcgcagtggagtacctcgggcgcagtgacgatcagctaaaaattcgcgggcagcgtatcgaactgggcgaaattgatcgcgtgatgcaggcgctgccggatgtcgaacaagccgttacccacgcctgtgtgattaaccaggcggcagccactggtggtgatgcgcgtcagttggtgggctatctggtgtcgcaatcaggtctgccgttggataccagcgcattacaggcgcagcttcgtgaaacattgccaccacatatggtaccggtggttctgctgcaacttccacagttaccacttagcgccaacggcaagctggatcgcaaagccttaccgttgcctgaactgaaggcacaagcgcctgggcgtgcgccgaaagcgggcagtgaaacgattatcgccgcggcattctcgtcgttgctgggttgtgacgtgcaggatgccgatgctgatttctttgcgcttggcggtcattcgctactggcaatgaaactggcagcgcagttaagtcgacagtttgctcgtcaggtgacgccggggcaggtgatggtcgcgtcaactgtcgccaaactggcaacgattattgatggtgaagaagacagcacccagcgcatgggattcgaaaccattctgccgttgcgtgaaggtaatggtccgacgctgttttgtttccatccggcatccggttttgcctggcagttcagcgtgctctcgcgttatctcgatccacaatggtcgattatcggcattcagtcgccgcgccctcatggccccatgcagacgtcagcgaatctggatgaagtctgcgaagcgcatctggcaacgttacttgaacaacaaccgcacggcccatattacctgctgggttattcgctgggcggtacgctggcgcagggcattgcggcgcgactgcgtgcccgtggcgaacaggtggcatttcttggcttgctggatacctggccgccagaaacgcaaaactggcaggaaaaagaagccaatggtctggacccggaagtgctggcggagattaaccgcgagcgcgaagccttcctggcggcacagcagggaagtacttcaacggagttgtttaccaccattgaaggcaactacgctgatgctgtgcgcctgctgacgacagctcatagcgtaccgtttgatggtaaagcgacgctatttgttgccgaacgcacgcttcaggaaggtatgactcctgaacaggcctgggcaccgtggattgctgggctggatatctatcgtcaggattgtgcgcatgtggatattatctctccggtggcgtttgaaaaaattgggccgattattcgtgcgacgctaaataagtaaatttatattatctataaacccataattacagaaaataattatgggtttatcatttgtttaatttataagtttggtgggtatttctctgaaatagagtgaatgttgcattcagtgggagtaatttacaaacttcagcttcggataaatctcaccaactggtagagtgggggccgtggagatttactcttattggactcattttcaggttataccccatgtcatcactgaatattaaacagggaagtgaagctcattttcccgagtatcctctggcgtcgcccagtaataatgaaattgatttacttagtctaattgaagttttatggcgggccaaaaaaacggtcatggcggtcgtttttgcgtttgcctgcgcagggttactgatctctttcatcctgccgcaaaaatggaccagctcagccgtcattactcccgccgaagccattcagtggcaggacctggagaaaacctttaccaaactccgcgttcttgatctcgatattaatatcgaccgtggcggtgcatttaacctgtttatcaagaggtttcagtctgttagcttactagaagagtacctgcgctcatcaccttatgtgatggaccaattaaaagaggcgaaaatcgacgaactggatttgcatcgagctatcgtcgcattgagcgaaaaaatgaaagcggttgatgacaatgccagtaagaaaaaagatgaaccgtcactgtatacctcctggacgctaagttttaccgcgcccaccagtgaagaggcacagaaagtgttggccgggtatatcgattatatctctgcgttggtggtgaaagagtcgatagaaaacgtccgtaataaactggagatcaaaacccagtttgaaaaagaaaaactggctcaggatcgcattaaaacgaaaaatcaacttgatgcaaacattcagcgcctcaattattcactcgacattgccaacgcggcaggaattaaaaagcccgtatacagtaatggtcaggccgttaaagatgaccccgatttctctatttctctcggtgctgacggtattgaacgcaaactggaaattgaaaaagcggttactgacgttgcggaactgaacggcgaattacgtaatcgccagtatcttgttgagcagttaacaaaagcaaatatcaacgatgtgaattttacgccgtttaaatatcagttaagaccgtcattgccagtaaaaaaagacggtccgggtaagtcgattattgtgatcctttccgcgttgatcggcgggatggtggcttgtggtggtgtgctgttgcgccatgcgatggcatccagaaaacaggatgccatgatggcagaccacttagtttaaatctttgcggttgaaggtgccgttcgtccgagcggcaccacgagcggcgttccggcaaccggatcgtcaataatcatgcagcgcagaccataaatgcgctcgatcagttcagcagtgacaatctccttcggtgctccctgagcaacaattttcccttcccgcaatgcaatcaaatggctggcgtaacgacaggcctgattaagatcgtgcagcaccgccgccagggtatagcctttctcgcggttcagttcgcttaacagttccagcaaatcaatctgatgactgatatccagccaggtcgtgggttcatcgagcagcataattgccgtttcctgggccagcaccatcgcgatccacgctcgctggcgttgtccgccagaaagggtgtccacgctttgatccgccagatgagttattcccgtggcctgcatcgcttttgttaccgcgtcttcatcttctttgcgccagcgggtaaacagcggttgatgcgggtaacgcccacgcgccaccagctcctgcacggtgatatcgcccggtgtggtggcgttttgcgccaacagaccaatccggcgtgcaacctctttactggcgtaatgttgaatgtgctcgccatccagccagacatgcccgtgagcaggcgtcatcaggcggcttaaggtacgcagtaacgtggatttaccgcagccatttggcccgataattgccgtgaagtgaccatcaggtatttctacagtcagattttccgcaacggtatatttgccatatccgagggttaactgttcgccgcgcaaacgggctactgattcggtcattttttgcgagactcctgaattaacaagacgataaggtaaataccgccgaggctgacggtaacgacgccaaccggaagttgatacggcataaacagttgttgggcgcagagatcggccaccagcagtaacagcgccccgcacagcgccgcctgggttagcccccagcgagcggtgccactgatgcggcgggcaatgtgcggcgcgactaaagcaataaaggaaattggccccgccagggcagtggcagctgcggtaagcactacggcgaccagcatcattaacagccgcgaacgttcgacgctgacgcccagcgcacatgcggtatcatcgcccatttccagcaagcgcattcgccgcaccagcaaggcggcggcaattaacattaatataatgatgggtgcggaaggcgaggtttttgcccacgtcaggccattgagcgatccggcattccacaaacccgctgttagcgccgtttctaaagacgctttcagcaacagccaggtattaaaggccaccagcatggcgcgaacaccaataccgataataatcaaccgaaaggtgtcgataccgttacgccaggcgagcagccagaccagcagcgaagtgacaatgccgcccaccattgctgccagcgcgatagccgtcaggtcctgaccaaacagcaccatcgccaccagcacgccgctccacgccccggtgttaaagcccattacgtcagggctgccaagcgggttacgcatcagcgactgaaaaatcgcgccgctgacgcccagcgccgcgccaatcaacagcgccatcagcacgcgtggtaaacgccattcggtgaccaccatcgtcatactgcgcggcgtgtcgcccatcaacgcggcgaatacctgcgaagtttccagcgtgacggcaccgctacgtaatccccacacgcctgccatcacacaagctattagcaacagcagacaggtgataattaatcggcgagagacgtaaatcatgcgccacctcgcgttttacgtcgtacgaggaagatcagcactggtgcgccaataaaggcactgactacagaaacgcgcagttcgccgggaacaatcacccgcccaatgatatcggcaaacagcagcagggcaggggtagcgagtagcgtgacgggcagcgaccagcgatgatcggcacctaccagccagcgcgccatgtgcggcatcatcaggccaataaaggcaatcgggccaactaccgccgtcgcactaccacaaagcacggtaattgccagcagaccaatcaactgtgtgcgcgctacgcgactgcccagtgccgtcgcggtgtcactgccaaggcttaaactgttcagcgcgcggctcagtaatagcgcagttgctccagcggtaagcaccgggattagcaccacttttaaggtatgtagattgcgaatatccagcgaaccggcttgccagaaacgcagttgatcgtagacgtcgggattaagcagggcgatgccgctggtcagcccttccagcaccgccgccagcgccacgcctgccagggttaaacgcaccggacttaactgcccgccgccctggctgccggtaaaggcaacaatcaacgaggccaccagcgccccggcgaaggccatcgccagttgttcctgcgcggaagagtaaccaaacagcgccgcgcccagcacaatggcaaaactggcaccggcgttcacgccaagcaaaccaggatcggcaagcgggtttcgggtgagggtttgcattaacgccccggcaaggccaagcgcaccgcctgccaataaaccggcaagggtgcgcggcagacgggcgtcgagcacaatggtgcagtcggcgctctggcaggtgccggagagcgcctccagcactacggaagcggggagtgattttgccccaatgagtaggcttaatgccgtcgcgataatcagtaataacagcaatccgggcacggcaatggcgcgtgtcacggcaacagaaccagacatacgaacttccatgataatgaaattaattatcgttatcgatcttatttggatatgttagcatgtgcagcctaagaatagatatttaaaatatttgatggcaaggcattgtaatgaataaacaatcctggctgcttaacctcagcctgttgaaaacgcacccggcgtttcgcgcagtattcctcgctcgttttatctcaattgtttctctgggtttgctcggcgtcgcggtgccggtgcagatccagatgatgacgcattccacctggcaggtggggctttcggtgacgctgaccggcggcgcgatgtttgttggcctgatggtcggcggtgtgctggcggatcgctatgagcgtaaaaaagtgattttgctggcgcgcggcacctgtggcattggcttcattggactgtgcctgaatgcgctgctgccggagccgtctttgctggcaatctatttacttggtttatgggatggttttttcgcatcacttggcgttacggcgctactggcggcgacacctgcactggtagggcgtgaaaacctaatgcaggccggggcgatcaccatgttgactgtgcgtctgggatcggtgatttcgcccatgattggcggtttactgctggcgaccggaggcgtagcctggaactacgggctggcggcggcgggcacatttattaccttgctaccgttgttaagccttccggcgttgccaccaccgccgcagccgcgtgagcatccgttgaaatcattactggcaggatttcgttttctactcgccagcccgctggtgggagggattgcgttgctggggggtttattgacgatggcgagcgcggtgcgggtactgtatccggcgctggctgacaactggcagatgtcggcggcgcaaattggctttctctatgcggcaatcccgctcggtgcggctattggcgcgttaaccagtggaaaactggcgcatagcgtacggccaggtctgttgatgttgctctccacattgggggcgttcctcgccattggtctgtttggcctgatgccgatgtggattttaggcgtggtttgtctggcgctgttcggctggctgagcgcggttagttcgttgctgcaatatacaatgctgcaaacgcaaaccccggaagcgatgttagggcggattaacggtttgtggacggcgcaaaacgtgacgggcgatgccataggcgcggcgctgctgggcggtttgggagcgatgatgacaccggttgcttccgcaagcgcgagcggttttggtttgttgattatcggcgtgttgttgctgctggtgctggtggagttgcgacgttttcgccagacgccgccgcaggtgacagcgtccgacagttaatgcttaaaacagcgccttaagtctatccagcacttgcatggcgctgtagtaatccaggcggaacgtctcggttcccagcgcataaacctgcttgttttgtactgcaggcaggtgcgcgagcagcggattagcataaatagcatcggcgtctttctgatcaccggcgaacaggaatagtgactcgccatttaaccctgcagccagattttctccaccaagctgaatgatgtcatggcgtttgccctggctttggctggcgtttaagcctgcgggcaacttcgccagcgtaaagccgagttgttccagcatctgcccttgtgctgattccggcgtccagagattggcactgtgtgcagcggcggtatagacgatggcagtgaccggctgcggcggtaatttgatttgctctttcgccgccgccagttgcttatcaaactgtgcaatccgctctgccgcttgtttctcatgcccggtaatttcgccaagctgcgttaacagcgactgccagcttttgtcgtcgtaattgatgattaatgttggggcgatggtagaaagctgatcgtacagcgccagcgccgaatcgccgccggttgcgctaattaaaatcagatccggcatttgcgcggcaacggcttctgcactcggttcgccgatatagagccgttgcagtttgcgttctttcgccaccttgctccactggcgtaaaaagccctggtcatccgcgacgcggttatttggcgtggtcgcgccgctggcgatcaccggagcatcaatcgccagcagtgagccggtcagggtgacgctggtggaaactatacgctgcggctggctttccagggtatgagtgccacggctgtcagtaatctgacgcggccagtcggcggcctgaactgcggctattcctgaaagcaaaagtcctgttaatagaagggcgttgcggtagagcggggcgagtctcacaagtcagcttcctgttattaatgaagttaatgcttctcattttcattgtaaccacaaccagatgcaaccccgagttgcagattgcgttacctcaagagttgacatagtgcgcgtttgcttttaggttagcgaccgaaaatataaatgataatcattattaaagcctttatcattttgtggaggatgatatggatacgtcactggctgaggaagtacagcagaccatggcaacacttgcgcccaatcgctttttctttatgtcgccgtaccgcagttttacgacgtcaggatgtttcgcccgcttcgatgaaccggctgtgaacggggattcgcccgacagtcccttccagcaaaaactcgccgcgttgtttgccgatgccaaagcgcagggcatcaaaaatccggtgatggtcggggcgattcccttcgatccacgtcagccttcgtcgctgtatatacctgaatcctggcagtcgttctcccgtcaggaaaaacaagcttccgcacgccgtttcacccgcagccagtcgctgaacgtggtggaacgtcaggccattccggaacaaaccacgtttgaacagatggttgcccgtgctgccgcacttaccgccacgccgcaggtcgacaaagtggtgttgtcacggttgattgatatcactactgacgccgccattgatagtggcgtattgctggaacggttgattgcgcaaaacccggttagttacaacttccatgttccgttggctgatggtggcgttctgctgggggccagcccggaactgctgctacgtaaagacggcgagcgttttagctccattccgttagccggttccgcgcgtcgtcagccggatgaagtgctcgatcgcgaagcgggtaatcgtctgctggcgtcagaaaaagatcgccatgaacatgaactggtgactcaggcgatgaaagaggtactgcgcaaacgcagtagtgagttacacgttccctcctctccacaattgattaccacgccgacgctgtggcatctcgcaactccctttgaaggtaaagcgaattcgcaagaaaacgcactgactttggcttgtctgctgcatccgacccccgcgctgagcggtttcccgcatcaggccgcgactcaggttattgctgaactggagccgttcgaccgcgaactgtttggcggcattgtgggttggtgtgacagcgaaggtaacggtgaatgggtggtgaccatccgctgcgcgaagctgcgggaaaatcaggtgcgtctgtttgccggagcggggattgtgcctgcgtcctccccgttgggtgagtggcgcgaaacgggcgtcaaactttctaccatgttgaacgtttttggattgcattaaggagcgaggatgagcattccattcacccgctggccggaagagtttgcccgtcgctatcgggaaaaaggctactggcaggatttgccactgaccgacattctgactcgccacgctgcgagtgacagcatcgcggttatcgacggcgagcggcagttgagttatcgggagctgaatcaggcggcggataacctcgcctgtagtttgcgccgtcagggcattaaacctggtgaaaccgcgctggtacaactgggtaacgtcgctgaactttacattacctttttcgcgctgctgaaactgggcgttgcgccggtgctggcgctgttcagccatcagcgtagtgaactgaacgcctatgccagccagattgaaccggcgttactgattgccgatcgccaacatgcgctatttagcggggatgatttcctcaacacatttgttgcagagcattcttccattcgcgtggtgcagctgctcaacgacagcggcgagcataacttgcaggatgcgattaaccatccggctgaggattttactgccacgccgtcacctgccgatgaagtggcctattttcagctttccggcggcaccaccggcacaccgaaactgatcccgcgcactcataacgactactactacagcgtgcgtcgtagcgtcgagatttgtcagttcacacaacagacgcgctacctgtgcgcgatcccggcggctcataactacgccatgagttcaccgggatcgttgggggtatttctcgctggcggcactgtcgttctggctgccgaccccagcgccacgctttgcttcccattgattgaaaaacatcaggtgaacgtcaccgcgctggtgccgccagcagtcagcctgtggttgcaggcactggctgaaggcgaaagccgggcgcagcttgcctcgctgaaactgttacaggtcggcggcgcccgtctttctgccacccttgcggcgcgtattcccgctgagattggctgtcagttgcagcaggtgtttggcatggcggaagggctggtgaactacacccgtcttgatgatagtgcggagaaaattatccatacccagggttacccaatgtgcccggacgatgaagtatgggttgccgatgccgaaggaaatccactgccgcaaggggaagttggacgcctgatgacgcgcgggccgtacaccttccgtggctattacaaaagcccgcagcacaatgccagcgcctttgatgccaacggtttttactgttccggcgatctgatctctattgatccagagggttacatcactgtgcaggggcgcgagaaagatcagatcaaccgtggcggcgagaagatcgctgccgaagagatcgaaaaccagctgctgcgccatccggcggtgatctacgccgcactggtgagcatggaagatgagctgatgggcgaaaaaagctgtgcttatctggtggtaaaagagccgctgcgcgcggtgcaggtgcgtcgtttcctgcgtgaacagggtattgccgaatttaaattaccggatcgcgtggagtgtgtagattcacttccgctgacggcggtcgggaaagtcgataaaaaacaattacgtcagtggctggcgtcacgcacatcagcctgaaggagagaacacgatggctattccaaaattacaggcttacgcactgccggagtctcatgatattccgcagaataaagtcgactgggcctttgaaccgcaacgtgccgcgttgttaatccatgatatgcaggactattttgtcagcttctggggtgagaactgcccgatgatggagcaggtgatcgcgaatattgcggcactacgcgactactgcaaacagcacaatatcccggtttattacaccgcccagccgaaagagcagagcgatgaagatcgggcgctgttgaatgatatgtgggggcctggcctgacccgttcgccggaacagcaaaaggtggtggatcgcctgacgccagatgccgacgacacggtgctggtgaaatggcgctacagcgcatttcatcgttctccgctggagcaaatgctcaaagagagtggacgtaaccagctgattattaccggggtatatgcccacattggctgtatgaccaccgcaacggacgcatttatgcgcgatattaaaccgtttatggtggcggatgcgctggccgatttcagccgtgacgagcatttgatgtcgctgaaatatgtggccggacgttctggtcgggtggtgatgaccgaagaattgctgccagcacctatccccgccagcaaagcggcgctgcgtgaggtgatcctgccgttgctggacgagtccgatgaacccttcgatgacgacaacctgatcgactacggtctggattcggtgcggatgatggcgctggcggcgcgctggcgcaaagtgcatggcgatatcgactttgtcatgctggcgaaaaacccgaccatcgacgcctggtggaagctactctcccgcgaggtgaaataatggatttcagcggtaaaaatgtctggataactggcgcggggaaaggtatcggctatgccacggcgctggcatttgttgaggcgggggcgaaagttacaggttttgatcaagcgtttactcaggagcaatatccttttgcgaccgaagtaatggatgttgccgatgctgcgcaggtggcgcaggtatgtcagcgactgttagctgaaacggagcgactggacgtgctggtcaatgcggcgggaattttgcgcatgggcgcgaccgatcagctcagtaaagaggactggcagcagacttttgcggtcaacgtcggcggtgcatttaacctgtttcagcagaccatgaaccagtttcgccgtcagcggggcggggcgattgttactgttgcgtccgacgccgcacacacgccgcgcattggtatgagtgcttatggcgcgtcgaaagcggcgctgaaaagcctggcgttgagcgtcgggctggaactggcgggtagcggcgtgcgctgtaatgtggtttcgccgggctccaccgacactgatatgcaacgcacgctgtgggtgagcgatgacgccgaagagcagcgtattcgcggctttggcgagcagtttaaactcggcattccgctggggaaaatcgcccgtccgcaggagattgccaatacgattttgttcctcgcctctgacctcgccagccatattaccctacaggatattgtggtcgatggcggctcaacgctgggggcataagcatgatctggaaacgccatttaacgctcgacgagctgaacgccaccagcgataacacaatggtggcgcatctgggaattgtgtatacccgtctgggcgatgatgtactcgaagccgaaatgccggttgatacccgtactcatcagccgtttggcctgctgcatggcggcgcgtcggcggcgctggcggaaacgctgggatcgatggccggatttatgatgacccgcgacggacagtgtgtggtgggcacggaacttaacgccacacatcatcgcccggtgtctgagggaaaggtgcgcggtgtctgccagccgctgcatcttggacgacaaaatcagagctgggaaatcgtcgttttcgatgaacaggggcggcgttgctgcacctgtcggctgggcacagcggttttgggatgaacccgacagaataaaatgagattgcaggaaaattcggttaacggagtgatcgagttaacattgttaagttaaatattggtttcaactccgatttacatggttgctgtgttgttaaattgtacaaagatgttatagaaacaaaatgtaacatctctatggacacgcacacggataacaactatgaacaaatcagggaaatacctcgtctggacagtgctctctgtaatgggagcatttgctctgggatacattgctttaaatcgtggggaacagatcaacgcgctgtggattgtggtggcgtcggtctgtatctatctgatcgcttaccgtttttatgggctgtatatcgccaaaaatgtgctggcggttgacccgacgcgtatgacgccagcggtgcgccataacgacgggctggactatgtgccgacggacaaaaaagtgctgttcggtcaccattttgcggccattgccggagcaggtccgttggttgggccggtactggcggcgcaaatgggttacctgccagggatgatctggctgctcgcaggggtggttctcgccggtgcggtgcaggatttcatggtgctgtttgtttccacgcgccgtgacggtcgctcgctgggtgagctggtcaaagaagagatggggccaaccgccggggtgatagcgctggtggcctgctttatgatcatggtcattatccttgccgtgctggcgatgatcgtggttaaagccctgactcatagcccgtggggaacgtataccgttgcgttcaccattccgctggcgctgtttatggggatctacttgcgttatctgcgtccggggcgtattggcgaagtgtcggtgattggtctggtgttcctgattttcgccattatctctggcggctgggtggcagaaagtccgacctgggcaccgtactttgactttaccggcgtgcagctgacctggatgctggtgggttacggttttgtggcggcggtgctgccggtgtggttgctgctggctccgcgtgactacctctcaaccttcctgaaaatcgggactatcgtcggtctggcggtgggcattttgattatgcgcccgacgctgaccatgcctgcgctaactaaatttgtcgatggcactggcccggtatggaccggtaacctgttcccgttcctgtttatcaccatcgcctgtggcgcggtgtctggcttccatgcgctgatctcttccggcactacaccgaagatgctggcgaacgaagggcaggcgtgctttatcggctacggtgggatgttgatggaatccttcgtggcgattatggcgctggtttccgcctgtatcatcgatccgggtgtgtacttcgccatgaacagcccgatggcggtgctggctccggcagggacggcggatgtggttgcttctgccgcgcaggtggtgagtagctggggctttgcgattaccccggatacgctaaaccagattgccagcgaagtgggtgaacagtcgatcatttctcgtgcgggcggtgcgccgaccctggcggtggggatggcctacattctgcacggtgcgctgggcggcatgatggatgtggcgttctggtatcacttcgccattctgtttgaagcactgtttattcttacggcggtggatgcgggtacgcgtgctgcgcgctttatgttgcaggatctgctgggcgtggtgtctccgggcctgaaacggaccgattcactgcctgctaacctgctggcaacggcgctgtgcgtgctggcgtggggctacttcctgcatcagggcgtggtcgatccgctgggcggtattaacaccttgtggccgctgtttggtattgccaaccagatgctggcagggatggcgctgatgctttgtgctgtggtgctgttcaaaatgaaacgtcaacgttacgcctgggtggcgctggtaccaacggcctggctgctgatttgtaccttgaccgcaggctggcagaaagcgtttagcccggatgcgaaagtcggcttcctggcgattgctaacaagttccaggcaatgatcgacagcggcaatattccatcgcagtatactgagtcacaactggcgcaactggtgttcaacaaccgtcttgatgccgggttaaccatcttctttatggtggtcgtggtggttctggcgctgttctcgattaagacggcactggcggcattgaaagagccgaagccaacggcgaaagaaacgccatatgagccgatgccggaaaatgtcgaggagatcgtggcgcaggcgaaaggcgcgcactaaagtcagagtgagggggaatgtgctgagcgctccccttactctcatcccgagcgtgttgatagcaattaagccctcttaattcaggagggcatttgtattaccggaggtttagatgtttgattcactggcaaaagccggaaaatatttaggtcaggcggcgaaactgatgattggtatgcctgattacgacaactatgtcgaacatatgcgggttaaccatcccgatcaaacgccgatgacctacgaggagtttttccgtgagcggcaggacgcgcgctacggtggaaaaggcggcgcgcgctgctgctaaatttgtacgtcaggctttaaacgattccactttttcgaacgctgcacgcaaggtatctggtgtcagcgtgactggcaggtaatgaatggattccaccggacgtagggtgtgggcaatcattttgtcgatctccacctgattattgatatccacttccagctccgccagcgtagtcggcagatgaaaacgctgatacgccccggttaattgcgccagcacatcatcctgacccagcaaggcgctttgcaccagaattccgtaggcgactttggtgccgtggagaaacttctcggtttgtggcaaaacggtaagaccgttatgcacggcatgggccgccgccacacgcgtaaaacgatcgcccagaccaccgaccatcccaccaccagcaataatggcatccaccacatcgcaaaatgattgcgttaattgctgattttgctgatcggcaagcgcctgttcgctactgtttaacaagacgtcgcgaatggcctgcgcattattgattcccagccgcacggttagtggcaacgtttctggttgcggagccagcaccaccgcttcataccatttcgccagcgtgtcaccgatccccgccagcagatattcttgcggcgcattgaggataatctctggctccagcagcaccataaaattggcgtcgtcgaaaatctcataatgcagcgcctgtccggcatcgttataccagacggagagcggtgtccaggcggcgcaggtggcggcgatcgtcggaacggcaacaaacggcagaccgagacggcgggcgagggcttttgcggtgtcgagcagtgcgccgccgccgacgccaatcaccacgctgcgatcgtcaccggactcagccgccagttgttgtacatcgctttcgctgcaatggccgcgaaacaaaatatgctttacccctggcagttcaaacgctggcggcagtttggtttgtgccgcagcaatggcgcgttcgccgtagatccacaccgcgcgagaaagttgttcatcagtgaaaaaatcgtgcaggtgattgaaacttccgggatgtgaaaagtagttagccgggccgactaccacgcggataggattgtgaggcatgttgtgttgtccttattgttttatttagacatctaaacgtcttgattgccaaatactagcatcgtgttatagtgccttcaacacgcaaccaacacgcaacttcgtcaggtacaataaaaatgacaaataaccctctgattccacaaagcaaacttccacaacttggcaccactattttcacccggatgagcgcgctggcgcagcaacaccaggcgattaacctttcgcaaggctttcctgattttgatggtccgcgctatttacaggagcggctggcgtaccacgttgcccagggggcaaaccaatacgcgcccatgaccggcgtgcaggccttgcgcgaggcgattgctcagaaaacggaacgtctgtatggctatcaaccggatgtcgacagcaatatcaccgtgacggcaggggcgacggaggcgttatacgcggcgataaccgcattggtgcgcaatggcgacgaagtgatttgttttgatcccagctatgacagttacgcccccgccatcgcactttcggggggaatagtgaaacgtattgcactgcaaccgccgcattttcgcgttgactggcaggaatttgccgcattgttaagcgagcgcacccgactggtgatcctcaacaccccgcataaccccagtgcaactgtctggcagcagactgatttcgccgctctgtggcaggcgatcgccgggcacgagatttttgtcattagcgatgaagtctacgagcacatcaatttttcacaacagggccatgccagcgtgctggcgcatccgcaattgcgtgagcgagcggtggcggtgtcatcgtttggcaagacctatcatatgaccggctggaaagtgggttattgcgttgcgcctgcgcccatcagcgccgagatccgcaaagtgcatcagtatctgaccttttcggtgaataccccggcacaactggcgcttgccgatatgctacgtgcagaacctgagcattatcttgcgttaccggacttttatcgccagaagcgcgatattctggtgaatgccttaaatgaaagtcggctggagattttaccgtgcgaaggtacatactttttgctggtggattacagcgccgtatctacgatggatgatgttgagttttgccagtggctgacgcgggagcacggtgtagcggcgattccgctgtcggtgttttgcgccgatcccttcccacataaactgattcgtctctgttttgccaagaaggaatcgacgttgctggcagcagcagaacgcctgcgccagctgtagttatttaaccgtccaggcgcgggaaaattgacggtcggcaaacaactcttgcaggccgttaatttgcttcaggcgtaacacttcgtcgctgtccattcccagctctttgcctattttattatcgtcccatcccaactggctgagttctcggacgatttctgacatggcagtgatttggtgacgtccacgagcgcgattatgacgaatagtcgcggcgatgcgttgattacgcgtaccttccagacaggtcaccggcaaataaccttttaagcgtaattttaacgatgatgagcctttaccaatttcatggcggtgaaaaccatccacgatttccagagcatttttatccgtatgcgtgaccacaatgggttgggtaaaaccatctatttcaatggattttttcagcagttttttttcgggtggtgccacgttgtttgggttgtaatcattaggcataagttggctgtttttaacccacagaacgcaatccactggctcttcacgaaaggggctaacctgatggatcgccatgcggatttcattaatcgctttgatgcgatcatcttccggcaagctggcgagaaattgggttaaatcctgcgttaatcgttgttgcatagtatcccccattcctgacgttttccttttatccgttcgttataacgctgatagttcttcgctttcgtaggactaaatgataatgcccggcaccagtaatcgttattgagtaaaactttgcatattcgccgccaggaggggatatctttcgcgccaatgtccccttgctgggtttgtggaacttcgatgccttttttctgataccagtgcaaataaatggcgattttattgcggtaatgctcagctgttttttccggcatgctattgagcagcaataatgcatattcttgccagtctaaatgttctggcttgaggattttccgatgaccataaaaatgattatcatgtccggcgtaaatgccgccactttttaccccgctgactcgtgcgcacatagcagcccagcgatccggttcgataacgtgatagagccataatccttgccgttgctccgggccaaaaggttcgcaaattcgcatatgacgcagaggaacgcctgcctgatacattatattatacagtgggttacagagctgttgatggttagcataccaggtccagatatcagccactttccagtcgtagatggggtaaatgtaccagctatgaccgcctggtgcggcggtggtccagggtttatcatcggcaaaacgttgtttatttaaactggcgatggcgacaaaacggttgtaggactcatctgcacggatgccgatcatcatcgccgccggacgcttttgcgaaaaccattcggcaaactcacgcacaaattgttcgaaggtcataccaggctggtaaaaggagaaaaagtcaggatcggttatcgcatcttgcgggggctgacgcacccattcgacatcaggttcccagcactgccattcgggttggtattgagaaagggaattttgcgtcgtaagcgggagcgcaacccagtaaaactcttcgatgacatcggcgtaaaactcacgtaatgactgaacatagttaatagtgcatgagaactgcgcttcccagtcgataaacaaaacgcagatttttttgcccatttgtcgggcaatttcagctgtcagatgcagcattaatccggaatctttaccacccgaaaaagaaacacagatacggggtagggtattaagtgtccaggtaatacgttcttttgcagcttccagaatattcagtggaagcgggattttataaatagacatctaaaaacgctctctgaacgttacggggtgactcgtgagatgaatccgctaattataggataaacgaagcaagatagagcacattattttatattcacacaatgaattaattgatgcgtaatatattatttgtcagtggtaatgaatcagaagctatcatttaaacgatctatgaatcgggagaagacaaggttgttcaacgaagccttgttataggaaatataaagtttaaccgcaggaagaggttgttccagttttatttcttttaacttcaaaaagtcacgatgtaaatcgtacagttcggtgggcacaatgcctaataagtcagtaacagaaatactattaattatagtcatcaaagaagaactgcgaaatgaaactttacggttcataaaacgttcatctatgtccatttgaatttcgtcaatccctgctgatttagatatcaacagggtgaattcttcggcgataatttgttcatagttactggtatcagtaatacgaggatgtttgttgctacatataagggaattgcgaatagtgtgtaacggcatgcagatgacagagcgactaattactggttgcagcgtaattgccaggtcagttttgcgttgaaccaacagttcttcggcattttcagctgaaagcaggatgtcatggcattctatatcgattgaagtatcttgtctaagacagcggattagcatgttgttattagtacaagaaataagctgaggaccgtagataataaaatttttctttagttcagacttattaacgatattgatcgtttgttcaaggcctctgagatttttctcaagatggtgatgcaggtttaaccctgttgtagtcggcgcgatacctttccctgagcgaatgaataacgggtcattaaattgcgcacgtaaacgttgtaacgactgactaacagcagagggcgttatatataatgattctgccgctttactaatgctgagatgttgataaatacattcaaatatgaccagtaaattgaggtcaaatttttttagatcataaagattagccataacatactccgttgtattgtctcttccataaatcattcacttgatcaataatgttgttgtatttatatgtattatgtttttctgcttaactttggattaagattttctaaaatagcatagctgtcaggtgggttacgagcaattcatgcgtttttaggatggttgaaaagcagagagagatttcaaccatcgatgaattatattctatttattccccataatgatattaagtgttttctgatcgggtaatccgacggcttgttgcagggtattttccttactcatgtaatagatagctggtgtgacatttgcccccagatcgtccatgagtttctcgttgtcgcttaacactttcatttgctctgtgcttacgtttgcaggcacgcttagcttaagcttgccaccagaggcttcatattgttgccaggtttttgcgggatctttggaggcaagaattgccgctgctgtcgccgggctttctggcttgataaccccaaccaacaatgttctcaattgcactttgccagaatctacccacggacgagcctgctgccagaactgtttacaatatgggcagaacggatcggcgaagacgtagacaatgaccggcgcgtcttttttaccgtcgaggagccagtgggattgttccatccgttgccacatttcacgtccggcgggtgcgtaaatttctttttcgataagcgtgttactcaggttttcacctttttcgttgtacatgtaaccagagatagcgtgcttaccatctggagtcaggtagatggtgacgcccatatcctgatacttaccgagataacctttcattcctccaggggcatcgaacgttttgatgattgtaataccctgtttttcaatcgcttttactggggcaggaagttcctctgcgaaggcgattgcaggaagcagagccagtaaaagtatcttttttaacattaatttgtccttttcagtcagtgcaaaagtcgagtaaaaggcataacctatcactgtcataggtaagagcttagatcaggtgattgccctttgtttatgagggtgttgtaatccatgtcgttgttgcatttgtaagggcaacacctcagcctgcaggcaggcgctgaagataccaaagggtagttcagattacacggtcacctggaaagggggccattttactttttatcgccgctggcggtgcaaagttcacaaagttgtcttacgaaggttgtaaggtaaaacttatcgatttgataatggaaacgcattagccgaatcggcaaaaattggttaccttacatctcatcgaaaacacggaggaagtatagatgtccttgattaacaccaaaattaaaccttttaaaaaccaggcattcaaaaacggcgaattcatcgaaatcaccgaaaaagataccgaaggccgctggagcgtcttcttcttctacccggctgactttactttcgtatgcccgaccgaactgggtgacgttgctgaccattacgaagaattgcagaaactgggcgtagacgtatacgcagtatctaccgatactcacttcacccacaaagcatggcacagcagctctgaaaccatcgctaaaatcaaatatgcgatgatcggcgacccgactggcgccctgacccgtaacttcgacaacatgcgtgaagatgaaggtctggctgaccgtgcgaccttcgttgttgacccgcagggtatcatccaggcaatcgaagttaccgctgaaggcattggccgtgacgcgtctgacctgctgcgtaaaatcaaagcagcacagtacgtagcttctcacccaggtgaagtttgcccggctaaatggaaagaaggtgaagcaactctggctccgtctctggacctggttggtaaaatctaaatttcctttgtctttcgcgctactaactccggcgcgagatacttcggaaattcacctaattcttcgggtgctgcggcacccgattttcttccccgcaccatgatgcaagctgcatccagctagccgcagaggccgcttgcatgatgatgtttaaagcccaggagataaacatgctcgacacaaatatgaaaactcaactcaaggcttaccttgagaaattgaccaagcctgttgagttaattgccacgctggatgacagcgctaaatcggcagaaatcaaggaactgttggctgaaatcgcagaactgtcagacaaagtcacctttaaagaagataacagcttgccggtgcgtaagccgtctttcctgatcaccaacccaggttccaaccagggaccacgttttgcaggctccccgctgggccacgagttcacctcgctggtactggcgttgctgtggaccggtggtcatccgtcgaaagaagcgcagtctctgctggagcagattcgccatattgacggtgattttgaattcgaaacctattactcgctctcttgccacaactgcccggacgtggtgcaggcgctgaacctgatgagtgtactgaacccgcgcatcaagcacactgcaattgacggcggcaccttccagaacgaaatcaccgatcgcaacgtgatgggcgttccggcagtgttcgtaaacgggaaagagtttggtcagggccgcatgacgttgactgaaatcgttgccaaaattgatactggtgcggaaaaacgtgcggcagaagagctgaataagcgtgatgcttatgacgtattaatcgttggttccggaccggcgggtgcagcggcagcaatttactccgcacgtaaaggcatccgtaccggtctgatgggcgaacgttttggtggtcagatcctcgataccgttgatatcgaaaactacatttctgtaccgaagaccgaaggccagaaactggcaggtgcgctgaaagttcatgttgatgaatacgacgttgatgtgatcgatagccagagcgcgagcaaactgatcccggcagcggttgaaggcggcctgcatcagattgaaacagcttctggcgcggtactgaaagcacgcagcattatcgtggcgactggtgcaaaatggcgcaacatgaacgttcctggcgaagatcagtatcgcaccaaaggcgtgacctactgcccgcactgcgacggcccgctgtttaaaggcaaacgcgtagcggttatcggcggcggtaactccggcgtggaagcggcaattgacctggcgggtatcgttgagcacgtaacgctgctggaatttgcgccagaaatgaaagccgaccaggttctgcaggacaaactgcgcagcctgaaaaacgtcgacattattctgaatgcgcaaaccacggaagtgaaaggcgacggtagcaaagtcgtaggtctggaatatcgcgatcgtgtcagcggcgatattcacaacatcgaactggccggtattttcgtccagattggtctgctgccgaacaccaactggctggaaggcgcagtcgaacgtaatcgcatgggcgagattatcattgatgcgaaatgcgaaaccaacgtcaaaggcgtgttcgcagcgggtgactgtacgacggttccgtacaagcagatcatcatcgccactggcgaaggtgccaaagcctctctgagtgcttttgactacctgattcgcaccaaaactgcataagaagaagtaagattcacctgtaattgcttagccgccggggtcaaacctggcggcttttttattgcattaaaaagccctgcagggatggctccgggcagggcgggagacttattctggcaattaacgcacaaccagcaccggcaaattggcgtggcggatcacgctcgaggcgttagaacccaacagatgagttgaaattgatgggttacgcgaaccaatcactactacatctgcatcaagttctttcgctaactcgttaacttcatcccgcacactaccaaaacggacatgttgcttaatgcgggaaggatcgatggtgaagtggctgaccatcgtttgtaaacgttcttctgcttcatgttgcagatgctcttcaaaacgacgtacatcagcggcaaaacggtgcaggctcaggctggctgaccccggtagtacgtgaagtagatgaataactccgtcatcctgggcgaggaattcagcgtggcgaaccgctttgtcgctcaattccatttcgaaaacatccactggcatgatgattgttttgtacataagcattctctccttgtttttgcatgtatacataacagcacattattggttatgaatctataatttgcgaggctgatttgatctgaatttgctattgagctggaaaataaataaaaccaggcgctaccagcgttgttcaaagtacagcactgcagcaacaataattgctgctatgaatatataaaatgcagtgataccgagagcttcgctcatatgaggttccgcagatgaataaccagttcagattagaatgctgcgcttaagagcaaaatgataaatctggttgatatttgagcggaaagaggatgcgagtgcatcctctgggcaaagcgagttatcgcttgtgcagatgggattaaagcaggtagtcgccagcagcttctggctggtattcgagttccagcacttcaaggtgggttgcaacgccgcccggaagttcccagtgaatggaatcgccaacgcgcagccccagcagtgcggcacctaccggagccataacggaaagctgagtattgctgtcggtcatttttgccggatacaccagcgtgcgcacacgcacttcgccatcgctaagattgcggaatttaacccggctgttcattgtcaccacgtcgtgtggcatctcttctggcgaacacatttgggcgcgatccaactctgcgtttaacgcgtcggcgattggcaaaccagcataggcgggttgctccagcagaatatcgatgcgttcggcatccaggtcgttaatgatgatagttggtctggacatttttactccatgtcgtcggtactgcgagtgtcgcagataaacatacccaaaagaaaaccctcaccgtcaggcggcgagggtttaactcacatgatgatactgactgttgctcactctttgaagtgatttgcgtcacattcagggaattcctcaatgtagcgcattatgtataaatcttaatcgtcatggtttatgggagacgaattagcgtgttttgtaaatcagaggattaataacctgctttatcaatcacaaaggttttgccacagttacctgggtgtggttgtggcaagaatgagtttgcagaaagcggagcgttgatggcgtcagctttgatcgagatctgaatttcagtcaaatacgcagggttaccctggcacgttagcttaactgctttcacgttctcttttccccagcttttggcaaaggcggcgtcaaagtcacggcggctcactgttttaccgtaattatccgcaaggaattttccggcttcgctctctttaatttcttgattcaggcgtaccatcgtgccgaagtatgcgtctggatcaaaaccaaagcaggcaccgtgtttggcatattcgtagcgttccaggcaggaacgtccgccagctcctggcatgacttcacttagtttagctgccgtttccagtgataacccggtttccggcgatgaacacatccggctggcacgtgcttctggcagattcgggattgggcgagtagcgcaaccgaagcgcatccagcggcgttcatcaacaccacgggcagcaaccgatttaggcaatcctggccacagaccatgtacggtcaaaaaatcagctttgttggtcgtttcggtttgcaggcgacattcatctcgttcgttacgatttcggtcgtattgactctgacaaaatccggtttgccatgagagggccaggacatagcgatcaaaatcgtcatactgttttgcctgcaacgccacggcgttggcagaagagaagggaagcagagaaaccgcgagcaacgcggcgttacgccagaatgctttcataatgggtgtggaactcatacatacactgaatattatctattaaatcataaaaaagcccgccaggtgggcttacctggcgggcgtgatgatttattcagcgtttggcgaacgtattagttccacatggcgagaatcggccagccaaccaacagcagcatagagatgtaaatcaccccgaagattgcgccaagacgccagtaatcttttgatttcacatagccacagccgtaaataatcaccccaggaccggttgcataaggcgtcagacagcccatgataccgatagacagcaccagcaggatacacagttgttccattggtacgcccggaatccctttaccgacggccagaataaccggcagcatggttgcggtgtgcgcagacaggctggcaaacaggtagtgggcaaagtagaacaccagaaccagtacaatcaccgttgcgtttggtgagaagccttccaggtgcgtactcatcgtgttggcgaaccagtcgataaagccagaacgggtcagaccattcgccataacaaccagcgttgccaggttgaccagcgtgttccatgcgctgttatagcgagtaatgtctttccacggcacaacgtgcagcgccagcatcagcgaaactgccagcagacctaccgcagtagcattaatgacttcactgccaaatacccacaaacctaagctgagcaatacaaggccaatcagcgtccactctctgcgtgtcagcgcacccatggtttttagttcatcacccgcccaggttgccacttcttcactgtgtgtgatttccggtttgtacagcacgtaggaaagccacggcgcaatgataagcaagataaccccaaccggcaggaagcagaggaaccactgcaaccagctaatctggataccggcaattttgctgacgaactccagacccagcacgtttggtgccgcaccggtgacaaacatggacgaactcagactggtactaatgaccatcatccacatcaaatagccgccaatacgacgcgcggacggatcgttcgggaatgatttaaacagcggcggcaggtttttaatgaccggaaaaaccgtacccccggtacgcgcggtgttggacggtgtaaacggtgccagcagaatgtcgataatgacaatcgcataacccaacgtcagcgtgcgtttgcccatgaatttcaccaggaaaagggcaatacgacggcctaacccggaaacttcataccctaatgcaaaaataaatgcgccaaataccagccataccgtggtgctggaaaaaccagccagaccccatttcagcgcctgtttttgcgcattaaacgctgggtcagctaattctttggcatcaaagagcaggtaattactgccaataacgcaaatagtaaccgcaataaaactgatcgccgttgccggaattggctcgaggatcatgccgacaatcattgccacaaacactgcaaagtaatgccacgcctgcggcggcataccgtcaggtacagggataagaaacatgacacccatcaccaccaggggcgccaataatttccatatattatcttttgctaaagacatacgggttctccgaaaattaatatttccaaatttatcaagtgcttaaataattaaatctgtgctaaaaaccaggtaagaatcagcaggtcggcactgccgcctggactgatatttcgttcgatacactccctgtcgaactgccggagataatcgagatcggcgggggttcggatgcccccattgtttaataatgtttgcgcctcgcgctgtagccagcgcaggcccccctcgccaccgcgcgatgcaacgttggtatcgccgttggtagccatcagtaggagcaaggtatcgagcaatgccagctcaggatctaacccctgatccagcagagtgaggtaatgcggcaaggcgtggttgatcaccagtggataacccgcttcggcttcaccgcgtgcgccggtaaggccaagctgctggtacaaccgttgacctgccgtcagttgtgaattattggtacgcagttcgcgatcggtcaggccacggcagaaacttgccgccgtcgcacaaattgttattggcgttaccgactggttgagttgaagcaaacggccaattgccgcacacagtagccctaaagaaaaaatgctgcctttatgcgtgtttacgcccgcagtggcgcggaacatatcaccttcgcaagccatacctattgggcgtaatccgtggagtacctcttctggtgccatttcagcactacaggcaccaaattcaatgaaacggggtaaccagccctgaatcgccagcgcgctgcggtgaaaatcttccagcgccatatctttatgcgcaccgcagttaatccgatccacgaggcctggtttcggtgacagattgacttcagtcagcatggcgcgccagcccagcagggcgtactcatcgattaatgacgtcgcaagctttgtggttttagttgacgttgcaggcatcgacatcgttcagcagcgcctccatgcggttgagtaaatcggtcagttgatgggtttttccacgcgcgcaaacagctgcgctttgctcgcacaacaggcagcggcgaggcggcagtgaatagtcgcggcgggagagaatgtcgccttcgggtgtcaggacatcgatatcccataaccgcccgagaggatgactatgttcaagctcaatggtggcgagcttgaggtcgcgagccggggcggcaatgctcaacatgccctccggcccgctggcggaaaccagtgcagcctgctcctgaatttgccagccctgctttgtggctaaggcacgcaaggctgtcacgccatgattaaaaattcggcgtgtgacctcgctgtctttaatcggcccaggcgcaaccacggtaaaggagaccagtggaacaggatggcgcttgagccaggcgtgttgccgtgcttgcctttcatcccggctgacgagcagctcgggaattgacaccgcatggtggctggcgaattcaggaagcaggtgcatggcttattccttcacctgatgcacaacatcgatcaccgagccatcgcggtaacgcacaacggcaacgacgcggtcggtgaattcaatcggctgtggttcaccggtcagcagacgcgcacgttcacgcagccactcaatagaaaccactttgatccccgcttcctgcagacgttctgccagctccggacgtgccgggttaacagcgatgccgtggtctgtgaccagaatatcgacactggagcccggggtgatgcaggtcagcacgttatccaccagcgtcggaatacgaccgcgtaccagcggcgcgacgatgatggaaagcgcagaagcaatcgcggtatcgcagtgaccaccggaagcaccacgcagtacgccgtcagagccggtcagcacgttaacgttgaactgggtgtcaatttccagcgcgctcagtaccaccacgtcgagacgatcaaccgctgcgcctttcgacccccagttagcgtactggttggcgctgatttcgatgtgattggggttacgggccagcgattgcgcagcatggctgtcaaagctctgcacatccagcagtttgcggatcagacctttttcgtgcagatcaaccatcgttgcggtaataccgccgagggcgaagtcggcgcgaatatcgcggctacgcattttgtcttccaggaaacgggttaccgccagcgaagcgccgccggtgccggtctgcatggagaaaccttctttgaagtagccagagttaacaatcacatccgcagcgctacgggcaataagcagttcgcgcgggttagtggtcatacgggtagcaccagcgccgatttttgcagcatcgccaacgcgatcaactttgacgatcagatcaacctgatcttgctcaatgcttgccggattatgcggataaggcagcagttcttcggtaagcatcacgacctgttttgcgttgtcggcatcaaccattgcatagccgagggagccgcagcaggctttaccggagtagccgttggcattaccgaattcatcacaggacgggacgccgaggaaagccacatcgatattcagttcgccgctctgtaccagatgcacacgtccgccgtgagagtggatttgcaccggttccgccagcagaccacgggagatttcttccgccagtggaccgcgcaggccagaggtataaatgcgggtaaccacgccctggcgaatgtgttctaccagtggcgcatggcaatcactcagggagctggaggccagagtcaggtttttaaagcccatcttcgcgatgacgtccatcaccatattgacggtcaggtcaccgccacggaaagcgtgatggaaggaaaccgtcatgccgtcctgtaaaccagagcgacgaatcgcttcttccaggttggcgcacagtttgcgatcgcgcgctttttcagcctggtaggtttgctttggcgagttctggaaagcggcaagatcgcattcagcgcgacgattccaggccgctacccgttcttgtcgttgagattgttcaattttctgcgtcattttgattgccttattcttcgcggatgccggaaagttctgcacgggagagcaccagacgggcgcgatcgataaccggaccgtccaccatcttgccgttcagggaaaccacgccgaggccttcgcgagcggcggcttcagcggcttctacgacgcggcgggcgtgatccacttctttctgggtcggtgcgtagaggttgtgcagcagatcaatctgacgcgggttgatcagcgatttgccgtcaaagcccagctgtttgatgtgggcggcttcttgcaggaatccggcttcgttgttagcgtcggaatagacggtatcgaacgcctgaatacccgcagagcgcgcggcctgcaaaatggagcagcgagcgaacagcagttcagttccttccggggagcgttctgtacgcaggttgcgcacatagtcttctgcaccgagggcgataccgatcaaacgctcggaagcgtgagcgatttccactgcgcgggtaatgcccagcggagattcaatcgccgccagcaggccggtactgccgggttcacgaccacaggctttttcgatacgcaggatctctttttcgatatccagaacatcctgagcggtatcggttttcggcagacgcacaacgtccgcaccaccgcgaacgacggcttccaggtcgttaacaccccattcggaatccagcgcgtttacacgcacaatggtttcaatatcgcgataaagcggatgttgcagcgcgtggtaaaccatgcggcgggcggtgtctttttcacgcaatgctacggagtcttcgaggtcaaacatcagggcatcagccgggtagatgaaggagttgctgaccatcgcggcattagcaccaggcacaaacaacatactgcggcgggtgcgagttttacgttgttgcagcgaagcggaaatcattggcaatcctcccatggcagagccgggataccgctggcgcgtgccagcagggcttccagtcgtgcacgtaaaatgcagtccagtgcgcctttgtcatcgacattcagctgtacgccgcgcacgttgtagcgggcgagaacgtccagaatggtggtgcgaattgcatcgccaaactgtttctcaacgctgctgttgatttgcaggtcgatatcctgcgtatcgagtggggcgatgcgtatcatcacatccccagactcaagggtgcctgcaacggcgggctggtttattttcatttttcacctgtttctcatgcgggggtcttttgacgagctgccgcgtcctggcgggagtgctcaagcaggttctgcaaataatgcagcgtgactgcagggaccagcggcgcgatagccgtgagatcgtttttcgccagcagttgacgtacccgggaagcggatatcggcatctcctggtaacgcagccgctcaatttcaaccagttcgatgggcggtgcggagatagtcggcgtttccagccagtagcgcatatcctggttgtactgggcggtaacgcgacaaaagggttcagtaccgacaaagcggtgagttacacccagcgcgggagcgaggtactgacggaaaatcttcagatcaatttcggtgtaacaatggttaatgacgctctgttctttaatgaagtagcaagggaacgtagcgcgggagatgatgtattcggagccgcgatgcacagtcaggcgtggaatatcggcggtgccttttaacaccagatccagccggtcttcataggggaagcgtgaagaatcttctttgactaaaaacagatgcaaccagtcgcactgtgccgcagcctgttgaatcagataacggtgaccattcgtaaagggattggcgttcatcacaatgcagccaatcttgttccctggatgacgaaattttttcagcgattcggcatagcgtttcagtcgcgtggcgctgttttccatcagcaccatcacgccgggtacgctggtcagcgtggaaaaaccgcactggcggaacagcgcctcgtattcggttttggtataaataaacagatgcgtgctatgccgctcataggcgaggtttatcagttcagtggctaatgtcagcgccagtccttcaccgcgaacggattcactgatagcaacgcatttaataatatttccggcaattccaccgcacgcgataagcttttcatcgcgggttacggtaataaatacttcgactgtggtgtcaacgctcaaatcattttcatgcaggaattgggcgatttccgccatttttttattttctgaacgttttacgcgggtgaaaatatcattgccgaacataataaatagtatcctgaaggtgcatgttgttatcgatttgcaacgaatgttgttcaatgttgcaaattgataaccttttattttcacttgggagaaagggggcgatcgaggtatatctttttctcctttcgctatacatcctaaggagtatttcggcgtgaaattttgatttatttcacatagagttagtggttttttatttatttaatggttttaagttttttaactaatgtaattacgaaataacccgcaggtttaagtgatttaattgatttaatgaataaaatttgccacgatcatatttaatatctatgtattttgattcaacattttaattacatccgtcaaagaggctcgggacaacccgcaaggaaaacaatgttgcagcttaaagagaataaacagtttgcatttttccaaagactggcatttccgctgcgtatctttttgctgattctggtgttctcaatatttgtcattgcagccctggcgcaatattttacagccagttttgaggactatttaacgcttcatgtgcgcgacatggcaatgaatcaggcaaaaattattgcttctaatgacagtatcatcagtgcagtgaaaacgcgtgactacaagaggctggcgaccatcgctgacaaattacaaagagatactgatttcgattatgtggtgattggcgatcggcactcgattcgtctttaccatcctaatccggagaaaattggttatcctatgcagttcaccaaaccgggcgcgctggagaaaggggagagctacttcatcaccgggaaagggtcaattggcatggcgatgcgtgccaaaacgccaatctttgatgacgatggaaaagtcatcggcgtggtgtcgattggctatctggtgagtaaaatcgatagctggcgggctgagtttttattaccgatggcaggcgtgtttgtcgtgctgttagggattttgatgttgctgtcgtggttcctggccgcgcatatccgtcggcagatgatgggcatggagccaaagcaaatcgctcgcgtggtccgtcagcaagaggcgctgtttagttcggtttatgaagggctgattgcggtggatccgcacgggtacattaccgccatcaatcgtaacgcaagaaagatgctggggctgagttcccccggacggcaatggttgggtaaacccattgctgaagtggtcaggcccgccgatttctttaccgaacagattgatgaaaaacgtcaggatgtggtggcgaactttaacggtctgagcgttattgccaaccgggaagctattcgttctggcgatgatttactgggggccattattagctttcgtagtaaagacgaaatttccaccctcaatgcgcaactgacgcaaattaaacaatacgtcgagagccttcgtacattgcgacacgagcatctcaattggatgtcgacgctcaatggtctgttgcagatgaaagagtatgatcgcgtgctggcgatggtgcagggggagtctcaggcccagcaacagcttattgacagcctgcgtgaggcgtttgccgatcgccaggtggcggggctgctttttggtaaagtgcagcgcgcccgcgaactggggctaaaaatggtcatcgtccccggtagccagctttcgcaactgccgccaggactggacagaaccgagtttgcagccattgttggcaatttacttgataacgccttcgaagcaagcctgcgtagcgatgaaggaaacaagatcgttgaattattcctcagcgatgaaggcgatgatgtggtgattgaagtcgccgatcagggctgcggcgttccagagtctctacgagacaaaatatttgagcagggtgtcagtacgcgtgctgacgagcccggtgaacatggcattgggttgtacttgattgccagctacgtaacgcgctgcggtggtgttatcactctcgaagataatgatccctgcggtaccttattttcaatctatattccgaaagtgaaacctaatgacagctccattaaccctattgatcgttgaggacgaaacgccgctggcagagatgcatgcggaatatattcgtcacattcccggattcagtcagatattactggcgggaaacctggcgcaggcccgaatgatgatcgagcgttttaagccggggctaatcttgctcgataactatcttcctgacggtagagggattaatttactgcatgaactggtgcaggcgcattatcccggcgacgtggtgtttaccactgcagccagcgatatggaaacggtgtctgaagccgtacgttgtggtgtatttgattatctcattaagcccattgcctatgaacggttggggcaaacgctaacccgtttccgccagcgtaaacatatgctggaaagtattgatagcgccagccagaagcaaattgatgagatgtttaatgcctatgctcgcggtgaacccaaagacgaactgccgaccggcattgaccccttgacgctaaacgcggtgcgaaaactgttcaaagagcctggtgtgcaacatacggcagaaacggtggcgcaggcactgaccatcagccgcaccactgccaggcgttatcttgaatattgcgccagccgccatctgattattgctgaaattgttcacggcaaagttggcagaccgcaacgcatataccacagtgggtgacatgataaagccggaggaaacttgcctccggcattactatttacttgcctgtgaccgctgctgccgttcctggcaccatcagctctgtagcaacgataacaatcaccaaaccaacaagcaccggcaccgaggtgcgttttacgacttcaaacggcgagatcttcgccatcccggcaaccgcaacgactacgccagaaacgggtgatagggtacgacccaggtttgacgcctgcagcatcgggatagtcaaatacgccgggttaatgccggaggagtgcgccagtttcgggatcatctcaacaaacgcataaaacggcgcattgcctgaaccggtcgtgactgccgccagcattgtcaggatcaccaataccagcatcaggatgatactcgccgaaccaaacgaggtagcgatagaaatcagactttgaataaagccgatggtgctaagcccctgagcgaataccccagcggcaaccagcagcatcaccacgttagcaaatgcatctgccatcccgcgataagccacttccagaccagagaaaactttctgggtattaaagctgcggatgaactccagaatggaggcaattagcatacaaatcaccagaatagtgatgatgtgtaattgcggaccccatttgccgtcaaaaatcagtactccgatgatcggcgtgaacggcaaaatggcataaaacgcaggggcagtggtggtgatttcactgacatctaacatttcatgagagatgtgctcttttttatccagataacgttgccagaagaagtgggcgatcgccatgccgataattgcagcaattgagataggcagcgttgttttgaaggcgaagtcaatcagcgacatttcggaagcctgcgccgccagcaccacatcccctgaagtcggtgcgagaataatcgccgccggggaggcacaaatggcagcagctgcgccacgactgataccaacgtttaccatcaccggaaacagggttgccatcagcaaaacacccagaccggttgcggaagagacggccagtgacatcagacaggcaacaaaataggcggcaatcatcagaaggtaaggggagttaatatactgcaatggttttgacgccagcttgaccaccatatcattcgcgccgatatgggtcatgtaagcggcaaagccacacagcatcataatcatcatgccgaggtcgccaccgcggctcattagcaatattttaacgtattcaacgatatccgtggcgctgtagcctgttgaagcctggctggacggtaacactttgtgccccataatggcactgataatcagcaataacaggccaccgacaaataacacgccagtggccgaataccctttaatgatgtagcgagctacacccacaataaccacaaccccaataaggagttcaatgaatgtcagcataatttttcctgtctccaggccccaaagtaaataataaaaaattcctaaaagttaaggaaaaaatatgcccaataaattggcggtgaatgctgattaaaatcaagaaaaactgccattaagacattgaagttgctgtttttatgcgtagataacaaaacgcatatttagcggttggcaaatatcacataataatgtgtgtaaattgatggtggattgatgcaaattcgttaattgtaaggtgttagctgcggttgtgtgctcaaaaaataatcttccatgagcatgagttgacgatacataatatatttttcgttaagatattttttatatcttattaaaaaataaagtaatttttatcggttgtattttgttatcagaaacgacttggtttttcttttatgactattcccatcgcagaaaacgatgcgtcgtctttaatcgatgcgcggaaatatttatcttgaactagcggaaataaatagggcagctattcatattattcttcatgttggggctattgaggttatgttaattgtagctttgctatgttagtagtagatttctgataaatgtttaatggtcacaaatgaacgtgagtaaatatgtcgctatatttttctttgtttttattcagttaatcagtgttggtaaagtttttgctaacgctgatgagtggatgacaacgtttagagaaaatattgcacaaacctggcaacagccagaacattatgatttatatattcctgccatcacctggcatgcacgttttgcttacgacaaagaaaaaaccgatcgctataacgagcgaccgtggggcggcggttttggtcagtcgcgttgggatgaaaaaggaaactggcatggcctgtatgccatggcatttaaggactcgtggaacaaatgggaaccgattgccggatacggatgggaaagtaccaggcgaccgctggcggatgaaaattttcatttaggcctgggatttaccgctggcgtaacggcgcgcgataactggaattacatccctcttccggttctactgccattggcctctgtggggtatggccccgcgacgtttcagatgacctacattccgggtacctacaacaatggcaatgtgtactttgcctggatgcgctttcagttttgagacaaatgaagttttagtaaatcctttaaaatcaaccagtaaaataattaacatcaaaaataacgcgacttttatcactttttagtaaagttgcactggacaaagcgtaccacaattggtgtactggtaaccgacacagcatttgtgtctatttttcatgtaaaggtaattttgatgtctaagattaaaggtaacgttaagtggtttaatgagtccaaaggattcggtttcattactccggaagacggcagcaaagacgtgttcgtacacttctctgcaatccagactaatggttttaaaactcttgctgaaggtcagcgcgtagagttcgaaatcactaacggtgccaaaggcccttctgctgcaaacgtaatcgctctgtaagatacgtcagcaagaattcaaaacccgcttaatcagcgggttttttttggtttttagtgtgcggttgaggccgaaaacagccagaaagccagtgcggtcatggcaaaagaccccaaaagattgacgaaaacgttcagtaacgcccagccaaagcggccctcttgtaacaaaaacaccacttctgccgaaaatgttgagaaggttgttagaccgccacaaaatccggtggtgattaatactttccacactggatcaatgttcgtcatcctgctgaaccaggcgaatcccattcctatgatgaatgccccaatcaggtttgctgccagcgtccccaacggaatcgcctgatgcagcgggttaaatcgcatacttaacagccatctcgccacgcttcccgtaccaccgcctataaaaactgctaaaagaagttgtaacactgcaaaatcctgctatttgatttgtatgagtgataagtgtaacgccgaataatcgccgttggcgaattttacgactctgacaggaggaggtggcaatgctggttgccgcaggacagtttgctgttacatctgtgtgggaaaagaacgctgagatttgtggctcgttgatggcgcaggcggcggaaaacgacgtttcgctgtttgtcctgccggaagcattactggcgcgtgatgatcatgatgcagatctatcggttaaatcagcacagctgctggaaggcgaattcctcggacgtttacggcgagaaagtaaacgtaacatgatgacgacaattctgacgattcatgttccttcaacgccggggcgcgcatggaatatgctggtggcgctacaggcaggaaacatcgtcgcccgttatgccaaactgcatctctatgatgcatttgccattcaggaatcacgccatgttgatgccggtaatgaaatagctccgttactggaggtggaagggatgaaggtcggtctgatgacctgttatgacttacgctttccagagctggcgctggcacaggcattacagggagctgaaatcctggtacttcctgccgcctgggttcgtgggccgctcaaagagcatcactggtcaacgttgcttgccgctcgtgcgctggataccacctgttatatggtggcggcgggggagtgcgggaacaaaaatatcgggcaaagccggattatagatccctttggcgtcaccattgcggcagcgtcagaaatgccagcactcattatggcggaagtgacgcccgaacgtgtgcgtcaggtacgcgcgcaactgcccgtcttaaacaaccgtcgctttgcgccgccgcaattattatgatgtttttttactcggcgcttgattcaccttgttacagattgctattgtgtgcgcgcgtcgaatgaccgttaatattctctggtttttaaggcgcgttctgttgccggttatatgtcaagaaggtatctatgggtgagattagtattaccaaactgctggtagttgcggcgctggtcgttctgctgtttgggactaagaagttacgtacgctgggcggagaccttggagcggccattaaagggttcaagaaggcgatgaatgatgacgatgctgcggcgaaaaaaggcgcagacgttgatcttcaggctgaaaagctctctcataaagagtgacgtggcgagcaggacgctccctcaatatcttgttcgatacaaaaacccgcttcaaaaagcgggttttttatcagacagatgtaagtaattattacaggattacttaacttccatccctttcgcctgcaaatcggcgtggtaagaagagcggacaaacggaccgcatgcagcatgggtaaagcccatcgccagcgcttcggctttcatttcgtcgaactcatccgggctaacgtaacgttgaaccggcaggtgatggcggcttggctgcaaatattgccccagcgttagcatcgtcacaccatgacggcgcaggtcgcgcattacctcaataatttcttcattggtttcacccagtcccaccatcagaccagacttggtcgggatttccggatgcgcttctttaaagcgttccagcagcttcagcgaccagttgtaatctgcaccaggccgtacctgacggtaaatacgcggtacgttttccaggttatggttgaacacatctggtggtgtggcggtcagaatatccagagcacgatccatacgaccgcggaaatccggcaccagagtttcaattttgatttgcgggcttttttcccgaatggcagtaatgcaatccgcaaagtgctgggcaccgccatcgcgcaggtcatcacggtcaacggaggtgataaccacataacgcagcgccatatcggcaatggtctgcgccagtttcactggttcattggcatcaggagctaccgggcgaccgtgggcaacgtcacagaacgggcaacggcgggtacaaatagcgccgaggatcataaacgttgctgtgccgtggttaaagcattccgccaggttagggcaggaggcttcctcacagacagaatgcaggccatttttgcgcattgcggctttgatgccctggatacgtgtagagtccgctggaagcttgattttcatccattccggcttgcgcagcagggcttcgcgctctgttgccacgtttttaaccgggataagggccatcttatcggcatcgcggtatttaacaccgcgttccatcacaatgggtttactcatagcgtgcgtgttccagttgcgaattacgaaggaaagcgtttcaattcaatagattgttgtaattatcaactatttttgaattaacgactggcagtatatcattgaaacggacctgaaagcagccaaagcggtcgcgaaaatgtaaaattgttgttggattgtgccattttatcgttctgcgctgtgatctggctgtaacaatactttttcaaaatgcattacggataacatctatggtcctgtgcaaaacatgttatcggtgatgagatcggtttgaaactgactgagttggttttccgcgccgccgatgggcgggttgcgcagtaaaagctgtggatagtgagttttaatcgcccgatagatgacaggaaggaccagggctccgaccgaggggggcagattaagcactttcgctgcattaacgattcctttatggacatatgcaacttcaaaatagtcagaagagtaagatcaatatttcgtaaggttgtaaatatttgtggtttaccttctgacgattttctacttaaacagggttcaatttgattattactatccacgcacttactcaaattttattcatggaaaaataatatttataaaaattacaataatcttatgtctaattgggacggaacgcttttgctcaccatggtcaattatttcaatgagttaatcaattaggtgggctacggagcaaggcgtagcatcgcatttctgcaagtgataaagaaaatatacaaacgcgaaggagatgtaaagcattagcaggtattatgagtaatgacccagtgtaaattgggccattgatgtatggaattaagcggtaatatattcgaagtcaggattgtttagtagcgctaaaatattttccagtaaacgtggtgcaatattattagttgtcgcttcgggtttccattgtgatattttagccatttccattcctgcatacccacaaggattaatacgtaaaaatggtgaaagatccatattgacgtttaatgccagaccgtggaatgaacaaccgcgtcgaatacgtaaacccagtgagcaaattttcttttccccgacatagacaccaggcgcgtcagcccgaggatgcgcttctatacccagttcagccagggtattcaccactgtttgctcaagcaaggtcaccagttcacgcacaccgagtttacggcgtttcaggttaagcaacacatacatcacctgttgccccggcccgtgataagtcacctgcccaccgcgatcgctctggatcaccggaatatcacccggcattaaaatgtgctccgcctttcctgcctgcccttgggtgaataccggatagtgctcgaccagccagatttcatcaagggtactatcatcgcgggtatcggtgaattcatgcatagcctgggagattggctcgtaaggctgaagaccgagctggcggacaagaattttatcctgatacaaaacggcgtctccgtggagaatgagtaaaagtgggggaaaagtatatcacagcgaggagaggggagttacccgaccaggagccgggtaacggagaagcgagttacagaaccatgcggacaatatcgattttgcccagttcttcatacagtgtttcaacctgctcgatatgagtggcgttgatagtgatagataccgagtggtagttgcctttgctgcttggttttaccgttggggtgtagtcacctggcgcatggcgctgtaccacttcaaccacctgatcaaccagctcaggtaacgcctgccccataactttgtaagtaaaaggagtagggaattcaagcagttcgttaagtttggttttcatgtcagctccggcgtaacgtaattaaatagcaactcccgccagaaggcgggagttttttactgatgcttagtatatggggacggaaattacactttcaagtgttcaatttttaaccaaaccagtgatggaacattaatttaatgtaatcaatgattttgccgaagaagttaccttccgggatttcttgcagcacaaccagcgggcgttgttcgatcgttttgccatcaagctggaagttgatagtaccgacgacctgattcttttgcagcggcgcatgcaattcactgctgttcagcacatagctggctttcagatctttcatgcgaccacgcggaatggtcaggtacacgtctttatcaacccctaacgaagcgcgatcagaatcaccaaaccaaaccggttcagaggcgaactctttacctactttcagtgggttaacggtttcgaagaaacggaagccccaggttagcaattttttactttcggcttcacggcctttaaaagtacgtccgcccatcaccgcagagatcaagcgcatctggccttcagtcgcagaagcaacaaggttgtaacctgctttgtcagtgtgtccggttttgatgccgtcgacattcaggctgttatcccataacaggccgttacggttcagctggcgaataccgttaaacgtaaattctttttctttatagatcgagtattcattcggtacgtcacggatcaacgcctggccgatcagcgccatatctcgcgcggagctgtactgaccatcagcatccagaccgtgtaccgtctggaagtgggtatttttcaggcccagggcgttaacgtagctgttcatcaagccaacaaaagcgtcctggctaccagcggcaaaatcggccatggcgacacaagcatcgttacccgattgcaggttaataccgcggatcagctgagaaaccggaacctgcatgcccggtttgaggaacatcagcgaagaacctttaaacaccgggttaccggtggcccatgcgtcgttgccgatagtgactaaatcagtttctttaaatttaccggctttcattgcctggccgataacgtaactggtcatcattttggtcaggctggcaggatcgcggcggacatcagcgttctgttcggcgagtactttgccggagttatagtcaatcaggatgtaggactccgcgtcgatctgcggtacacccgggatcatggttttgatattcaggtcatcggcatgtgcagcagagataaaggctgtgcaaagagccgtggtgagcgccaggcgcttcatgatacgagcggaaaaaatggtattcatggtctgaactacgacatccgtgatggaattaaaaaaagtgccctactatagcaaatgcactaccggcaggcatctgactttccgcgtgactttgttaacgtcatttacagaaattgacacatcagatgcctgctttacgctactgcgcggtggtaataaatgactgtaattgggcttcggtttgcaaacgttgctgcaaggtactggcttcggctttgctggcgaatgggccaagctggatccgccagaccgcgccattttgagttacgcgaccggggacgccgaacttctgtcccagttgctgttggtactgttgcgcacgagcctgatcgctaacggccccgacttgcaccataaagttgccgctggcgctttgcgaggcggcttgcggtgtcaccattgcaggtgaggttgcaggcgttgtcgacggagctgtaacaacgggctgtggcgcaggcgtcggttcgctgccttccagtacaccaggcgctaaggtcgttggtgcgccgaggaaaccgctgctggttaccggcgcgccggtcggatcttcgctttttagcgtcgaattactgaccggaagaatgtcaccctgcgggacaggcactgaacttgttcccgcgccaccgcttaaatcgggaggtgctggcagggcgtaagtctgtttggcgactgtggtacaagccataccaggaccagaaagcgaaccatcctgggcgacaataatcggatcgatacgaactttggtgttgtttgacgtgttaagacggtcagctgccgcgcgagaaagcgaaatcacgcggtcgttgccataagggccgcgatcattaatgcgcaccacgatcattcgcccgttagccagattagtgattctggcgtagctggggattggaagcgttggatgggccgccgtcaactgtgtcggatcgaaagcttcgccagaggccgtcaggttactgccgggttcggcatcatagattgccgccagtcccgcctggctaaatcgagacggatcctgcacgattttgtagcttttaccgtcgcgctggtaatcctgatttgccgtcgcgttcagtggttcgaaacgcgggtctgccccgctaatttcaactatggggccgttacataccgcaggctgcggtacacttaccgtctgttgctgactatcatcgcttgtacatgccgcgagcattcctgccgcgatgcagatcccgagccactgcttacgcattgcgcacctcttacacgcttttcgacaacattttcctgtgggtgtggattgacattacaatcccgaacccagccatcagcacaattagcgccgatcctccataactgaccagtgggagcggaacccctacaaccggcagaataccgcttaccataccaatatttacgaagacataaacgaataatatcagcattaagccgccagccatgacgcgaccaaaggtggtttgcgctctggcggctatccacagcccgcgcatgatcagcagaatgtaaagagcgagcagaatcaaaatgcccactaatcccagctcttccgccagtaccgcgaagataaagtcggtatggcgttcggggagaaattcaagctgtgactgagtgccgtgcagccagcctttgccgcgtaatccgccggagccaatagcaattttagactgaataatgtgatagcctgcgccgagtgggtctgattccgggtccaggagcatcattacgcgctggcgctggtaatcatgcatcaggaagaaccacagaatcggaatgaacgccgctaccagcactactgcgacgccaatcagacgccagctaaggccagagaggaacagtacaaacaggccggaaagcgcaacgaggattgatgttcccaggtcaggctgtgcagccaccagcagcgtgggcataaatatcagtaccagcgcgatagctgtattcttcaatgaaggtgggcaaacgtcgcggttgataaagcgtgcaaccatcaacggtacggctatcttggcaatttccgacggttgaaaacgaacaataccgaggtccagccagcgttgagcgcctttagagatggcaccgaaagcatctaccgccaccagcaaaataatacagatgatatagagatagggggcccagccttcataaacgcgtggaggaatttgcgccatcaccaccatgatgaccagacccatcgcaatctggccgattttacgctccatcatgccaatatcctgaccgctggcgctccagataaccagggcgctgtaaaccagcaatgccagtaagatcagcagcattgtgggatcgagatggactttatcccagaatgtttttttattcggattatccgtcatgattaatggtcctccgctgcggcaaccgctggattttccgcaggcagatcggtgttgttatcacccagcataatgtggtcgaggatctggcgcatcagcgtaccaaccgccggacccgcgccaccgttctccagaatcatggcgacagccacttgcggattgttgtatggcgcaaaggcggtcatcagtttgtggtcacgtaaacgctcggcaattttgtgcgcattataggtttcgttcgctttcagaccgaagacctgagcggtaccggatttcgccgcaattttgtacggtgcgctggcaaaatatttatgcgccgtaccgttagggcggttagcaacaccgtacataccgtctttcgccagctcccagtaaccggaatgaatatcgccgacgggcggttcatgcggttgtacccatggcacctgtttgccgtcttcggcggtgctcatcagtaaatgcggaaccttcacgataccgtcattaatcaggatcatcagtgccttactcatctggattggggtcgctgtccagtaaccctgaccgataccaaccggaatggtgtcaccctgataccacggttttttaaagcgtttctgtttccattcgcgggtaggcatgttgccggaacgttcttccgccaggtcgataccggtgtaatgaccataaccgaatttccccatccattcggagaggcgatcgatccccatatcgtaggccacctgatagaagaaggtatccgcagattcttccagcgatcttgtgacattcagacgcccgtggccccattttttccagtcacgataacgtttttccgaccctggcagttgccaccagccggggtcaaacagcgtcgtannnnncattccattcattaattaattaatgaatgaatgnnnnnttgctggagataccgtcaacaaacaggtttgggtcataactaggcgtggaaaccagcgccaacaccccacctgtacgcggatcggtgactaccacagctgcgcggctacccgccagcagcgtttcaatatattgctggagtttgagatccagcgtcaggtaaatatcgtgtccggcttgcggtggtacttcttttaactggcggataacacgcccacggttgttaacttcaacctcttcataaccggtctgaccgtgcagcacgtcttcatagtaacgttcaatgcccagcttaccgatatcatgcgttgccgcatagttggccagtttgccgtcattattcaggcgttcgacgtctttatcgttgattttcgacacatagccgatgacgtgggtcaacgccgaaccgtaaggatagtaacgacgtttatagcctttaacttcaacacccggaaaacggtactggttgacggcaaagcgagctacttgtacttcggtcaggttagttttcaccggaatagaggtgaaacggtgtgaacgtgcgcgctcttttcggaatgccgcaatatcatcatcggtcagatcaaccacgctgcgcaaagcgtccagcgtttgctgcacgttatcgactttctccggcatcatttctatctggtagatagtgcggttgagagccagagggataccgttacggtcgtagataatgccgcggctgggtgcgataggcaccagcttaatgcggttttcattagagcgggtctggtagtcggtaaagcgaacaatttgcagattatacaggttggcgataagcacgccggtcagcagcaaaatccccaaaaaggcgaccagcgcccggcgcacaaacagcgcggactctgccgtatagtcgcgaaaagagttctgtagtttcatccgctgcgttttctactcaaagctcacttatcactcacggtgataaggatggttggtggtgatgctccacgcccggtacagactctctgcgaccagcacgcgaaccagcggatggggaagggtaagtgccgacagcgaccagctctgctccgccgccgctttacaggcaggcgacaacccttcaggcccgccaatcagtagactgacgtcgcgaccatccagcttccagcgttccagctcagcggctaactgcggcgtatcccagggcttgcctggaatatcgagggtgacaatgcggtttttgcctgcggccgccaacatctgctcaccctctttgtcgagtatgcgcttgatgtccgcattcttgccgcgttttccggccggaatttcaatcagctcgaagggcatatctttcggaaaacgacgcaggtactcggtaaaaccggtttgtacccagtccggcattttcgttcccacggcgacaagttgcagcttcacgcattaactccagagtttttccagttcatacaggcgacggctctcttcctgcatgacatggacaatcacatcgcccaaatccacgacaatccagtcggcgctgttttcaccttctacgccgagcggtaacaggcccgctgcgcgagactcctgcacaacgtgatcagcaatggacataacatggcggctggacgtacccgtacagatgatcatgcagtcggtgatgctggatttgccctgaacgtctaaggcgatgatgtcctgacctttgaggtcatcaattttgtcgataacaaaatcctggagtgctttaccctgcaagttttccccctgggtgaatcaaatagataaaaatggtctgtcagtatacctgaaccagaggcgatttcgggacaattgtcgccgaatcggctttcgaaagtgggctatcatcccaccccgcgccgcagattgcatcgccatttttgtaaaacaatttctacaaagtcgtgtctggcggaaaaagtctggctgcggagaatatcagcctgcccggggctgtcaatggtcgttgcggcttacccgtaaaaaaacagaaaagtcatgcattctcgaccccgatggcacggctattgaggacgcgtagcgtcgcgaatttttggttgatatcaatggcgctccaacacccctggtcaacgcggaaatgccacatagactcggcaggcatgccaattaaacgagcaattaacagactcagtacgccctgatggctgacgactaaaatattctgatagtgctgatattcactaagccttgcgataaatcgttccacacgttgcgaaaatgcctgaaatccttcaccgttcgtggggatagcatgctgccagtcattgcaccacgcgctatagttttcggcatcttcttgcatgaggtcacgatgatgtcgcatctcccagtcgccaaaaaacatttcattgagttcagggatgatatgaacggggtgctggcggtcactaagaaccagtcgcgcggtatgctgtgcccgttccagttcactgcataaaaccaggtcaaaggaaacatcatgtagcagcgtatgcagattttgcgcttgctcaataccgcgcgcggtcaggggtgtgggcgcatgaccgctgtacagaccatcgacattcgcttgcgtttcaccatgacgaattaaccacagtcgcatcatgccctccgtaacgacaggtatcagcgatacaagccttgttggttaatgtaagtcagtaccggttccggtaataaatcctcacacgattcaccattttgcaaacgttcgcggatgatggtcgccgagatgttaaaccacggcgtttcagccagataaattttaccggcaggctgaaggtgaagatcttccgggttatgtgtcaaatgatcctccagccattgctgatattgtggttgtgccatttcaagtgggtaaccaggacgccgacagacgatcaaatgtgcattgtcgagtatcgtttcgtattcgtaccaggtcggaaaggtcagcaatgaatcctgaccaataataaacgccagcggcacgtccggtccttgctcctgccgccactctttcagtgtttgcgcagtgtaagagggggcattgcgctttagctcgcgttcatcaagagtaaataatggcttgtcggcaatcgccagttcaagcatgtgtttacgctgcatgctgtttgcttccggctggggacgatgcggaggaacattattagggatgattgtgacccgcgtcagaccaatcaaattcgccagcgtttccacgggtttaagatgaccatagtgcaccggatcaaaggtgccgccaaacagagcctgtaaagatttcatatcaaccgtcgataaatacgtccgccaggggtttatggcacaacagaagagataacccttcaagctctgcccacactgactgaccgtaatcttgtttgagggtgagttccgttcgtgtcaggagttgcacggcctgacgtaactgcgactggcttaagcgatttaacgcctcgctcatcatgcccctgcggttctgccatacccgatgcttatcaaacaacgcacgcagtggcgtatgggcagactggcgtttcaggttaaccagtaacaacagttcacgttgtaatgtgcgcaacaaaataaccggttcgctgccttccagacgcagttgctgaagaatatgcaacgcgcgcttactttttcccatcaacaaagcatcaacccaatgaaaaggggtgaaatgcgcggcatcattcaccgcctgttcaacgcgcggtaatgtcagtttgccgtccggccagagtagcgataaacgctccagtgcctgggccagcgccagcaggttaccttcataacagtagcagagcacctgatttgcagcgtcatccagttctaagttgagctgttttgcgcgcgcagcaacccagcggggcagctgagcctgctccggtgtctgacaggtcacctgcacgctgcgattcgcaagagcagtaaaccaggcggcattttcttgcgctttgcttaatttattaccgcggacgatcaacagcaggtcgtcatgcagaagtccggtgagtgtgagaagttgttcattgatcgccgcattcggtccgttttcgggtaacaacagcaatagcgtttgtcgactggcaaacaggctcatggcctggcataacgaaaaaatcgcattccagtcggtgttgggatcaatggaaaaagtgtggtgttcttcgaacccttgcgccgcagcgacctgacgaacagcgtcctggctttcctgcaataacagaggatcgttaccaagtaaaagatacgccgcgcgcagcccttcattgagctgcgcgcggagttgttccgggtacaaccgaatcatcagttacccagcgtggtggagacgcgtgcaggcgttgccggagtatccgttgtggtcgacgtctgttcttcgtcggaacgaatatccgcagcacggatgcttggcagcttacgaatcagctgttcggcagcacggtcgtacatctcttttacgatcatgtcttgttcgttatctttcgctaacgccatttgcgggttatcgaagaacgaacggaagactttggcgctaatcgggtagatatcacggccggggatcaacacggtcgcattcaccgtcatgatcatctgatactctgctgtttgaccgttacggaataccgatgcggtatctttcgcgatgctcactttacccaaacgcagggatggaacgtccttacgcgtggtttctttatcaagcaactcgacaccattcagacgtaactgattacgcaccgcacggcttaatggcccgttcggatcgcctgagtccaggatcatgactttcatagtggaaggaacctgcgtggtgtcacgcagatgccagccacacccggcggtgattaacaccgccagagataacaacaatgttgccagatatcgcacgcttcctcccgcgcttagccaacgaccagattgaggagtttacctggtacgtaaatcactttacgtacagtaacgccatcaagatattttgctaccagatgttcctggccagcacgttcgcgaacctgttcttccgttgcgtccaccggaacggtgatttttgcacggactttaccgttaacctgcaccacgaccagcgtggagtcttccaccatcgctttttcgtcagcaaccggccacggcgcgttgtcgatatcgccttcgcctttcagttcctgccacagcgtgaagcagatgtgcggggtgaacgggttaagcatacggactaccgccagcagcgcttcctgcatcagggcgcgatcctgctcgccatcggtcggtgctttcgccagtttgttcatcagctccataatcgccgcaattgcggtgttgaaggtctgacgacggccgatatcatcggttactttagcgatagttttatgcacatcgcgacgcagcgctttctgatcttcagtcagcgcatcgacgttcagtgccgcaacatcaccttttgctgtatgctcgtacaccagtttccagacacgtttcaggaagcggttagccccttccacgccggactcctgccattcgagagtcatatcagccggagaagcaaacatcataaacagacgaacggtgtccgcgccgtaacgttcaaccatcacctgcgggtcgataccgttgttcttcgacttggacattttgctcatgccggtataaaccagttcatggcctgccgcatctttcgctttcacgatacggcctttctcgtcacgttcaacgatagcatcaaccggggaaacccagttacgttcgccgttttcaccaacatagtagaaggcatctgccagcaccataccctgacacagcaactgtttcgctggttcgtcagagttcaccatgcctgcatcacgcatcagtttgtggaagaagcggaagtagagcaggtgcataatggcgtgttcgataccaccaatgtaaatatccaccggcagccagtagttagccgctttggaatccagcataccttctttgtactccgggcaagtgtagcgcgcatagtaccaggaggactccataaaggtgtcgaaagtgtcggtttcacgcagtgctggcataccgttaacggtagtttttgcccattccggatctgctttaatcgggctggtaatgccgtccatcaccacatcttccggcaggatcaccggcagctggtcgtccggggtcggcattacggtaccgtcttccagcgtcaccatcggaatcggcgcgccccagtaacgctgacgagaaacaccccagtcgcgcaggcggtagttcactttacgctcgccaacgcccatttcagtcagtttgtcggcaatggcgttgaaggccgcttcatggtcaagaccattaaactcgccagagttgaacagcacgcctttttcagtcagggcttgctgagaaagatctggctcagagccgtcagctgccaggataaccggtttgatgttcaggccgtatttagaggcaaactcgtagtcgcgctggtcgtgacccggaaccgccataactgcgcccgtgccgtattccatcaatacgaagtttgctgcccaaacgggaatttcttcgcccgttaatgggtgaaccgctttaaagccagtatcgacgccttttttctccatcgtcgccatttcagcttcggcaactttggtgttacggcattcgtcaataaaggcggccagttcaggattattttccgccgctttctgtgccagcggatgacccgcagccaccgccaggtaggtacaacccataaaggtgtccgggcgggtagtgtaaacggtcagcgtgttgtcatagtccttaacgttgaaggtgatttccacgccttcggaacgaccgatccagttacgctgcattgttttaacggtgtctggccagtgatccagtttatccagatcgttgagcagctcgtcagcgtaagcagtgattttgataaaccactgcgggatctctttacgctcaactttggtatcgcagcgccagcagcagccgtcgataacttgttcgttcgccagtacggtctggtcgttcgggcaccagttgaccgcagaagtcttcttatataccaggccttttttatacagttcggtgaagaatttctgttcccaacggtagtattccggcgtacaggtcgccagctcgcggctccagtcataaccaaagcccagcattttgagctggtttttcatatacgcgatgttgtcgtacgtccacggtgctggcgcggtgttgtttttcaccgccgcgccttccgcaggcagaccaaatgcgtcccagccgattggctgcaggacgtttttgcccagcatacgctggtagcgggcgatcacgtcaccgatggtgtagttgcgaacgtggcccatgtgtagtcgaccagaaggatagggaagcatagacaggcagtaatacttctctttgctctcgtcttcggttacttcaaatgtgcgcttctcatcccagtgaagctgtactttggattctatctcttccgggcggtattgctcttgcatggcagccagtggtcctgttttcaatacggctacaaatgtagcgttgatgtggtttttcagatccgcatagcatagcccaaacgcccgcgtcaaaacagcctttcgcgcactcgacgttgaaatgatgcccggattattcatacattaatttacagagtttgtgggcgtattagcaaagcaaggaacaaagaacgtctattattatagtcagttaacgacccgggagatgaaacgatgaacaaggttgctcaatattaccgtgaactggtcgcgtcattgagcgaacgcctgcgcaatggcgaacgtgatatcgacgcactggtggaacaggcgcgcgagcgcgtaataaaaacaggggagttaacgcgaaccgaggtcgatgagctgacgcgagctgtcagacgtgacctggaagagttcgccatgagctatgaagagagcctgaaagaagagtctgacagcgtctttatgcgggtgattaaagaaagcttgtggcaggagctggcagacatcaccgataaaacgcagcttgaatggcgcgaagttttccaggacctcaatcatcacggggtttatcacagcggagaagtggtagggctgggaaatctggtctgcgagaaatgtcacttccatctcccgatctatacaccggaagtgctgacgctatgcccgaaatgtggtcatgatcagttccagagacgcccgttcgagccgtaatgaaatgagtggcgccggatggcgtgatgtcatccggcgagtgattaagcgtaaaatttcagacgatcagccagtaaatcaacaaagccctgacgatcaacatcgaccattacggtggcattcggtttattgccagtcagataataataatcaacaaccgtcataccctgggtatatttcccttgtgtttccacgccaacccagcgctcaacagtggtaaacaactccggtttcaacagccaggcgatggtgcatgggtcatgcagtggtgcgccgacaaagccccatttttcgtctttatgatattcgaggaagaaatccagcagttcggcaacaatggttgaaacagggttgccaatcgcgcggaaacgctcagtgtcttcaacgtggatttgtgctttgtgagtaacatccagaccggccatcaccaccggaattcctgactggaagacaatttctgccgcttccgggtcaacgtaaatattaaattcagccgcaggcgtccagttaccaagccccattgcgccgcccataatcacgatacgggcaattttgctatgcagttccgggtggctattgagcagcaaggcaacgttagtttgcggtccggtagaaacaatggtgacaggttcctcactttcacgcagcgttttcgccatcagctccaccgccgtacagttttgcggtgcgaacgtcggttccggtaatgccgggccgtcgagaccgctttcgccgtgcacgttgtccgcaataatcaaattacgcattaacggttttaccgcaccgcttgctaccggaatatcggtgcgattaagcaaggtcagcatacgcagaacattgcgtaaggttttttctggtgtctggtttccggcggaagacgtaattgctttgacatcaagctctggtgaggcgagggcgagaacgattgcgatagcgtcgtcatgacctgggtcgcaatctaacagaattggcagtgccattgttgctccttgttgtgtgtttctttgcgacaagggtaacgccgggatgtaacagatacgagggacgaaacgagaaagcgtgagatggcgcgcaattgagtatgcgcgccagagtgattaatgcaggatttttgcgaggaagtcttttgcgcggtccgatttcggatcatcgaagaaagcgtctttcggcgagtcttcgacaattttaccctcgtccataaagatcacccgattcgccactttacgggcaaagcccatttcgtgggtcaccaccatcatcgtcattccttcgttcgccagttcgaccatcacgtccagcacttcgttgatcatctccggatccagcgccgacgttggttcgtcgaacagcatggcaataggatccatgcacaatgcgcgagcgatcgccacacgctgctgctggccgccggaaagctgcgccggaaacttattggcatgtgcggaaagcccgacgcgctccagcaatttcaatgctttttcacgagccggcgctttattgcgtttaagcactttcacctgcgccagggtcaggttttcgataatcgacagatgggggaacagctcgaaatgctgaaacaccatcccgacgcgggaacgcagtttcgccagatcggttttcttgtcgttaaccacgatgccatcgacggtgatttcaccttgctgcaccggttcgaggccgttgacggttttaatcagcgttgatttgcctgaaccagacgggccgcaaaccaccaccacttcgccttttttcacttcggttgagcagtcggtcagcacctgaaagtgaccataccattttgaaacatttttcagggtaatcattatgctgtccttcttttcaagtagctgaccaacaacgacgcgctaaggctaataacgaaataaacaaatccggcaaacaggatcatctcaacctgcgtaccatcacgctcaccaatggttgaggcggtacggaagaaatcggccagagataacacatacaccagtgaggtatcctgaaacagtacgatgccctgagtgagcaacagcggcaccatcgcgcggaacgcctgcggcagaataatcagtttcatcgactgccagtgagtcattcccaacgccagcgcggcgctcgactgaccacgagaaatactttgaataccagcacggataatctctgaatagtaggccgcttcaaacatcgaaaacgccaccatcgccgaaattaaacggatatcatttttgggtgataatcccagcacgttttgcagaaaacccggtacgatcaggtaaaaccacagcaaaaccataactaaaggaatcgagcggaatacgttaacgtaggctttggcaaaccacgctacgggcgcaaagctggacaagcgcatcaccgccagcatggtgccccacaaaataccaatcaccactgccgtgacggtgattttcagcgtgatcaccagcccgtcgagcagatatggcagggaaggaacaatggaactccagtcaaactcgtacattatttgccccccatgttgccgggcaggcgaactttacgttcaaccagcgtcatcaccagcatgataaaagcgttaatcaatacatacgccagcgtaatggcggtaaacgactcccaggcgtgggccgagtaatcgagcaatttacccgcctgcgccgccatatccaccagaccgatagtcgaggcgatggcggagtttttcaccaggttcatcatctctgaggtcatcggcgggacgataacgcgataagcattaggcagcagtacgtagcggtaggcctgcggtagcgtcagacccatcgccagcgcggcatttttttgcccacgcggcagcgactgaatagctgcgcgtacctgttcgcaaacacgggcggcggtaaacagccccaggcagagcatggatgaaaggaaaaactgaatattgggatccagctctgccttaaaccacatgccgattttctctggcagcagctccgggatcaccaggtaccaggtaaagaattgcacaatcaacggcacgttgcggaacagttcgacatacaacgtacccagaccggagagaaaacggtttggaacggtacgtaaaatgccgaaaaatgaaccgacgaggaaagcgataatccaggcgcagatcgacaaagcgatcgtcacctgaaaaccactccagatccaaccaagataggtggtgttgccgaacggggcttgttgtaaaaaaataccccagttccagtctatagacataaatctactccagaaaaaagagggtagcagcgttaactgctaccctcgaagattgttacccagcgtattgcggttttcaggcccgatggggaacgaccaccaggcgtatagtctgtccgtgctacgtaacaatcgagagggctggaatttccgcccctggttcttgtaattagttcagtgccttgtcattcggttctttgaacagtgctttcatttcgtctgacagttcgaaattcatgttcaggtttttcggcggaattgggtttttgaaccatttatcaaaccatttttccgcttcaccggaggtctgcacctgagcgatagtgtcatccatcagctttttgaactgcggatcgtctttacgcaacatgcaaccgtaggcttcctgagactgcggcttgccgacgatttcccagttgtctggtttcttcgctttcgcacgttcaccggccagcagggcatcatccatcataaaggcaacggcacgaccgctttccagggtgcggaaagagtcaccgtgatctttggcgctgatgatgcgcatattcattttttgctcttcattcagtttgttgagcaaaacttcagaggtagtgccggaagtgacgactacggctttgcctttcaggtcggcaaaatctttgatatcgccgccctttttggtcagcaggcgcgtaccgaccacgaaaatagtgtcagagaaagccgcctgtttttggcgttcggcattgttggtggtagaaccgcattcaaaatcgaaagtgccgttttgcagcagtggaatacggttttgtgaggtgatcggaatcaatttcacctgtaagtctggtttgttgagtttctttttcactgcttcaacaatggcgttggagtaatcctgcgagtagcccaccactttttgctgattgtcgtaataagagaaaggtactgaagattcacggtgaccgacgacaatcacgccgtttttggcgattttgtccagcgtgctgcctgctgccggggcggcgtcatctgcctgtgccagtcctgcggaaagcgccagggccaggattgctgtggcaggtttacgtaattgcatatccaactcctttatcttctgcgttaaaaacgcatggatacccgttgtgagtgtttgtgttgttatcatctgcgactttattgtgcagtgttgtgtttgttaggtaacatttagtttggataaatgtaaagatattgctgttttattgtttatttttgcgaggtgcgccgcaccattccgaagcaaaattcttaaaccgcacctttttggtgctaccgctgatttgtggtggtgcaacccggttgcgttgcggctgatttcattgcttacacagtaaataaagcaacttacatgccaaaaaatacttaggggtgaattaattacgattgtaatttcagtttgaaaaagtcatatttcggacagtgttaacttttcggtgtgggacgtttgccgggatgataactacactcgggaaaatgctttttactagtcttttcaaggaagaatcaccttatgtctgcatcttcggttaagccgttaaatgttcaattacccgcaataaccctgatcctttttgcgctctgtgttgggatattttgttacctcgcacaatggatgagttacgaagaagtcgatcaatccgcactcatccatctcggcgctaacgttgcttctctcacgttgtcggatgaatcctggcgcttattgagcagtgtttttctgcacagtagtttttcccatttgctgatgaatatgtttgcactcctggtggtggggacagtggcggaacggatactggggaaatggcgactcctgattatctggttattctccggcatctttggtgggctgatcagcgcctgttatacgttacgcgaaagtgagcagatagtcatcagcattggggcatccggggcaattatgggaatagcgggcgctgcgatagcaacacagcttgcttcaggtgcgggcacacaccataaaaaccagcggcgagtatttcctctgttgggtatggtggcgctgacactgttgtatggtacccggcaaacaggaatagataacgcttgccacattggcggcctgattgcggggggcgcgttgggttggctgagtgcgcgtttagttgggcaaaatcggctcgttacggaaggcgggattattgttgcggtcactcttcttctgaccgggactatctggtttgtgcagcagcagattgatgaatcagttttacaggtcgggcaaagcctgcgtgaagcgttttatccgcaggagattgaacaagagcgacgacaaaaaaagcagcagttagtggaggagcgcaacgccctcagggaaacattatccgctccggtaagtcgtgagcaggccagtggtgatttactcgctgagattgccgatatccatgatatggcgatcagtcgggatggtaatacgttgtatgccgcaattgaaaacacgaacagtattgttgttttcgacctcggacaaaagaaaatcctgcatacctttacagcgcccatagcgaaagaaaagtcagtcaaacattgtggtggctgtaaagatcagggcgtcagatcgctggcattaagcctggatgaaaagttgatttatgcgacttcatttgaagcgaatgcgttatcggtcattaacgtggcgacgggggagattattcagtcgattaccaccggcgcacatcctgacagctttatcctctcgcgtgatggcacaaaagcctgggtgatgaatcgcaccagtaatagtgtgtcagcgattgatctggtggcttatcagcatgtggcggatatcccgctggagaaatacgacgggacggggatgagcggtaaaccaggcgcctgggttatggcactttccccggatgaaaaaacattactggttccgggagcaggcagaggtaacatcgtgcggatcaataccatcacgcatcagaaagaagactttcccgcaggtaatgcgcgtggtgtcgtttctgcgatgggattccgaccaaaaaatggtgagattatttttgccgatagccaggggatttcacgtataagagctgaggatcaacaagccagcattatgacgcaatggtgtagcaggagcgtttattccgttgagggtattagcccggacggtcagtatttagcgttggtgtcatatggcctgcaaggttatgtcatcctgctcaatattaatgccgggcagattattggcgtttatcccgccagctacgtgaatcatcttcgtttttcagcggatgatagaaagatatttgttatggcgaagaacaggttaatccaaatggacaggacgcgctcgcttgatccgcaggcaattattcggcatccccaatatggcgatgtggcttgtatccctgaaccgtaagaaaaaagggcatgataatcatgccccagagcgtgttgaaaaagtacgctttatcctacaaaatcgcgaaaattcaacatattgtaaaaatcgcgtaggcctgataagcgtcgcgcatcattcacatcaacgtttacgtcgctgacgcagactcatcagtacagcggcaaaaccaaacagcgccgtcagcacccacagcggccagttgccggttcgtgcgtacggtgtgagtccggtggttggtgtcacgttagtggtcaacacctcgcgggtgaactgcgggatcatcgcctgaatctcaccctgcgggccaatcaccgccgtaatgccgttgttggtgctgcgcaacagtgggcgcgccagctccagcgcacgcattcgcgccatctggaagtgctgccatggaccaatagacttaccaaaccacgcatcgttggagatagtcagcagatagtcggtatccgggcggaagttatcgcgcacttgctcgccgagaatgatctcgtagcaaatagccgcagtaagctcaataccatttaccgacagcggtggttggatatatggcccacggctgaacgacgacatcggcagatcaaagaacggtgctaacggacgcagaatcgactccagcgggacaaactcgccaaacggcaccagatggtttttgttatagcgatcggctgattcgtagctgtacggcgcacctttacccagcgtgatgatggtgttgtaggtatcgtagcggttctgcttattgagacgtgcgtcaacaatcccggttaccagcgagctacctttatcgcgcaactcaccgtccagtgctttgaggaacggttgctgattaatttccagatcggttatcgccgactccggccagataatcaacgatgatttgcccatcagcggtgccgttgcgttgtagtaaatcttcagcgtattaagaagctggccttcgtcccatttcagcgattgcggaatatcgccctgaaccatcgaaacctgaatggttttctccggttgcggggtaaaccactggatgtaacgcagcgggaagggaagggcaaacagcacgacggccaccaccagcggacgccagttgcgtttgaccaacgccagtgccagcaggccgctaaccatcatcagcaggaagttaatggcttccacgcccattatcggtgccagcccttttaacgggccatcaatctggctatagccgaactgtaaccacgggaagccagtcagcacccaaccgcgcagaaactcggtcatttgccagagagcaggggcggcaatcgccacgcgcagccaggtggtttttgaccacaaccgcgacagcacgccagcaaacagtccggtatacagcgacaaatacgccgccagcagcaccaccaggaagacgttaaccgggccaggcattccaccaaaggtcgcgatgctgacatagacccagttaataccgctgccaaagagaccaaatccccagcaaaagccaatagcggcagactggagtggacgacggttaaaggtcaacgcctgaagccccatcagcgaaataatcgccgcaggccagacgtcgtaaggagagaaggccagcgttccgcaggcaccgaataataacgccagcagcaggcgaatgcgctggcgttcaattaatgaggcaaaagccatgtagttatctatccagtttcggttttattcatccagcttcggctggggtgagtcatccgggattttgacatgaacctgaataatacgccgactgtcggccatcgccactttgaactggtaaccgtcgatgtcgatggtttcgccacgcgccggaagatgcccaaatgcctgcatcaccagaccaccgatagtgtcaacctcttcatcgctaaagtgggtgccgaacgcttcgttgaagtcttcaatagaagccagtgcgcgcacggtccaggtatgacgactcagctgacggaagtcgatatcatcttcttcgtcatactcgtcttcaatctcaccaacaatcagttccaggatgtcttcaatggtcaccagaccggaaaccccaccgaattcgtcaatgacgatcgccatgtggtaacgctgagagcgaaactctttcagcatccggtctacgcgcttactttcaggaacgacaaccgcctgacgtaacactttgtccatgctgaaggcttcagcatcgctgcgcataaacggcagcaagtctttcgccatcagaatcccttcaatgtgatctttgtcttcgctaatcaccgggaaacgtgagtgggcggactcgatgatgacatcaaggcattcgtccagcgtctggttgcgtttcagggtaatcatctgggagcgggggatcatgatgtcgcggacgcgttggtctgcgatgtccatcaccccttcgagcatatcgcgcgtatcttcgtcgataaggtcgttctgcccggaatcacggatcagcgccagcagttcgtcacggttttttggttcaccgtggaaaagttggctgagtaacagggagaaaaatcccttcttgttgcttatcgtgtcactactgtgtgaattgtcgtcgctcatggcgtcgtatgggttctcatgttagttaatcaaaacgccgtcgttaatcaccaacggcggggacgtctgccagtcaaatgcctggcaaattattctttctcggcaatgtacggatcctcatagcccagagcaagcataatctctgtttcgagggcttccatttcttctgcttcgtcgtcttcgatgtgatcgtaacctaacaaatgcagactgccgtgcaccaccatatgcgcccagtgcgcctccagtggtttgccttgctcctgagcttccttctcaaccacctgacggcagataaccagatcgcccagtagcgacatttccatgccaggcggtacttcaaacgggaaggagagcacgttggtcggcttatccttaccgcgataggtcagattcagactgtggctttcggcggtatcgaccacgcgaatcgtcacttccgattcttcctgaaactgcgggatcaccgcattcagccatgtctgaaactggctctcttccggtaacccggaattatcttcacatgccagttgtaaatcgaggatcacctgactcatttttgttcctgttcttcgcgcttgcgttctgctgccagcgccgctttacgtttttgttcggcttcttcccaggcttcataggcgttaacgatacgcgccaccaccgggtgacgaaccacgtcttcgctgtggaagaagttaaagctgatctcttcgacatcagccagcacttcgatggcatgacgcaaaccagacttggtattacgcggcaggtcgatctgtgtgacgtcgccggtgataaccgcttttgagttaaaaccgatacgggtcaggaacatcttcatctgttcgatggtggtgttctggctctcatcaagaatgataaacgcgtcgttcagcgtacgaccacgcatataggccagcggtgcgacttcaataacgttgcgctcaatcagtttctcgactttctcaaagcccagcatttcaaacagcgcgtcgtacagcgggcgcagatacgggtctactttctggcttaaatcgccaggcaggaagcccagtttctcaccggcttcgaccgccggacgagtcagcagaatacggcgaatttcctgacgctccagggcatcaactgccgcagccactgccaggtaggttttacccgtacccgccgggccaacgccgaaggtaatgtcatggtcgagaatattggcgatgtactgcgcctggtttggcgtgcgcggcttaattacgccgcgtttggttttgatattgactgctttgccgtactccggcacgctctccgcgctttgctccagtacccgcgcttctttaatcgcaaggtggatctgttccggttcgatatcctgaatctgaccgcgcatcggggcagtatcgacatacaggctacgcagaatgtctgccgctgcggtgacgcaaatcggacggccggtcagtttaaagtggttatcgcggcgattgatctcgatgccgagacggcgttcgagttgtttgatgttgtcatcaaacgggccgcacaggctcaacagacgcgcattgtctgctggctccagggtgatttcgcgagtgtctatgttcaaaccgttcctcttatctgtatgccgccggaagctgaacattcaccggcctataaggaaattattcacgccacaggaaaaaggcgcaagcattgcgataaagatggggataaagagagaaaaaacaaggcccaccggaacggcgggcctgagaattacggctgataataacccacgccaaggtcgttttctttgcgggtacgggcaatcaccgattccggtgtttctgccacgcgcagacccatttcatcttcagttcgcaccactttaccgcgcagagagttcgggtagacgtcggtaatttctacatcgacgaatttaccgatcatatccggtgtgccctcgaagttgaccacgcggttattttcagtgcgaccggaaagctccatgatgctcttacgtgaagtcccttctaccagaatgcgctgggtggtgccgagcatccggcggctccatgccatcgcttgctgattaatgcgctcttgcagaatatacagacgctgcttcttctcttcttccggaacatcatcaaccatatcggcggctggtgtacccggacgtgcagagaagataaagctgtagctcatgtcgaaattgacgtcggcaatcagcttcatcgttttctcgaagtcgtcggtggtttcgccagggaagccaacgatgaagtcagaactgatctgaatatccggacgcgccgcacgcagtttacggatgatcgctttgtactccagcgccgtgtgagtacggcccatcaggttcagaatgcgatcggaaccgctctgtaccggcaggtgcaggaagctcaccagctccggcgtgtcgcgatacacttcgatgatatcgtcggtgaattcgatcggatggctggtggtaaagcgaatacgatcgatcccgtcgatcgccgcaaccagacgcagcagatcggcaaacgatccggtggtgccgtcgtagttctcaccgcgccaggcgttcacgttctggccgagcaggttaacttcacgcacgccctgagccgcaagctgggcgatctcaaacagaatatcgtcggacggacggcttacctcttcaccacgggtgtatggcactacgcagtaggtgcaatatttattgcagccttccatgatggagacaaacgcggtcggcccttcggcacgcggttccggcagacggtcaaacttctcgatttccgggaagctgatatctacaaccgggctgcggtcgccgcgcacggagttgatcatctccggcaggcggtgcagcgtttgcggcccaaaaataatatcgacatagtgggcgcgctggcgaatgtgctcgccttcttgcgatgccacgcagccgccgacgccgataatcaggtctggattcttctcttttaacagtttccagcgacccaactgatggaagactttttcctgagccttctcgcggattgagcaggtgttcagcagcagcacatccgcttcttccgccacgtcggtcagttgatagccgtgggtggcatccagcagatcggccatcttcgatgaatcgtactcgttcatctgacagccccaggttttaatatggagttttttggtcatcgacttgctcttgcgaaatagtagccaggaatgcagggcgcatagtgtaatgctttgctgccgttgtgaccagtatgagcgttatcagcccttgggggtaaaaatcctgtaaacttaaagcatattgctaacaggatgattgaccatgacaaatcaaccaacggaaattgccattgtcggcggaggaatggtcggcggcgcactggcgctggggctggcacagcacggatttgcggtaacggtgatcgagcacgcagaacctgcgccgtttgtcgctgacagccaaccggacgtgcggatctcggcgatcagcgcggcttcggtatcattgcttaaagggttaggggtctgggatgcagtacaggctatgcgttgccatccttaccgcagactggaaacgtgggagtgggaaacggcgcatgtcgtgtttgacgccgctgaacttaagctaccgttgcttggctacatggtggaaaacactgtcctgcaacaggcgttgtggcaggcgctggaagcgcatccgaaagtaacgttacgtgtgccaggctcgctgattgcactgcatcgccataatgatcttcaggagctggaactgaagggcggtgaaacgatcctcgcgaagctggtgattggtgccgacggcgcaaattcgcaggtgcgacagatggcgggaattggcgttcatgcctggcagtatgcgcagtcgtgtatgttaattagcgtacagtgtgagaacgatcccggcgacagcacctggcagcaatttaccccggacggaccgcgtgcgtttctgccgttgtttgataactgggcatcgctggtgtggtatgactctccggcgcgcattcgccagttgcagaatatgaatatggcgcagctacaggcggaaatcgcgaagcatttcccgtcgcgtctgggttacgtaacaccgcttgccgctggtgcgtttccgctgatacgtcgccatgcgttgcagtatgtgcaaccagggcttgctctggtgggcgatgccgcgcataccatccatccgctggcggggcagggagtgaatcttggttatcgtgatgtcgatgccctgattgacgttctggtgaacgcccgcagctacggcgaagcgtgggccagttatcctgtgctcaagcgttaccagatgcggcgtatggcggataacttcatgatgcaaagtggtatggatctgttttatgccggattcagcaataatctgccaccgctgcgttttgtgcgtaatcttggtttgatggcggcggagcgtgctggcgtgttgaaacgtaaggcgctgaaatatgcgttagggttgtagcctcacaacattgctggatgcatgccaaccgtaggtcggataagacgcggcagcgtcgcatccgactttgtaaggataagacgagtcaacatcgtattcggcattgaatatacgcagaaaagcaaaaagctcgccgaagcgagcttttttaatgtggctggggtacgaggattcgaacctcggaatgccggaatcagaatccggtgccttaccgcttggcgataccccaactgggtgcacttacaaggtaagcgtcttgaataaattggctggggtacgaggattcgaacctcggaatgccggaatcagaatccggtgccttaccgcttggcgataccccaacaaattggtttttgaatttgccgaacatattcgacacattcagaatttggtggctacgacgggattcgaacctgtgaccccatcattatgagtgatgtgctctaaccaactgagctacgtagccagattgtttcttcgatggctggggtacctggattcgaaccagggaatgccggtatcaaaaaccggtgccttaccgcttggcgataccccaataaccgggcggtgaaccgcttactcgaagaatatggctggggtacctggattcgaaccagggaatgccggtatcaaaaaccggtgccttaccgcttggcgataccccatccgtacaacgctttctggtgaatggtgcgggaggcgagacttgaactcgcacaccttgcggcgccagaacctaaatctggtgcgtctaccaatttcgccactcccgcaaaaaaaagatggtggctacgacgggattcgaacctgtgaccccatcattatgagtgatgtgctctaaccaactgagctacgtagccatcttttttttcgcgatannnnncattccattcattaattaattaatgaatgaatgnnnnnggaattcaacaatagtggtgggaaattaatctatgaaatactggcctacagtaatgagttgtcaaacatcgatgtggcaaacccggaacatttccttactgcatatcagaatcaacaagcgccccagtaactgaaattgccccggatttctccggggcaatattacacgtcttatttatatgccgactggtgaacgccaaccgcgcgaccagacggatcgtccattttcttgaacgcttcatcccactcaatcgctttagcggaagaacaagcgacggaaggaccgcccggcacgcactcagcggcgctcggaagcgggaacaattcttcaaagatctcccggtacagatacgcttcttttgaggtcggcgtgttgtacgggaagcggaagcgggcagtttccagctgttgatcagaaacctgctgcgctgccacttctttcagggtgtcgatccaactgtaaccgacgccatcggagaactgctctttttgccgccaggccacgcttgcaggcagatacgcttcaaaacattcacgcaggatgtgtttttccattttgccgttaccgcacattttatcctgtgggttaatgcgcatcgccacatcaaggaattttttgtcgaggaacggaacgcgtgcttccacgccccaggctgacatcgctttgttggcacgcgcgcagtcatacatatgcagggccagcagtttacgcaccgtctcttcatgcaactctttagcgttcggcgctttgtggaagtatagataaccgccaaacacttcgtcagaaccttcaccggacagcaccattttaatgcccatcgccttgatcttacgcgacattaaatacatcggtgttgaagcgcggattgtcgtcacgtcataggtttcgatgtggtaaatcacgtcgcggatggcatccagaccttcctgtacagtgaagtgaatttcgtgatgcaccgtgccaagatggtttgccacttcctgggctgctttcagatccggtgagcccggcagacctacagcaaaggagtgcaactgcggccaccaggcttcagagcgttcctgatcttccacgcgacgggcggcgtatttcttggtgatagcggaaataattgaggaatccagaccaccagaaagcagcacaccgtaaggcacatcagacatcagatggcttttaacggaatcttccagtgcctgacgcagctcgtttttgtcggtcacgttatctttcaccgcatcgtagtcgaaccagtcgcgatgataataagaacggatttcgccgtcctgactccacaaatagctccccgccggaaactctttaatcgtgcggcaaactggcacgagggctttcatttctgaggccacatacagctgaccgtgttcgtcatagcccatatacagtgggatgatccccagatggtcgcgaccaatcagatatgcatctttttcgctgtcgtacagggcaaaggcaaacatgccctgcaagtcgtcgagaaattccggccctttttcctgatacagcgcgaggatcacttcacagtcagacccggtctggaactggtaacgatcgccatattcagcgcgcaatgcctggtggttgtagatttcaccgtttactgccagcacatgagttttttgttggttgtagagaggttgcgcccccgcgttaacgtcaacaattgacagacgttcgtgggcgagaatggcgttatcgctggcataaataccggaccagtccgggccacgatgacgcatcaggcgtgacagctcgagtgctttcttacgcagctcaactgcgtctgttttgatatcgaatacgccaaaaattgaacacataaccttctccgttaacctggtgtttactgcgtgttgtgtttgcttgttaaaaaaatgccgcaaagcagcacggtgcgcaagcgatttggcggtggaaaaataaaaaacgtaatggcgattgctgattgatgaaaaaggggagggcttttgggtatatttattgatggatcgataatttttgacgggttttattgaatggggtgattttaatgatgggtaaaaataagaaaccacgccctgaggcgtggttgctattcagataacgtcgatttcagcgaccgatgggtaaatccaacttgggcggaacggcatactgtcgatatcgtcgagtgacgaaacaccagaaagcaccagaatcgtctccagaccggcctggaagcccgccagaatatcggtacgcaagttatcgccgacaatcaccgtttcttccgaatgcgcctgcattttgtttaatgccgcgcggatgatccacggactcggctttccaacatagaacggtttgcgcccggagattttctcgatccctgcacacaacgcgccacaggcgggataaaaaccgcgcccgtgggtgtccgggttggtggcgataaagcgtgcaccgttagcgacgaaataggctgctttatgcatcatgtcccagttgtaggaacgcgtttcgccaacaatcacaaaatcagggttcacatcggtaatagtgaaaccggctttgtacagttcatgaatcagtgcgccttcgcccaccacatacgctttcttgccttcctggcgacgcaggaaatcggcggtcgccatcgcggaggtataaaacacgctatccggtacatcgacaccggcagtggcaaagcgattcgccagatcttgcccggtctgtgaaggatagttggtcagcaacaccagcggcaggcctttatccataatcccgtgcaaaaattccgctgcaccgggtacggcgacgttatcgtgcatcagcacgccgtcgatatcgcaaattacatttttaatggtcatggactacccagaatattgacaacaataagcgccactataaaagcacattaattttccagcaaatgctggagcaaaataccgttgagcatggcgcgttttaccagcgcaaaagcgccgattgccgagcggtgatccaactcagaacgtaccaccggtagattagtacgaaacgccttcaacgcctgggtattaatgcagctttcaatagcagggagcagcactttatcggcttcggtgatttctccagcaataacaattttttgcggattaaataagttgatagcaatggcgatggttttacccagatgacgaccgacatattcaatcacttccgaggccaggctatcgcctttgttcgcggctttgcagatagttttgatggtgcagtcgtccagtggcacacggctctggtagccctgctttaacagattcaacacccgttgttcaatggcagcattggcggcgatagtttccaggcagccaaagttgccgcagtggcagcgttcacccagcggttcgacctgaatatggccaatttcaccgacgttgccgttgcgcccgataaaaattcgcccgttagagataatcccggccccggttccgcgatggacacgcaccagaatggagtcttcgcaatcctgacttgcaccgaagtagtgctctgccagcgccagactgcggatatcgtggccgacaaaacaggtcactttaaaacgctcttccagtgcttcaaccagcccccagttttctacctgaatatgcggcatgtaatgaattttgccgctgtccgggtctacaagccctggcaggatcaccgaaatcgcgatcagctcgcgtagcttgcgctggtagctatcaataaactgagcaatggcattcagcagggcatgttccagcgtctgctgggtacgttccggcagcgggtaatgttcttctgccagcactttgctgctgagatcaaacaaggtgatggtggcgtcgtgacgaccaagccgtacgccgattgcgtggaaattgcgggtttcggtgacgatggagatagcgcggcggcccccggtggaggcctgctgatcaacttctttgatcagcccgcgttcgataagctgacgcgtaattttggttacgctggcgggggcaagctgactttgctcggcaatctgaatccgcgagattggcccgtactggtcaatcaggcgataaactgccgcgctgttaagctgttttacgagatcaacattacctatctgagcttgtccgcctggtgtcatactttctcttattgagttacgacctcgttaccgttaacgatggtcctggtgattttaaaatcaggtgtgaatgcagtcaggttggcaactttacctgcggcgagcgtgccgagacgtttctcaacgccaatcgcacgtgccggatagagcgtcgccatacgcagcacttcatccagtgcgataccacaatgttcgaccagattacgcacgccttcaatcatggttaaggatgaaccgcttaacgtaccgttctcatccacacaaagtccgttacggtagtatattgttttacccgcaaaaatgaactgttcaatgttggcacctgctggcgcggtggcatcggtaaccagacacaatttgtcgcctttcagacgtttagcgttacgaatgttggcgtaatcaacatgcaggccatcagcaataataccgcaataaatgtcagcttcgtcgaggatcgcgcccgccaggcccggttcacgaccggtaatatacggcatcgcgttgtacagatgggtggcaaaggtaatccccgcgcggaaaccggctttcgcttctttcaacgtcgcgttggagtgaccagcagaaaccacaatcccggcatttgccagtttgctgatgacttccgctggaaccatttccggtgccagagtcactttggtaatgacgtcggcgttctcacacaggaaatcgaccagcgcggcatcaggcttacgcacaaaattcggattatgggtgcctttttttaccagattcagccacggaccttccagatgcagacctaacgcctggttcggatgttttgccaggtactcgcgcataacgcgcacgccctgtttcatcagctcatcgctggtggtgataagcgtcggcagatagttagtacagcctgatttctcattggctttctgcatgatttccagcgtttccacgctgaccgcttcagcggtgtcgttaaactgtacgccgccgcagccgtttaactgcacatcgataaaaccgggggagagaatggccccgttcagtgaacgttgttcgatctctggcggcagttccgctaccggacagacgcttttaatcaggccatcagcgataacaaccgcgtggtcatcaagaaattcgtggccggtaaagatccggccctgggttaatgcatacattctgacccccgattttaaaaaatattgccctgagcaaggtgtcagggcagggataataattacagacctttgatattttctgcttctaattcattgaaatatcttaaagtcttaactttcagctccatggtggaaggttcatcgcacaccatgatcgcttttggatgcagttgcagacagctgatggtccacatgtggttcacgcaaccttcaacggcggcctgcagtgccagtgctttctgactacccagcaccagaatcatcacttcttcggcatccagcaatgtaccaacaccgacagtcagggcatattttggcacctgattaacatcgttatcaaagaaacgagagttcgcgacgcgagtgtcatgagtcagggttttgatacgagtacgagaagccagagaagacgccggttcgttaaatgcaatatgaccgtcgttacctacaccgcccataaacagatgaatttttccgtaagaacggattttttcttcatactggcggcattcggcgtcgatatccggggcgttgccgttgagaaggttgatattttctgctggaatatcaacgtgatcgaagaaattacggtgcataaagctgtagtagctttccggatgctctttcggcagaccgacatattcgtccatgttgaaggtgacaacgtgcttaaagctgacctggcctgctttatgcatttcgactaacgctttataggtggtcatcggcgtgccgccagtcggcaggcccagtacaaacggacgatcggcagtcggtttgaacgcattgatacgattgacgatatggcgagcagcccatttgccgacctgttcagcggtagtcagggggatcagtctcattattcacctcaataagtaaaatgtaagccgttggcggattaggcatctttaagcgtaacctggatttgcgcagacaggcgtcaatccgacctgattttttgaatgataaaataagttttctggtttagccagtaaaagggagtgatgataacgatatttggtgacaaaactcacaaaagacacgcgtttaatttgcgatacgaattaaattttcacacactctgtagcagatgatctaacaatctgattacagaacatcggcagtacaatttgcagcaaaataaaaatacggctttaaacgagccaaatagggttctcgtagggggaataagatgaatattttaggttttttccagcgactcggtagggcgttacagctccctatcgcggtgctgccggtggcggcgctgttgctgcgattcggtcagccagatttacttaacgttgcgtttattgcccaggcgggcggtgcgatttttgataacctcgcattaatcttcgccatcggcgtggcatccagctggtcgaaagacagcgcaggtgcggcggcactggcgggtgcggtaggttactttgtgttaaccaaagcgatggtgaccatcaacccagaaattaacatgggtgtactggcgggtatcattaccggtctggttggtggcgcagcctataaccgttggtccgatattaaactgccggacttcctgagcttcttcggcggcaaacgctttgtgccgatcgccaccggcttcttctgtctggtgctggcggccatttttggttacgtctggccaccggtacagcacgctatccatgcaggcggcgagtggatcgtttctgcgggcgcgctgggttccggtatctttggtttcatcaaccgtctgctgatcccaaccggtctgcatcaggtgctgaacaccatcgcctggttccagattggtgaattcaccaacgcggcgggaacggttttccacggtgatatcaaccgcttctatgccggtgacggcaccgcggggatgttcatgtccggcttcttcccgattatgatgttcggtctgccgggtgcggcgctggcgatgtacttcgcagcaccgaaagagcgtcgtccgatggttggcgggatgctgctttctgttgctgttactgcgttcctgaccggtgtgactgagccgctggaattcctgttcatgttccttgcaccgctgctgtacctcctgcacgcactgctgaccggtatcagcctgtttgtggcaacgctgctgggtatccatgccggcttctctttctctgcgggggctatcgactacgcgttgatgtataacctgccggccgccagccagaacgtctggatgctgctggtgatgggggttgtcttcttcgctatctacttcgtggtgttcagtttggttatccgcatgttcaacctgaaaacgccgggtcgtgaagataaagaagacgagatcgttactgaagaggctaacagcaatactgaagaaggtctcaatcaactggcaaccaactatattgctgcggttggcggtactgacaacctgaaagccattgacgcctgtattactcgtctgcgccttaccgtggttgactcagctcgcgtcaacgatgcgatgtgtaaacgtctgggtgcttctggggtagtgaaactgaacaaacagactattcaggtgattgttggcgcgaaagcagaatccatcggcgatgcgatgaagaaagtcgttgcccgtggtccggtagccgctgcgtcagctgaagcaactccggcaactgccgctcctgtagcaaaaccgcaggctgtaccaaacgcggtatctatcgcggagctggtatcgccgattaccggggatgttgtggcactggatcaggttcctgacgaagcattcgccagcaaagcggtgggtgacggtgtggcggtgaaaccgacagataaaatcgtcgtatcaccagccgcaggaacaatcgtgaaaatcttcaacaccaaccacgcattctgtctggaaaccgaaaaaggcgcggagatcgtcgtccatatgggtatcgacaccgtagcgctggaaggtaaaggctttaaacgtctggtggaagagggcgcgcaggtaagcgcagggcaaccgattctggaaatggatctggattacctgaacgctaacgctcgctcgatgattagcccggtggtttgcagcaatatcgacgatttcagcggccttatcattaaagctcagggccatgttgtggcgggtcaaacaccgctgtatgaaatcaaaaagtaatctgctttatgtctgatgcgacgcggcagcgtcgcatcagacaataaaaagcggcagggatcttctctgccgctttttttgtctgagattacattgggaagataaaaacagcgcctgcacaaagcgccagaatgcggatgagatacattggtacagagaacacccagaattcgggaagtttgtatttccccattccgaggatcatggctggcattccgtcaataggcatatagccgccattccagccagaaatcaccaccgcaatcgcggcagcggtcgggttaagcccaaggctagtacaggcggcaatggcgatgggggcaaaaatatatactgaccccatattcgaacccgtgaaggtggcgcaggtactggtaagcaaagcaaaggcgacaataaatacaaacggtgagacgccagaaccgagcacacctgcaacggcatcgccaaccatcgccgtaaagccggtgcccgccagtgcatcagctataccgatcacccccgccatcattaaaatgaccggagcccccatatgatcgcgaacttctttgaagtccagtacatcgatcatcagaacaaacgcacccgcaagacccggaataacgaaggcgatatttcccagaatgttcattagcatcatgccgataacgctgacagcgaatgcggcaatagtgcaatattctttccaggcaggaagggcgttaaacgtttcctcgcgtgccgccagcgcatcctcggaagcatccgcaatgggatgatccggaagaaaacggtaggcaataagactccatgcgaggaaagccgctgacatgatgagattcaccagcgcaaagcgccccatcgaaatctcctgatgaaaccccgcggtttcgagtacggtcgccgtaacgccaaagagaagcgcgagattgataggaagaagcgggtggttggtggcaaatcccaggggcatcattaatttcgatgttggtagctttttactgtacggaatggtggataccagcgacagaattagcacgtaataaccggtcgctccggtgccggcaagactggcacccagcataacaatgactaacaacagcccatagctgcggtaactgcctttattgaccaggcttatcatcgcagatttaacgttgctgataagccgggttttttgtagcgccgccatgaccaccataaaccctgcaatcatcaccacgcttggattgacgaatccggcaaaagcctgttgaacggtcgaaagtcccgatacaaccagcaataaacacgcaagcagtggcggtgcgccaaaaggcattttgtccgacatgatcagcacgatcatcaggaccagtattcctaatgccaggatcatttccattgtcattttttctctccttttaggcttccagcatgtcgcgcggtactttaaagaccgctttgcgtattgaagtagccgtgccaattgcgcacagcgcctggtgaggttcctcaggcataaagacggcgaaatcaccggcgtgtagggtgatggcgacactgttttcaggggatggggcgataaacagatcgggcttacgttcttcatcgttttcgcgagcgatgggccgcgttcccgcattaatgccctcacaaccagtaatcaccacctgtatatcggcccataaatggtgatactccgtatggcggagttcggcgggttgcgtgtctgaagttcccagcgtgcagaaccaccgacatccttcaggttgccagcgaccgtcctctctggtggataacgccgataatgaacactccgggcgcagcagaatatttctcacccaggcaggaagccccgccagcgacaaatggttgagattaccgataatcatgatgcctgccccttaacccactcgggggagatgcgtacgtacttgatggcctgacgccaccaggtgtaagcgatatgtagcgtaccgtccgggctttgtttgatgctggggtaggagaactcacgatttagcttttccagggaattgttggtcatgcagtagccgtcgccttcatcgagattgcgccgccacggccagcttttcccaccatcggcagaaatcgctaccgtcatcggcgcgcgtggggcaccccagaaagcggagcgtccgacggctgtcggttctttgcggctgtcgtcgccatcgacgatttcgtcataaagcgacgcgcgacgttctactgcgcctgccgcactcatcgcgttgtacaccagcgccagttcgccgctggcaagcgtcgttacctgaatagacgaattgttgttgggcaattcggttgcttgcggcaccgaccaactctcgccgttgtccactgaatggctgatatagatgttgtctgcccaacggctgcgaaagagagcaaccaacgtaccgtcgtgcaacattgtgatattcatatgaacacagccgagactttgcggcacctcgacatcgcgccaggagtgaccaccgtcagcggaaattttcactgcgctgatatcatcattgccgacccatttttcgccgggttgggtacggcaataaaagacgggcagcagccagttgccgttatcaagcaccgtgattggctgtcgaatgaacgtaccgggtttatcaagcagggtggcaatctcgccccaggtttgtccgaggtcgtctgacttacggtagcggacgatggcggtgtcctgattaccggatatttgtgcggtccataggagccacagcacgttatccggcgcgagaaacagcaccgggttttgctctgaacgcgtgtcatcgtgggaaagtttgaccgcatcgctccactgcattccgccagcgggcaatcgcgatccccagacagaaatatcggcaataccttcctgcgttcccgcaaaccagacgcacattaacgcgccatccggcaaaggcagaatattcgccgcgtggttttgcgggcaggacgagggcagcatggcggtaagcacatgcgaatcgttttcggatggacggatgacgccgtcacgaataagggctacagacatagttagactccatcttaaagttggtaatagatttattaatgcgagtgcgattcatgcgtttcgatcaatgtcgaaactttcttctttcacggataatattgagtgtctcaacacttaatgagaaaaatatcgcgaagtagagatactctttggcaatatgaatgttgagactatcggcaaccagcaatacaccgacaaacaataaaaaggttaacgccagtatttttattgacggcgtggcgttaacgaaatcaccaattgttttcgccgcaaacatcatgacaccgacggcaatcattacggcggcaatcatgataaatatatgctgagaaaggccgacggcggtgatcaccgaatccaggctaaacacgatatcgagcagcattatctgtacaatggcaccgcacaacgacagttgccgcgatccgctgccatgttcgtcttcctgcgcgggcgacagctcttcgcgtatctcctgtatcgctttataaatcaggaacagcccgccccgagcagaatcaacgtgcggaacgaaatctccagcgtcagcacggtaaaaagcggctgggtaatatgtgaaagccacgcaatggatatcagcaataatatccgcataatcatcgcgcagcttaaacccagtttacgcgccatattttgttgtgataacggaagttttgccaccaccagtgaaagaaaaataatattatccaccccaagaataatttccagaaaggtgagggtaattaaagtgagccagatatctggctgcataaaccacaaaaacatggggtaatcctttattctctttatctaaactttatagcgggctggataatagagttaatttaattaatgttataatgacgaataatttgttgaatctcgctgatctgttcaggcgtgaaattaaccgcgtagcggctatcaccaacatcatgccccataagctgcaacgcttttttcaccgcagccggggagaatgctactttataaagatcggtacgcaggcccgttacactctcctgtgcttcataagacccttcaatatcaccggcatggaagcgagaccagatggcattgatttctcgcggcgcgatgttggcgagcccagagatacaggctgaacatccctcgacaaaccctttatggatcagcgaatccgggccgttgagcacattaaagccgtcaatgtcgcgcaccgcatcgagaaaacccttcaggctttcgtcgcttccggcgctgtctttaatcccaatgatattggggtgcgacgccagagcacgcgcggtttctggctggatcgtattgccagtgcgggccgggatgttatagagaaacatcggaatgctcagtgcgtcggcaattgcgctgtaatgcgcaatcaactcttcctgtttcagcggtacgaagtaaggggcaatgaccgacacggcatctacgccaagtttttcaatctgctgacccagacgaatcgtttcgcgcgtagagatctcgccaatgtgtgccacgaccggcgcacgaccagccacttcatccacgcaggtttgcgtaacgctgagcttctcctgttcattcaacacaaaaaactcgccgttggtgccgccgcaaaaaatcgcgttacccgcttccagttgacgattcacctgcacttttaacgccgggatattcagactgccggtcgcggtaaacggggtgacgatagcggttaatacaccttcaatggttttcggcatgatttattccttaaattgatgttgcggaaacagtgtttggtaaatggcctgtacgtcctgtagatcaagctggcacggcacattgttcataaggcgcttcacgttcagtgccgcctcgctcagagaggcaatatcctctggcggtacgccgagatccgcgagattgttgggtagcttgagttgattgactaatgcctgtaaccaggtcaccagggcatgagatttttcttccgcgctcagggcggtttccgcatcgggaatgcaatcccagacccgggcaaatttctcgaccgcccaggggcgaacaaacgccatgcacggcgccagcaagatggcattcgcgacgccatgcggcagatgatatttgccacctaacgggtaggagagcgcatgaacgagatgcgtgcccgcatgggttatcgctacgccgccatagtaagacgcccacagcatttccagttttgcgcgcagatcctgaggatcgttcacggcgggttgaatgtgccggaaaagtttacttaacccagtcagcgccgcgttatcgctgaccggatttgccacggtcgcggtaaaacactccagtaagtggcaaagagcatcaatgcccgtggacgccgcaatatgcgcgggcatgctggtggtcagttccgggaaaagcgccacatagtctggtaacagcacctgggaaataatacccaccttcgtgctttgttcagggattgccagaatcgcattcggcgtggcttctgagccggttccggcggttgtaggaatcaaccatgattgcacccgctgagtcggtttttcacccgcaagcagcgcatccagccccggtgattgtggatggcaaagcaccgacagcagcttcgccacatccaacacgctgccaccgccgatcccgaccaccacatcaaaagaggcatcgccaagggcatccattagctggcgcacatcatgatgcgtgggctctgcgggcacattatcgataacgttaacctgcgggcagtgcttttccagtaaggcgcgaatctgctgcacaccgtcgagctgcgcaatattacggtcagtgaccagcagcatttttctgatgtcgggtaagagcgacgtcagggaagggatagcgcctgcgccgctcagtatcgtgctattgataattaccacaaataacctctcttctggtgattgaattcaatcattcaaaatgccgtagcctacgtaacatggtctaattttataatttattcgagtgattaataacttgagcttgctcacatttaatcaatcatgattgaatataatcattgttatcataaaacaacctggagtgatgatggaaaagggaatcactaagccgagcattctcgtcgttgccgatgatttcacgggagccaacgacgcgggggtaagcctggcgcaggtggggcatacagttgatgtggcctttgaaatgcattatcgcggtgatgccagcgtatgggtgattaacagcgacagccgggcgatggatcctaagctggcggcgatgaaaataacctcgctgatgagtcatctccctctggcgaataatccgccgctcgtgattaaaaagatagattccacgctgcgaggcaatatcggcgcagaaattgaagccctgatgaaggcatgcggtataacgggcgcagtggttgcccccgcatttcctcaggcgggaaggaccacagtggccggtgagtgttgggtaaacggtgtgcggataacggaaaccgagtttgccagcgatccgaaaaccccggtattgagcgcccgaattgcggatatcatccggttgcagacggccattccatgccagcccgttacggtttctcagctcagccatttgtcttatgagcaaccgtggattggcgtgatagatgcgcagacggacagcgacctggatcgcatcgctgccgctgtgatgcaggctaaacaaccgctgctgctggtcggctccgctggtatttgtgatgccgttgcccggcgctccgcgattatgtcgccacccaccgtgctggccattattggttcaatgagcgaaatcgctcaacggcagatcgccacacttcattcacacccacgtatcacacagatatacgtcgatgttgaacacattctggcaggcaatgccagtgactatgacgcgcgtattgtgcaggccttgcagaaaggcgaccactgcattgtccacacctgtaacgattctgtagcaagacatcagatcgacaccctttgccagcgttggcagatgagtcgcgctgcacttggggaaaaaatttgccggtttcttggcgaacttacccggcaagttctgcttcgcacaatgcccgatgcgctttatctctctggtggtgatgtcgcaatggcaacagccagtgcgttaggcgcgaccggatttcgtattacggggaaggtggcgcaatgcgttccatacggtcactttctgggcggtgtctggtcccgttcggtgatgacgaaagccggtgggtttggcgatgagaccacgttgcatcaggttctgaattttatcgaggagaagtgtagtgaataatattattgcggtaacgatgggtgacccggcgggtattggcccggagatcattattaaatccctgagcgaagccgggcttgctggtgccccggtggtggtggtgggctgtgtgcgtacgctgcgacgtattatggcgatgaatatcacgccgcaggcagagttacgcgtcattcaaaaggtgtgcgacgcccattttgctcccggcgtgattaacgtgatggatgagccgctggctaaccccgatgcgctgacacccggagtggtacaggctgcggcaggcgatttagcgtatcgctgtatcaaacgtgcaacggctctggccttatcaggcgaggtgaaagccatagccactgcgccgctgaataaagaagcgctgcatcttggcgggcataactatccggggcatacggaattgctggcccatcttaccggcagcaaagagtacgcgatggtgctctataccgataagctcaaggttatccatatttcgactcacatctcactgcgtaaattcctggatactttgaatggtgaaagggtcaaaacggttattcgagttgcgaaccacttcctgaaacgtgttggtattgagcgtccgcgtattgccgtggcgggtgtaaatccacatgcaggggaacatggtttattcggcactgaggaaatcgagattatcgcgcctgcgattgaagcaatgcaggccgaagatattgatgttactggcccgtgcccgccagataccgtgtttatgcaatgccatgaagggctattcgatatggtagtggctatgtaccacgatcaggggcatatccctttaaaactgcttggattttatgatggggtgaatatcaccgccgggttgccatttattcgcacttctgccgaccacggcaccgcgtttgatattgcctggacaggaaaagccaagtctgagagcatggcagtttccatccagttagcaatgcagatttcgcgagaataaaatgaagggatataaccggttagagcagatcatggattacctgaaaagccataatctggtcaccgttgatgagctggtggcggtaaccaatgcgtcgccggctacgattcgtcgagacctgataaaactcgatgagcagggtgttatcagccgtacacacggcggtgtgaccctcaaccggtttattcctacccaaccgactacccatgagaaaatgcagcgcagcctggcggaaaaacatgccatcgccagcgcagcggcgtcaatggtcaaagcgggggattccgtcgtccttgatgccggtacgacaatgattgaacttgcgcggcagattacacatttaccgcttcgcgtgatcaccagcgacctgcatatcgcgctttttttggctgaattcaagcaaattgaagtgacgattatcggcggacgtatcgacgactccagccagtcctgcattggcgaacatggtcgtaaattgctgcaaaatacctggccggacgtggcatttttaagctgtaacagctgggatcttgaaaagggtattacagcacccacggaagagaaagccgcactaaaacgcgatcttatcgcgcatgcttcgcgcaaaattctcctggctgacagctcaaaatacggttcatggtcgctgtttaatatcgcgcatcttaatgaactgacagagattattacggatagtcagcttgatgggcagacgcgtagaacgcttgcgtccttgtcgacgcgtttaatcatagccgactaatctatgactctgcggccagctcatccggcaatttaataaatgcgtcaggctggcgacgtttggccttacgtttccagcgcgaggatctgctggcagtagcgcagaaaacgccccaatatcttacgcaaaaccattttttctctaactaacagttgtcagcctgtcccgcttataagatcatacgccgttatacgttgtttacgctttgaggaatccacgatgagtgaggcagaagcccgcccgactaactttattcgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgtcgattcgatcaaaaacgacgtagagtggttaggtttccactggtctggtaacgtccgttactcctccgattattttgatcagctccacgcctatgcgatcgaactgatcaataaaggcctggcgtacgttgatgaactgacgccggaacagatccgcgaataccgcggcaccttgacgcagccgggtaaaaacagcccgtaccgcgatcgcagcgttgaagagaacctggcgctgttcgagaaaatgcgtaccggcggttttgaagaaggtaaagcctgcctgcgtgcgaaaatcgacatggcttcgccgtttatcgtgatgcgcgatccggtgctgtaccgcattaagtttgctgaacaccaccagactggcaacaagtggtgcatctacccgatgtacgacttcacccactgcatcagcgatgcgctggaaggtattacgcactctctgtgtacgcttgagttccaggacaaccgccgtctgtacgactgggtactggacaacatcaccattcctgttcacccgcgccagtacgaattctcgcgcctgaatctggaatacactgtgatgtccaagcgtaagctgaacctgctggtgaccgataagcacgttgaaggctgggatgacccgcgtatgccgaccatttctggtctgcgtcgtcgtggttacactgcggcttctattcgtgagttctgcaaacgcattggtgtgaccaagcaggacaacaccattgagatggcgtcactggaatcctgcatccgtgaagatctcaacgaaaatgcgccgcgcgcaatggcggttatcgatccggtgaaactggttatcgaaaactaccagggcgaaggcgaaatggttaccatgccgaaccatccgaataaaccggaaatgggcagccgtcaggtgccgtttagcggtgagatttggatcgatcgcgccgatttccgcgaagaagctaacaagcagtacaaacgtctggtgctgggtaaagaagtgcgtctgcgtaatgcttacgtcattaaggcagaacgcgtggagaaagatgccgaaggcaatatcaccaccatcttctgtacttatgacgccgacaccttaagcaaagatccggcagatggtcgtaaagtcaaaggtgttattcactgggtgagcgcggcacatgcgctgccggttgaaatccgtttgtatgaccgtctgttcagcgtgccgaaccctggtgctgcggatgatttcctgtcggtgattaacccggaatcgctggtgatcaaacagggctttgctgaaccgtcgctgaaagatgcggttgcgggtaaagcattccagtttgagcgtgaaggttatttctgcctcgacagccgccattctacggcggaaaaaccggtatttaaccgcaccgttgggctgcgtgatacctgggcgaaagttggcgagtaattttaagttctaccaggccgggtgaagcgtttacgccgcatccggcaagaaatatgcaaacaatcccaaacgccgcgctctgcggcgttttttttctgcttttcttcgcgaattaattccgcttcgcaatttatccagaaaacaaatttaaaatcacaaaccataattaagtaaaatgtaaccgttttcatcttgctggaaattcacgcttttattcttctgcaagcctttcaactacaacttaagccttgtaacaaaaatcatcaaaatatgtgcggttgctcatgttcttacattctggttacagaaagagattgataattcgcgtcgcgaaaaatagtctgttcctgtagtcagcgagacttttctcaacgctacttttttaatttttatttttttcgctgttcacctttggtgcagcaatttatacgtcaaagaggattaacccatgcgtacgtttagtggcaaacgtagtacgctggcgctggctatcgccggtgttacagctatgtcgggctttatggcaattccggaggctcgcgccgaaggattcatcgacgattcaaccttaaccggcggtatctattactggcagcgtgaacgcgaccgtaaagatgttaccgacggcgataaatacaaaaccaacctttctcactccacctggaacgccaacctcgattttcagtctggttatgctgctgatatgttcggccttgatattgccgcgtttacggcgattgaaatggcggaaaacggcgacagctctcacccgaacgaaatcgcgttttcaaaaagtaataaagcctatgacgaagactggtccggcgataaaagcggtataagcctgtataaagcagcggccaaatttaaatacggtccggtttgggcgagggcaggttatattcagccaaccggtcagacgctgttagcgccacactggagctttatgccgggtacttatcagggggcggaggccggggcgaattttgattacggcgatgctggtgcgttgagtttctcctacatgtggaccaacgaatacaaagcaccgtggcatctggaaatggatgagttttatcagaacgataaaaccaccaaagttgattatctacactcccttggggcgaagtacgacttcaaaaataacttcgtactggaagcggcgtttggtcaggccgaagggtatatcgatcaatattttgccaaagccagctacaaatttgatatcgccggtagcccgttaaccaccagctaccagttctatggtacgcgcgataaagttgacgatcgcagcgtcaacgatctttatgacggcaccgcctggctgcaggcgttgacctttggttaccgggcggctgacgtagtggatttgcgcctcgaaggtacctgggttaaggctgacggtcagcaaggatacttcctgcaacgtatgactccaacctacgcttcctcgaacggtcgcctggatatctggtgggataaccgttccgacttcaacgccaacggcgaaaaagcggtcttcttcggtgcgatgtatgacctgaaaaactggaatcttccaggcttcgccatcggcgcttcctacgtttacgcatgggatgctaaacctgcgacctggcagagcaatccggatgcgtactacgacaagaaccggactattgaagagtctgcctacagcctggatgcggtttacaccattcaggacggtcgtgccaagggcacgatgttcaaactgcatttcaccgaatatgacaaccactccgacatcccaagctggggcggtggttacggcaacatcttccaggatgagcgtgacgtgaaatttatggtaatcgcaccattcaccatcttctgatgcccgacgcggcaggttttgtgcctgccgcacgtttgaggaatttgcaatgaaaaaattgattctcatcgccatgatggcatcggggctggtggcttgtgcacaatccaccgcgccacaggaagacagtcgtctgaaagaggcatacagcgcctgtatcaacaccgcacaaggttcgccggaaaaaattgaagcctgccagagcgtgttaaacgtgctgaagaaagagaaacaacatcagcagtttgccgagcaggaaagtgtccgcgtactggattatcagcagtgtattcaggcaacgcaaaccggaaatgatcaggcggtgaaagccgattgtgataaggtctggcaggaaattcgcagtaataacaaataagtgagagctgtaactctcgcttttcttattttccttgtataaaaaagccaacctgcaggttggcttttctcgttcaggctggcttatttgccttcgtgcgcgtgctcatcttcgcggcaatcgccttcggcacagtgaccgtaaagatagagactgtggttagtcaggcgaatgccatgttttgcggcgatttcacgctgacgcgcttcgatggaatcatcactaaattcgataaccttaccgcagtcgaggcagatcaggtgatcgtggtgatgttgctgtgttagttcaaatacggatttaccgccttcaaaattgtggcgggtgacgataccagcgtcgtcaaactggttcagtacgcgatataccgtagccagaccaatttcttcacccatatcgatcagacgtttgtataaatcttccgcactgacgtgatggttgtccggctcctgaagaacttccaggattttcaagcgaggaagcgttactttcaggccagctttctttagggcggtattgttatcagtcatgcggaatctgtcctgttactaagcggttcacttcattagaagaagtgacagaatttgctcttgagataatgcgtatcattatagaattgccacgcctaaatgaaaaccacaagtccctggcaaatattgttaataaaaacgtggcacagcttacatttacaacggcaaggccacttgaacaccgggacattgtacaggtacaacagcaaaagttacaaatttgtagcaattattttgattggcattatctattaatacggcgtagacatgagtctacgccgcatcacatcaggcattgagaatttcgtcgagatgcagctcttcagaaatttgtttaacccatttttctacacgttcagcggtcagttccggctgacgatcttcgtcgatagccagaccgacaaagtggtcatcatcagccagaccttttgacgcttcgaagtggtagcccgcggttggccagtgaccaacgatagttgcgccgcgcggttcaatgatgtcgcggatggtgcccaatgcatcgcagaagtattctgcgtaatcttcctggtcgccacaaccaaacagcgcaaccagtttaccattaaaatcaatctcttcgagagtcgggaagaagtcatcccagtcacactgcgcttcgccgtaataccaggttgggatgcccagcagcagaatgtcatatgcttccagatcttctttgctgctttttgcaatgtcatggacatcggcaacgtcttaccannnnncattccattcattaattaattaatgaatgaatgnnnnngcgcggcattccggtgggtacgctggcgattgccaatgagagcaggccagcgtttaacgcttaaacgcccgcagcacgggatgcgcagttatctggcggtcgcgggtggtattgatgttccgccggtaatgggatcatgcagcaccgatctcaaagtggggattggcgggttggaaggccgtttactgagggatggtgaccgactcccgattggcaaagcgaagcgtgattttatggaagcgcagggcgttaaacagctgctgtggggnnnnncattccattcattaattaattaatgaatgaatgnnnnngcgcggcattccggtgggtacgctggcgattgccaatgagagcaggccagcgtttaacgcttaaacgcccgcagcacgggatgcgcagttatctggcggtcgcgggtggtattgatgttccgccggtaatgggatcatgcagcaccgatctcaaagtggggattggcgggttggaaggccgtttactgagggatggtgaccgactcccgattggcaaagcgaagcgtgattttatggaagcgcagggcgttaaacagctgctgtggggnnnnncattccattcattaattaattaatgaatgaatgnnnnngcaaagttctttttttcgcgttgtcgggttagggtattatgttgaccattgtgccacagggctgcaacaaataaggtttattccgagtttttctgcaagccaggcttgacgctatccgctgccgggatttattcatatactcctggcgacttgtattcagctaagacactgcactggattaagatgaaaacgattgaagttgatgatgaactctacagctatattgccagccacactaagcatatcggcgagagcgcatccgacattttacggcgtatgttgaaatttaccgccgcatcacagcctgctgctccggtgacgaaagaggttcgcgttgcgtcacctgctatcgtcgaagcgaagccggtcaaaacgattaaagacaaggttcgcgcaatgcgtgaacttctgctttcggacgaatacgcagagcaaaagcgagcggtcaatcgctttatgctgctgttgtctacactatattctcttgacgcccaggcgtttgccgaagcaacggaatcgttgcacggtcgtacacgcgtttactttgcggcagatgaacaaacgctgctgaaaaatggtaatcagaccaagccaaaacatgtgcctggtacgccgtattgggtgatcaccaacaccaacaccggccgtaaatgcagcatgatcgaacacatcatgcagtcgatgcaattcccggcggaattgattgagaaggtttgcggaactatctaaaacgttgcagacaaaggacaaagcaatggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgagcctgcgttcatttccgtactggaagtgctggcagcgaacggcgttgatgtcattgtgcaggaaaacaatggcttcactccgacacctgccatttccaatgccattctggttcacaataaaaaaggtggcccactggcagacggtatcgtgattacaccgtcccataacccgccggaagatggtggtatcaagtacaatccgccaaatggtggcccggctgataccaacgtcactaaagtggtggaagacagagccaacgcactgctggctgatggcctgaaaggcgtgaagcgtatctccctcgacgaagcgatggcatccggtcatgtgaaagagcaggatctggtgcagccgtttgtggaagggctggccgatatcgttgatatggcggcgattcagaaagcgggcctgacgctgggcgttgatccgctgggtggttccggtatcgaatactggaagcgcattggcgagtattacaacctcaacctgaccatcgttaacgatcaggtcgatcaaaccttccgctttatgcacctcgataaagacggtgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcgatcaactacctgttccagcatcgtccgcagtggggcaaagatgttgctgtcggtaaaacgctggtttcatctgcgatgatcgaccgtgtggtcaatgatttgggccgtaagctggtagaagtaccggtaggtttcaaatggtttgttgatggtttgttcgatggcagcttcggctttggcggcgaagagagtgcaggcgcttccttcctgcgtttcgacggcacgccgtggtccaccgataaagacggcatcattatgtgtctgctggcggcggaaatcaccgctgtcaccggtaagaacccgcaggaacactataacgaactggcaaaacgctttggtgcgccgagctataaccgtttgcaggcagcagcgacttccgcacaaaaagcggcgttgtctaagctgtctccggaaatggtgagcgccagcaccctggcaggtgacccgatcaccgcgcgtctgacggcggcaccgggtaatggcgcttctatcggcggtctgaaagtgatgactgacaacggctggttcgccgcgcgtccgtcaggcacggaagacgcatataagatctactgcgaaagcttccttggtgaagaacatcgcaagcagattgagaaagaagcggttgagattgttagcgaagttctgaaaaacgcgtaaacatatcaaataagaaaaagggcggtcggaagatcgcccttttttgctttgcttaattaaccgtgtttatttttcagttcaaagcgtggtgagaccagaccatacagtgtccaaccgaggaaggtcacgatggaaccgtatagcatggcttcttccccggatgagtacagcgcataaaagctgtacatcgcgccaacaaaagcaacaaagtttgcaactttcgcttttgaggggggcacattagcgaccttctgaataatgactaatgccgccattgacagaatatacgggatgatattggtcaccacggccaggttaaccagcacgttgaactgactgttcagcgacgggctaatggtcatcagtgataatccgctctggatgatgacaatggtcagcattccctgtactggtgcatcgactttgctcacacgggagaaaattttcgggaagtacccttcatcggcagaagatttaaacacctgggcaatggtgaactgccagccaagcagcgaaccgcagcaggacatcaccatcagcgccataatgactttacccacttccggcgtgaacatctgcgcgaaggccagaccaaatggtgccgttgaatttgccagctccatatttggcacaatcccggcaatcacgttggtggagacgatataaatcaccgccgcacctaacgtaccgccgagtaccgcgattggcacattacgttccgggttttccactacatcagtattcgcacacgcagactccagaccaagaaaagcccacagcgtcatagcgatggaagaacctaccgcactgaagaacggtgcatgatgcggattccaggaatcaacgtaaagcgtcgggctaaaccagaaccagccgataatgcacaggcctaccaccggaataatgaccccccacacggtaatgctactgatttgcccggtaatgcgcgcaccaccaaagttagccacggtacaaatccacagcaccccgatggtcgcaagaccaatctgcactggcgacaaactcgcgccgagcagttcggtgccgtaaccaaccgccgaaatagcaatcgcgacgttagcaatcagcagcgagacgccgtaggtatagttcgccataaagttaccggatttaccgaaagcatactcggcataaccgcccatacctcctgatttacggctgaacataccgcattttgcgaatgcccatgccagtgccattgagcctacggctgtcaccagccaggagataattgagattgtcccgacttcggcaagctttgtcggcagcatgatgataccggagcccatcatgttgaccatcgtcagtatggttaactgaacgacacccattttgttcgatttcgcctgactcataatttttcccctttcaacagggcgctttgcgcatcacgaggcttgatgacatagcaccaaacttgcttacgaccatcatgttcttcgatatagacaccctgcagctccggtgcaaaacctggcagcaggttgatgccttcttccagagcgctgaagtaacgcagaacagcaccaccccagatttcaccaggaacaacacacagcacacccggaggataaggaagcgcaccttcggcagcgatacggccttctgcatccggcagacgaaccagctccacttcaccgcgtaagtaggcgtagttggcttcttgcggattcatgctgacgcgtgggaagtgttccttacggaacatctctttttgcagttgtttcacgttgtggcgggcatacaaatcatgcatttcctggcacaactgacgcagggtataaccggcgtagcgctcttcatgctgtttgtagatggaaggcagtacttccgccagaggcgcatcagcttccagtagtttttcgaagcgtaccagcagggcaacaagttgctgcagtttggccatatcttctgccggagtcagcaggaagaggatggagttaagatcgcatttttccggcactacgccattttcgcgcaggaagttagcaagaatcgttgcgggtacaccgaacgcttcatattcgccgttacgtgcatcaatacctggagttgtcagcaacagtttgcacggatcgacaaagtattggttctctgcgtagccttcaaaagaatgccagtgctcaccgggtacaaatttaaagaagcgcagatcaaccgcaatttgcgctgtttcatacgactgccagggtttaccatccaccagttcaggaacgaacgggcgaatgtgctggcagttatcgaggatcaatttgcgggcattaataccgttaaccacacaatccatccacatattacgaccgctgacaccttcatgcattttggcgttgatatccagtgcggcaaacagcggatagaacgggctggtggaggcgtgcatcataaatgcgttgttcatgcgtttgtgcggtacataacgctgttgccctttgatatggctgtcttttttatgaatttgtgaagtctgagaaaaaccagcctgttgtttatgcacagattgcgtaaccagaatacccggatcgttctcattaagctccagcagcagtggcgaacagtccgccatcatcggaataaactgttcatagccgacccatgctgagtcaaacaggatgtagtcacacagatgaccgattttatccaccacctggcgggcgttataaatagtaccgtcgtaggtgcctaactgaatcacagcgaggcggaacggacgcgcctcttttgcccgttgcggtgcaacttctgtaatcagttcacgcagataactttcttcgaagcagtgcgcatcaatgccaccgataaaaccatacgggttacgtgctgtttccagataaaccggtgttgcaccagcctgtagcaaggccccgtggtggttagacttatggttattgcggtcaaacagcaccagatcacccggtgtcagcagggcgtttaaaaccactttgttggaagaggaggtgccgtttaaaacaaagtacgttttatcagcattaaacactttagccgcatgttgctgtgcaatgcatggcgcaccttcatgaatcagtagatcgcccattgcaacgtcggcattacacaagtcggagcggaagagcatttcgccaaaatattccacgaactgattgcctgccggatggcgacggaaaaactcacctccctgatgacccgggcagtcaaaagcgctattgccctgattgacataatcgaccagtgcgcggaagaagggcgggcgcagttgcgtttcataatggctggcagcggtttctaactgacgtccataaaactctttccgtgattcgcaatgctcgaagacaccagaaatacgtggcagatattctgctggtacacgttcttcattttccgttgcaataaaaacaggaatgccatagccagtagcgtctatttcatcgagttttccacgttcaacatcattgactgataaaataatggcggcaacgtcaatataattacttttgtcaatattcacgcattcacgatgagtggaaaaacaatccgggcaagaacggctaacggcaatttttaattctgacattttgttcatctctttatttcaggtaatagcaggtcctcaatttctcaaaggagaaattgatcacgccggaaaaaagcaaaaccccaccgctgataaataaatcagtagtttgctttttgcagatgcaataacccagaccagcccggtaactggctatactcgtcatacttcaagttgcctatgctgcgactcgaattattaagaggttaaaagggttagcagtatatgagcaccgagggatacaggtattaacctgtaatgcttaaagtcagggagacctgtacgctggggtgccctttagtcagaagactagcgggcattaaagaaatgaaagtcaaaactattacgatgggcaaacttcatgatatgggttgtccgccttatatgaggcattaagcggttattattttccatttacctttacctttttctgtgtcagttgaaggtagggttattctatccatgaaatggctataatctgtgaagaagatcaacaaaaaacgatcatatcccaaataataaatcattaatgatgaatagcgccatattagatgctgttttgttgtttaaatgttgcaattttgtgggttgtattttcattaagaaattaaacctgccaaataataattttcggggcaggtttaataataaattaataattatttaagcgtatttattgaataataattcatggcataaaccgatacccaataccggtttcagtaataaaatggcgggggcgggtgggatcctgctccagtttttgtcgcagatgccccatataaatacgcaaataatgactgtgttcgaccgcgtttggcccccacacctggttgaggagctggcgctgggtgagcacttttcccgcattattaagcaacactgccagcaggcggaactcaatcggggtgagatgcacctcttcctcgccccgatggatcacacgagctgctaaatcgacggtaacatcggaaaatttcaccagcggatcgggcgtggtggtggcggagtggcggcgtaatgcgacgcgcagacgggcctgcaattcgccaatgccaaacggcttactcagataatcatccgctccggcatccagcgcggcgattttatcgctctcttcgctgcgtgcggaaagcacaatcaccggcaccgcgctccactggcgcaggtcgcggataaactcaatcccatcaccgtcgggcaggccgagatcgagaataatcaaatctggcttacgggttgccgcttccagcaagccgcgttgcagcgtttcggcctcaaagacgcgcataccgtcgccctccagcgccgtgcgcagaaagcgacgaatagcctgttcatcttcaacaatcagaacgtttgtcacatatcctcatgaaattcttcaagttcaggggctgtttgctggggaagtgtaacacgaaaacaggcaccaccttccggtcggttgaatgcggtaatggtgccgccgtgtacatccactatcgcccgacaaattgccaacccaagccctacacccggtaccgccgactctttattcccgcgagcaaacttatcaaatatcgtctgctcctggcctggtggaagaccggggccgttatcccagacatccagttgtagattttcgccctcaacgtgggcattgataccaatttcggcctgcgcccccgcatatttcaccgcgttctctagcaggttaatcagcacccgttcaaagagtggcccgtcaacgtggattaaggtcagcggctctggcagagaaagattgatgggcgacgataaacccggttccagcatttgcagcgcgctgccgaccacttcttccagcgttaaccactctttcttcaaattaaagccgccggactgaattcgcgccatatccagtagattattcaccagtcgggtggtgttcagcacatgctgacgaatctcgctggcctggcgggcgtggggcgatccttcgcttgccagatcgagcgttaagatttctgcctgaccgaacagcaccgtaagcggcgtgcgtaaatcatgcgaaagcgccgccagcagggcgttgcggatctgttcacgttcgcttgccatccgcgcctgttcttcgctggcggtcagtgtcagtcgctcaagggcattggcgactaacagcgtaaacgtctccagcaggcgctgctgttccgggatcatcaactggcgcagattccccggttccaccaccaccagcccgtaggttttctcgccgctttttagcggcaaaatctggtacggtacaccgggtaacgtgtcggtgcctgcgcccgcaggcaggcctttatcaaaactccactgcgcgatggcatcgtcccacggcgtcattccttgcggatgtgttaaaggctgcaatttaccgttgtcatcaggcagcaacacctggctacgggcatgaaacgtggaggcaataaactgttcgctggtggcggcgatatcctgcgaactacggcccacagccagagctttggacatttcatataagtgccgtgtgcgttgttcgcggtaacgggctacccgcgcctgataacgcacgccagcagtaaggttcccgatcaccagcccgacggttaacatcaccgcgaaggtcagcagatattgcacatcagagacggcgagcgtgccgcgtggggcgataaaaaagagatcgaaactcaccacattaatgacggtggcaaccaccgaaggccagcgtccgtaaaatagtgccaccaccacgacgccaggcagatacagcatcaccaggttggcggcatcaaacgctatcagccactgcatggcaattaaggtgataacggcgcataacgcggcggcaaccacgcatccctgaatctgtacccgccacttgtctttaaaagagcggctatccggcgcgttgttaatcgtgcgggcgggtggttcatcaagcgcgaccagcacctgatcgagatcgggggcgatgcgtgccagccggtcagcaaatgtttcccgacgccaccagcggcgcgaagccgggcgaccgagaataatcttgccgagattatgttcacgggcataacgcactaccgctttctcttccgctggatcagaaagtgttgccgtctccgcgcccagctcctgcgccagacgtaaggcgctgagaattgcccgacgttttttctccggtaagcgatgcagggcaggggtttcaacatacaccgcgtgccagacactgcccaggcgcgaggccaaccgcgccgccgcgcggaccagtttctcactgccggtgttatgcccgatgcataataggatcgcgtcgcgtgtgtgccagactttctcttcgccaggatgcccccgccaggcgcgcatttgctcatctacgcgatcggcagtacggcgtagtgccagttcgcgcagggcgatcagattacctttgcggaaaaaatgttcaatggcgcgctccgcctgcccggcaatatagactttgccttctttcagtcgctggcgcagatcgtccgggggcaagtccaccagcaccacgtcgtcggcggcatcgaaaaaaggatcgggcacggtttcccgcacctgaattccggtgacgccgctgaccacatcgttcaggctttccagatgctgaacgttgacggtagtgaaaacatcaatgcctgcttccagcagctcctcaatgtcctgccagcgtttaggatgacgagaacctggcgcattactgtgcgccagttcgtccattaagatcagtgccggacggcgggcgagggcggcatcgagatcaaactcgctgatgtgccgcccacggtacgcctggcgttttaacggcagaacagccagacctttcagcatggcggcggtatctttccgaccgtgggtttctaccacgccaaccacaatatccagcccttgcgcccgcagtcgctgggcttccgccagcatcgcccaggtcttcccgacgcctgcgcaggcaccgaagaatactttcagcttcccccgatgcggcgcggcagcttgttccagcagacgatcggggtcgggacgtaagggttcgttattcatcaagcctatccagtgccagattgagttcgacaatgttgacgaccggctggccgatatatttcaccagcggttgttggctgtattttgcgatcagttgcgtgagctgttcaacgctgagattacgcgctttcgccacgcgtgggatctgccaggccgccgcttgcggggtgatgttattgtccagcccgcttgctgacgccgtcaccagttcaaccggaacgttcgtgctggcatccgggttagcagcccgtaatgcggcaacgcgtgcggctatctgtttatccagctccgggttactgactgccagattgctcccgccagaagcctgtggattatagggcatttctgctgttgccgacgggcgaccatgaaaatagccgttgccggtaaaattttgcccgattaatgccgaaccgcgcaccgtatcaccttcacgaatcaatgaaccgttggcctgccagggaaaccaccattgccccagtgcggtggtcagcagcgggtaaacgccgccagtaatcaataacagaaagagaaatgtcgataatgccggacgtaatccacgcatggtaaacctcacaccagaccgcaaacggttagcagtaaatcaatgactttgataccaataaacggcaccagcagcccacccagaccgtaaatccataagttacggcgcaacatggcagaagcggtaagcggtttataactcacgccttttaacgccaggggaatcaaaaagacgataatcaaggcgttgaaaatgaccgcactgagaatggcggagtcgggcgaatgcaggcgcatgatgttcagcgcatttaactgcggatacgttgccgcgaacgccgctggaataatggcgaagtatttcgccacatcgttggcaatgctgaaggtggtcaacgagccacgggtcatcagcatctgtttgccaatgtgcactacctcgatcaacttggtcgggttggagtcgagatccaccatattgcccgcttctttcgccgcctgggtgccggagttcatcgccaccgcaacatcggcctgtgccagcgccggagcatcgttggtgccatcgccggtcatcgccactaaacggccttccgcctgatactgacgaatcagtgccagcttggcctccggtgttgcttcggcgagaaaatcatcgacacccgcttccgcagctatcgcggcggcagtcaggcggttatcgccggtaatcatcaccgttttaatgcccattttacgcagctgggcgaagcgctctttaataccgcctttgacgatatctttcagcgcaataacgcccagcacacgagaaccttccaccaccaccagcggcgtggctccctgacgcgcaacctgatcgactttttgatcaacatcggcagggaagtgaccgccgttagcctcaacatggcggcgaatggcatcgacagaacctttacggatcatgcggttgtcgatgttgatcccgctcatccggctttgcgcagtaaacggtacaaaggtggcatggagcgactgcacatcgcgctcgcgcaggttaaaacgctgcttggcgaggatcacaatactgcggccttccggcgtttcatcagccagcgaagccagttgtgcggcgtcggccagcgctttttcctccacgccttgtgcggggataaactctgacgcctgacggttaccgagtgtgatggtgccggttttatccagtagcagaacgtcaacgtcacctgccgcttcaactgcacgtccgctggtggcaatcacattcgcgcccagcatccgactcattccggcgacgccaatcgctgacaacaggccgccaatagtggttgggatcagacagaccagcagtgccaccagtaccgttacgctgacggcattaccgccccacgcggaaaacggccacagcgtggcggttgccagtaaaaagacgatagtcagggcaatcaggagaatggtcagggcaatctcgttcggcgttttacgtcgctgcgcaccttccaccatcgcgatcatccgatccagaaatgtctcgccggggttaacgctgcactcaatcaccagccagtcagaaagaatacgcgtgccgccagtgacggaggcaaaatcaccgccggattcacggatcaccggagccgattccccggtgatggcgctttcatcgaccgatgcgccgccttcaatgacttcaccatcgcaggggataatatcgctagcttctaccagcacgatgtcacctttacgcagttgatcagcaggaactttgtccgccgcagcgccatatttcggttcgcgcagcttgcgagcaaaagcggtttttttcacccctttcagactgttggcctgcgctttactgcggccttctgccaacgcctcggcgaaattagcgaacagtacggtgacccacagccagccgctaattgccgcgctaaacagcgcattgccaggcatcacatcgcttgccatcgcgatgctaatacaggtggtcagcagactgccgatccagacgataaacatcaccggattgcgccattgcgcctgcgggtttaattttttcaccgcttctttcagcgcctgaacgacaagtgttggttcgaatagcgccagttgtttacgactcatattcagtgctcactcaatatcatcaggagagatattccgccaccggaccaagcgccagggcagggataaaggtcagtgcgccaaccagcaacacggtgccgattaacaggccaacaaacagcgggccgtgcgttggcaatgtgccggagctggcgggttggctctttttactcaccagcgaaccggcaattgccatcaccgggataatcaccccgaagcgcccgacaaacatgcacaacgccagtaaacagttccagaatggagagttggcgcttaatccggcaaaggcgctgccgttgttgttagcggcggatgacacggcatacagcacttcgctaaaaccatgcgggccagggttgagcatggcgctacgtccggcgtcggtcatcattgccagcgccgcgcccatcagcaccagcgtcggggtgaccagaatcgccagtgcagtcagtttcatctcgcgtacgtcgatttttttacccagatattccggtgtacgaccaatcatcagcccggcaataaacaccgccagcaggacaaacagcatcatgccgtaaaggccggaaccgacgccgccgaataccacttcaccaatttgcatcaaccacatcggcaccatgccaccaagagcggtaaacgaatcatgcatcgcaatcaccgcgccgcaggaagccgccgtagtcacgaccgcaaacaggctactgaccagcacgccgaaacggctctctttaccttccatattgatgctgctgtccgcgccgagcgccagcagatgaggattaccctgaacttctgcccacatcactacgcctacgcagatgacaaaaatcaccgacatcgcccacagcaacatgcgcccctggcgacgatcgcccgccacttcaccaaaggcaaagcacagcgctgttgggatcaagaaaatcgccagcatttgcacgaagttggtcagtgcggttgggttttcaaacggatgcgacgagttggcattaaaaaagccaccgccgttagttccgagcattttgatcgcttcctgagaagctactggccccattggtaacagctgttgcgctccttcaatggtcgtcacagcctgataaggcaaaaagttttgcagcgcaccttgttgaataaaaaacagtgcgatcagcaatgctacgggggttaacacccataacgtaatccgcaacaggtctacccacgcattacccagcgtgttcatgctctggcgggtaaacgcgcgaataagcgcaaaaatcaccgcaatcccgctggcggcagaaagaaagttttgcaccgttaagcccgccatctggctgaaatagctcaacgtggtttcaccgctataagattgccagttggtattcgtgacaaagctgacggcggtattgagcgccagatcccacgacagccccggcaactgctgtggattaagcggcagatagtgctgaccgagcaacataaaaaacagcaccgccagccccagtatattcaggccaagaatggctgagagatactgcttccagttcatctcgcggtcagagacgccaagcgcgctaaagagtacgcgttcaacgcccgtcgtaccaggaagaggtatatcattaatcagccgcgccagcccgctacctaagggacgcgccagcaccataaataccagtaaaaacgtggcaatcagtaagaacccttgcgcagccatcagaacgcctccgcattgatcagggcataaaccagataacccagtaataaaaacaccagcaacacgccggttatcacgcctgcactcacagtgcacctccagtggcctaaaagtgataccggaagggtagagttctggctgcaaagatttcgcaaaaatctgcgggcgtggtgtaaaaaaagtataaaaatggcaaaagccatgatttaactaatgtttagtattaatttaacttttatgtaacttaattacacggtgaatgtaaataaaccatcaataagcaaaaataagtggtcggatgagtagtaaaattacacaaacagcggtactattttcatcagataaacgaattcatttttccggtgctattcaccgggtagatacaaaagggggagaaaagtatggaactctacaaagaatatcctgcatggcttatctttttacgccgtacttgtgcggttgcagcgggcgttctggcgctgcctttcatgcttttctggaaagaccgcgcccgcttttacagctacctgcaccgcgtctggtcgaaaaccagcgataaaccggtgtggatggatcaggccgaaaaggcaactggtgatttttactgattgccaaacatgacgtttaaagaaaaccgccggtggaaacgctggcggttttcttttttcggcgtctacacttactcctgtaaaccgttcaggagcagtaatgaatcaacaactttttgatgacagcacccttatccgcatttttgctttgcatgagttacacaatctcaaagatcgaggactaacgcgcggggcgcttctcgattatcacagccgctataaactcgtctttctggcacattctcagccggagtaccgcaaacttggcccgtttgtggctgatattcaccggtggcaaagtctggatgactattacaaccagtaccgccaacgcgtaattgttttgctttctcaccctgccaaccggcgtgatcatactaacgttttgatgcacgttcagggatattttcgcccacatattgattccacagaacgccagcagctggcggcgcttatcgacagttatcgccgtggcgagcaaccgcttcttgcgccgctgatgcgtatcaaacactatatggcgctttatcctgacgcctggctttcagggcagcgttatttcgaactttggccgcgtgtgattaacttgcgccatgcaggagttttatgactacccatctggtctggtttcgccaggatttacgtcagcacgataatctcgcgctggctgccgcctgccgcaattcgtctgcgcgcgtgctggcgttgtatatcgctacaccacgccagtgggcggcgcataatgtgtcgccgcgtcaggctgaacttatcaatacacaacttaatgcgctgcaaaacgcgctggcggaaaaaggcattcctttattgttccgcgaagtggatgactttgctgccagtgtcgaaacagttaaacaggtgtgcgcggaaaatcgcattacccatctgttttataactatcagtatgaggtgaatgagcgggcgcgggatgtgcaggctgagaggacgctgcgtaacgtggtgtgtgaaggatttgatgacagcgtgatcctgccgccgggggcggtgatgactggcaatcatgagatgtacaaagtctttacgccttttaaaaacgcatggttgaaacggctgcgggaagggatgccggagtgcgtcgctgcaccaaaatttcgtagtagcggatcgatagagcccgcgccatccattacgctgaattatcctcgtcagtctttcgatactgcgcatttcccggtggaagaaaaagcggcgattgcgcaattacgccagttttgccagaacggtgccggagagtatgagcaacaacgagattttccggcagtggaaggcaccagtcgtttgtccgccagcctggcaacgggcgggttatcgcctcgccaatgtttacatcgcctgttggcggaacaaccgcaggtgctggaaggcggaccggggagcgtctggcttaatgagctgatatggcgcgagttctaccgccatttgatgacgtattatccttcgctgtgtaaacatcgtccgtttattgcctggacggatcgtgtacagtggcaaagcaatcccgcccatttaaaggcctggcaggagggcaaaacgggatacccgattgtcgatgctgccatgcgtcagcttaacagcactggctggatgcataaccggctacggatgattacagccagttttctggtgaaagatttgttgatcgactggcgcgaaggcgagcgatatttcatgtcgcagttgattgatggtgatttggcagctaataacggtggctggcagtgggctgcttctacgggtactgatgcagcgccgtattttcgtattttcaacccgacaactcagggcgagaaatttgaccgcgaaggcgaatttatccgccagtggctaccggagctgcgcgatgtaccggggaaagcggtgcatgagccgtggaagtgggcagagaaaacaggtgtgacgttggattatccgcaaccgatagtcgatcacaaagaggcaaggctgcgaacgctggcagcgtacgaagaagcgaggaaaggagcctgataaaacgcagcgagcgttttatcaggcatggtgctggcttattaagactccagcgccagcgcgcggtttctgaacttaagcgcctgatacagccaaatcatcagtaccagtcctacacacgccagtgcgccccaggtaatttgatcaaatacttcaatatatgcattgatggagtagttgatcgccccggaagcatcaaacgaagcctgcgatgtctgatcggcaatcacgcccgccagatagttcgcaatcgcgccggaaagcagcatataaatgccggttaatacgccggtcacgccggggatttcaatgcgcgtaatctgcgacatagcaaccggatcgataaacagttccgcaaagcccatcaccgccaggcctaacaccatcagtggcagagaagagtgaccatacattgcggaccagcgggcgcttaaggtcagaatgcagaatccggcgctcatcaggccaaggccaagagcaaattttccccagatgcgcacggtacgattacctgcgacgctttctttaaccacccacgccaggaacacaccgcacagcataactgcgaaggcattaatcgactggaacatagcagtcggaacggtataaccaaacatatcgcggttaacgaagcggtcgatataaaggctaatcgagctacccccctgttgtgcgaatgcccagaacaacatgctgaagaaggtgagggtaacaatcagccccagctccttacgctgtttttggttttctgctttgcgataaatttttgccagaaccccaaggccaatgatcgtcgcgacaatcaaggcgtataccgaccactctttccagaacaacacggtaatcagcgcaggcgttgccaccagcagaaccagtagccatccccagttgggcaggagaaagtttgtcgcacgcagtacctttttgttaacgccgcgggtgtgtgtgaaatgacgattgccacataagaaaatgaccagacccgcgatcatacccaccgccgccaggccaaagcccatcgcccaactgtactcttcctgggcgaaaccacaggcgataggtgcgataatagaccccacgttacccgccgcatacatcagcgagaaaccgccatcacgacgtggatcggttggctcatacagctcgccgagcaggcaactgacgttggatttaaacagaccatagccgcagacgataatcgccagggacagatagaggaatgacggatggatctcactggcacccagcaccacatgaccgatcgccatcaacaacgcccccagcatcaccgccatgcgattgccgagaactttatccgccaaaaagccaccgaggattggcgtgacatataccagcgaacagtaggcgctaaataactcgtaggcgtgattatcgctatattttagttgattggtgagatagaggatcagcagggcacgcatgccgtaaaagctaaaatattcccagatttgcagcgcaacgacatagtaaatagcgcgcggttgtgatgcgtgtttattcataataattccacaattgactgcaacgtcacgtaatagttgcgcggcgtgcttgtgtttccttaaagttaaaactttgatacagatctgattatttatgcaatatgctgtctgattgcataaatatacattagctgaagcgtgatgatataaacaatttgcgtcttttggcgtcgtgtttgtttcttaatatgtcaaaagattggctatcgacgaacaggcgaggtaacgctatgttaacggtgtagctatcagaatacggaaggcgcgaagatgaaaaacaccgaactggaacaactgattaacgaaaaactgaacagcgcggcgattagtgattacgcgccgaatggtttgcaggtggaaggcaaagagacggtgcaaaaaattgttaccggtgtcactgccagccaggctttgctcgatgaggcagtgcgtctgggcgcggatgcggtcattgtgcatcatggctacttctggaaaggcgaatctccggtcattcgcggaatgaagcgtaaccgcttaaaaacattgctggcgaatgatatcaacctgtatggctggcatttgccgcttgacgcacatcctgagctgggcaataacgcacagctggcggcgttactggggatcacggtcatgggcgaaattgagccgttggtgccgtggggcgaactgaccatgcctgtgccgggactggaactggcctcctggattgaagcgcgtctgggacgtaagccgttatggtgtggcgataccggacctgaggtggtccagcgcgtcgcctggtgcacgggcggcgggcaaagttttatcgatagcgccgcgcgttttggcgtggatgcttttattactggcgaagtttctgaacagaccattcattcagcccgcgagcagggattgcatttttatgctgcaggtcaccatgccactgaacgtggtggtattcgcgcattgagcgagtggctgaatgaaaataccgatcttgatgtgacctttattgatattcctaatcctgcataacgaataatcagagggatcgaaagtgcaacgagcgcgttgttatctgataggtgaaacggcggtagtactggaactggaaccgccggtgacgctggctagccagaaacggatctggcgactggcacagcgtctggtggatatgccgaatgtggttgaagccattcctggcatgaacaatatcacagtgattttgcgtaatcctgagtcgctggcgctggatgccatagagcgtttgcaacgctggtgggaggagagtgaggcgctggagccggagtctcgctttattgaaattccggtggtttacggtggcgcagccggaccggatttggcggtggtcgcggcgcattgtggattgagcgaaaaacaggttgttgaattacactcctccgtggaatacgtggtctggtttttaggttttcaaccgggcttcccgtatctcgggagtttgccggaacaactacacacgccacggcgcgctgaaccgcgcttgcacgttccagcaggttctgtcgggatcggcgggccgcagaccggtgtttatccgctggcaacgccgggtggctggcagttgattggtcatacctcactcagcctgtttgatccggagcgtgacgaacccatcttattacgtccgggagacagcgtgcgctttgtaccccagaaggagggagtatgctgaagattattcgtgcgggcatgtataccactgtgcaggatggcggtcgtcacggttttcgccagtcgggtatcagccactgcggcgcactggatatgcctgcgctgcgcattgctaacctgctggtgggtaatgacgccaacgcccccgcgctggagatcacgctcggtcagttaacggttgagttcgaaactgatgggtggtttgccctgacgggtgccggttgcgaagcgcggctggatgataacgccgtctggaccggctggcgattgccaatgagagcaggccagcgtttaacgcttaaacgcccgcagcacgggatgcgcagttatctggcggtcgcgggtggtattgatgttccgccggtaatgggatcatgcagcaccgatctcaaagtggggattggcgggttggaaggccgtttactgagggatggtgaccgactcccgattggcaaagcgaagcgtgattttatggaagcgcagggcgttaaacagctgctgtggggcaaccgcattcgcgccttgccggggccggaatatcatgagttcgatcgcgcctcgcaggatgcattctggcgttcgccctggcagcttagctcgcaaagtaaccgcatgggctatcgcttacaggggcaaattttaaaacgcaccaccgatcgcgaactgttatctcacggtttgttaccaggtgtggtgcaggtgccgcataacgggcagcccattgtgttgatgaacgatgcgcaaaccaccggtggttacccgcgtattgcctgtatcattgaggctgatatgtaccatctggcgcaaattccgctcggtcagccgattcattttgtccagtgttcactggaagaggcactgaaagcacggcaagatcaacaacgttatttcgaacaattagcgtggcggctgcacaatgaaaattgacctgaacgccgatctgggcgaaggctgcgccagcgacgcagaactattaacgctggtttcctctgccaatattgcctgtggatttcatgcaggcgatgcgcaaaccatgcaggcttgcgtgcgtgaagcaataaaaaacggtgttgcgattggcgcgcacccgagttttcccgacagggaaaattttggtcgcagcgccatgcagctgccgccagaaaccgttttcgcccagacgctgtatcaaattggcgcgctggcagcgattacccgtgcgcaaggcggcgtaatgtgtcatgtcaaaccgcacggcatgttatacaaccaggcggcgaaagaggcacaactggcagacgccatcgccagagcggtatacgcttgcgatccggcattgattctcgtcgggctggcaggaagcgagctgattcgtgcaggcgaacgatatggcctggtaacgcgcgaggaagtgtttgccgatcgcggttatcaggcagacggttcgctggtgccgcgaagccagccaggcgcgttgattgaaaacgaagaacaggcgctggcgcaaacgttggagatggtgcaatacggcagagtcaaaagtatcaccggcgaatgggcaatggtcacggcgcaaacggtctgcctacatggcgatggcgagcacgcactggcgttcgcccgccgattacgagctacatttgctgaaaaggggattgttgtcgcagcataaccccgcttaataaagaatgaaaaaaggatatcaccatgcctgaaggcccggagatccgccgtgcagcggataacctggaggcggcgatcaaaggcaaaccactaactgatgtctggtttgccttcccgcagttaaaatcttatcaatcacgacttatcggtcaacacgttacccatgtggaaacgcgtggtaaggcgttgttaactcatttttccaacgacttaacgctctacagccataatcagctttacggtgtctggcgcgtggttgatacaggcgaagagccgcagaccacgcgagtactgcgggtaaaactgcaaacggctgacaaaaccattctgctttatagcgcctcggatattgagatgttgaccccggaacaactgaccacgcatccgtttttacaacgcgttggtcccgatgtgctggatccgaatctgacgccggaggtggtaaaggaacgattattgtcgccgcgctttcgtaaccgccagtttgctggattactgctcgatcaggcgtttctggcaggacttggcaattatttgcgggtggagatcctctggcaggttgggttgaccggaaatcataaagcgaaagatctcaatgcggcgcaactggatgcactcgcacacgcgttactggatactccgcgactttcttacgctacgcggggccaggtggatgaaaacaaatatcatggggcgctgtttcgctttaaggtttttcatcgtgatggcgaaccttgcgaacgctgtggcggcatcattgagaaaaccacgctgtcatcgcgcccgttttactggtgcccaggctgccagcactaggccgaacgcttcggcgcataggttgaaataaaccgtgcgatggcaggccccgtcagcaaaatactgaacaggcgcagggtttgcatcgccatgatgagcgccatatcggcattgctccctgcggcgatgaccgccacggtatcaagcccgccggggctggtggcgaggtaggcggtcataaaatcaatatgcataaaccgggtcagcccccacgccatacccgcacaaatagccagcagagcaaaaatcgacagcaggatttgtggcagtgggcgcaatgcccgcagtaatatttgcttatcgaaaccaagaccaatccgccagccaattgccatatatgccatcgccagcagccattccgggagttcaatcgtgatgagctgaccagactggagcactgcgcccgccagcatcgggatgagcatcgtgccggaaggaagacgtagcaagcatcccgccgtaccggcaacgaccgcgagcaaaatcgtaagcaggagattaatgctcactggcgggaaccagacgatctgctggttaaccgcttcagcgttatcgcccagcatcatgcgggtaaccagaacagcggcccccgcgacgaacagcactcgcagatattgcataaacgccaccaggcgaatatctgcgccgtaatcttgcgccattgcgaccattgccgccgcgccgccaggagaagaaccccaggccccggtatttccaggcagtgagctatagcgcaccaataaccaacccacgatggcgctggaaagcagcgtcaccagtaaaatcgcaagcacgatcggccagttgacggccagcgtggtgagaatcgaaccagtgaggttttgtgcaatcatgcagccaagaatggcttgggcagcgagaaaagcggagcggggaagttgcagagtgactccgcgcatactgaagatgatcccggcgatcatcgggccaagcaggagtgccgccgggagatgtaaagcgaggaagccaatagaaaggagaagtgacagaacacataacattccccactgcaatacaggcattcttcgcttcctcattattttatctttggtgtatcgatacagcataaagaaagctgggtctggaaaaaataacggtaatcaaggaaaaggggaaaatcagcaataatctgaatacgttgccctttccggctgaaaagggcgtcgtgttaaatcagttatagttaatcttaaaaagtaccactgtatcgaagggacccgccgcgatgggagtgccaggtgtggacgataattcagccgtataggttttttcgtagatcagcatatcactggtgaaatcggcgtattcagcatatttattgaatgtataaggcgaggcgttttcatccagtatacgtagcttcagaccattaccaatcaacaatgctttatcttcttcaaccaacgttttttcggtataaaacgaggagctgaccttaaatccgtcggtacactggtcattttgcgattttgttgtcttgatactgaatgttttcgacattgtgtggcggcgaatatccagtaagttaaatttacccaaatcaatcaccagtgtttccggtgaaatattttttcaccattattaatgggtatttgcatctggtttaatttttacaattttttatgttcagccatataaaaagaacccgctctattaaaggcgggtccggaaagtgaacggcttagcaatcaaccattaacgcttgatatcgcttttaaagtcgcgtttttcatatcctgtatacagctgacgcggacgggcaatcttcataccgtcactgtgcatttcgctccagtgggcgatccagccaaccgtacgtgccatagcgaagatcacggtgaacatagaagacggaatacccatcgctttcaggatgataccagagtagaaatcgacgttcgggtacagttttttctcgataaagtacgggtcgttcagcgcgatgttttccagctccatagccacttccagcaggtcatctttggtacccagctctttcagaacttcatggcaggtttcacgcattacggtggcgcgcgggtcgtaatttttgtacacgcggtgaccgaagcccatcaggcggaaagaatcatttttgtctttcgctcgacgaacaaattctggaatgtgtttaacggagctgatttcttccagcattttcagcgccgcttcgttagcaccaccgtgcgcaggtccccacagtgaagcaatacctgctgcgatacaggcaaacgggttcgcacccgaagagccagcggtacgcacggtggaggtggaggcgttctgttcatggtcagcgtgcaggatcagaatacggtccatagcacgttccagaatcggattaacttcatacggttcgcacggcgtggagaacatcatattcaggaagttaccggcgtaggagagatcgttgcgcgggtaaacaaatggctgaccaatggaatacttgtaacacatcgcggccatggtcggcatttttgacagcaggcggaacgcggcaatttcacgatgacgaggattgttaacatccagcgagtcgtgatagaacgctgccagcgcgccggtaataccacacatgactgccattggatgcgagtcgcgacggaaagcatggaacagacgggtaatctgctcgtggatcatggtatgacgggtcaccgtagttttaaattcgtcatactgttcctgagtcggtttttcaccattcagcaggatgtaacaaacttccaggtagttagaatcggtcgccagctgatcgatcgggaaaccgcggtgcagcaaaataccttcatcaccatcaataaaagtaattttagattcgcaggatgcggttgaagtgaagcctgggtcaaaggtgaacacaccttttgaaccgagagtacggatatcaataacatcttgacccagcgtgcctttcagcacatccagttcaacagctgtgtccccgttgagggtgagttttgcttttgtatcagccatttaaggtctccttagcgccttattgcgtaagactgccggaacttaaatttgccttcgcacatcaacctggctttacccgtttgttatttggctcgccgctctgtgaaagaggggaaaacctgggtacagagctctgggcgcttgcaggtaaaggatctattgatgacgaataaatggcgaatcaagtacttagcaatccgaattattaaacttgtctaccactaataactgtcccgaatgaattggtcaatacttccacactgttacataagttaatcttaggtgaaataccgacttcataacttttacgcattatatgcttttcctggtaatgtttgtaacaactttgttgaatgattgtcaaattagatgattaaaaattaaataaatgttgttatcgtgacgcagatcactgttcgggataaaacccgacaaactatatgtaggttaattgtaatgattttgtgaacagcctatactgccgccaggtctccggaacaccctgcaatcccgagccacccagcgttgtaacgtgtcgttttcgcatctggaagcagtgttttgcatgacgcgcagttatagaaaggacgctgtctgacccgcaagcagaccggaggaaggaaatcccgacgtctcctggtaacagaaagttaacctctgtgcccgtagtccccagggaataataagaacagcatgtgggcgttattcatgataagaaatgtgaaaaaacaaagacctgttaatctggacctacagaccatccggttccccgtcacggcgatagcgtccattctccatcgcgtttccggtgtgatcacctttgttgcagtgggcatcctgctgtggcttctgggtaccagcctctcttcccctgaaggtttcgagcaagcttccgcgattatgggcagcttcttcgtcaaatttatcatgtggggcatccttaccgctctggcatatcacgtcgtcgtaggtattcgccacatgatgatggattttggctatctggaagaaacattcgaagcgggtaaacgctccgccaaaatctcctttgttattactgtcgtgttttcacttctcgcaggagtcctcgtatggtaagcaacgcctccgcattaggacgcaatggcgtacatgatttcatcctcgttcgtgctaccgctatcgtcctgacgctctacatcatttatatggtcggttttttcgctaccagtggcgagctgacatatgaagtctggatcggtttcttcgcctctgcgttcaccaaagtgttcaccctgctggcgctgttttctatcttgatccatgcctggatcggcatgtggcaggtgttgaccgactacgttaaaccgctggccttgcgcctgatgctgcaactggtgattgtcgttgcactggtggtttacgtgatttatggattcgttgtggtgtggggtgtgtgatgaaattgccagtcagagaatttgatgcagttgtgattggtgctggcggcgcaggtatgcgcgcggcgctgcaaatttcccagagtggccagacctgtgcgctgctctctaaagtcttcccgacccgttcccataccgtttctgcgcaaggtggtattaccgttgcgctgggtaatacccatgaagataactgggaatggcatatgtacgacaccgtaaaagggtcggactatatcggtgaccaggacgcgattgaatatatgtgtaaaaccgggccggaagcgattctggaactggaacatatgggcctgccgttctcgcgtcttgatgatggtcgtatctatcaacgtccgtttggcggtcagtcgaaaaacttcggcggcgagcaggcggcacgtactgcggcggctgccgaccgtaccggtcacgcactgttgcacacgctttatcagcagaacctgaaaaaccacaccaccattttctccgagtggtatgcgctggatctggtgaaaaaccaggatggcgcagtggtcggttgtaccgcactgtgcatcgaaactggtgaagtggtttactttaaagctcgcgcgacagtgctggcgactggcggggcagggcgtatttatcagtccaccaccaacgcccacattaacactggcgacggtgtcggcatggctatccgtgcaggcgtaccggtacaggatatggaaatgtggcagttccacccgacaggtattgccggtgcgggcgtactggtcaccgaaggttgccgtggtgaaggcggttatctgctgaacaaacatggcgaacgctttatggaacgttatgcgccgaacgccaaagacctggcgggccgtgacgtggtggcgcgttccatcatgatcgaaatccgtgaaggccgcggctgtgatggtccgtgggggccacacgcaaaactgaaacttgaccatctgggtaaagaagttcttgaatcccgtctgccgggtatccttgaactctcccgcaccttcgctcacgtcgatccggtgaaagagccgattccggttatcccaacctgtcactacatgatgggcggtattccgaccaaagtgaccggtcaggcgctgactgtgaatgagaaaggcgaagatgtggttgttccggggctatttgccgttggtgaaatcgcttgtgtatcggtacatggcgctaaccgtctgggcggcaactcgctgctggacctggtcgtatttggtcgtgcggcaggtctgcatctgcaagagtctatcgccgagcagggcgcactgcgcgatgccagcgagtctgatgtagaagcgtctctggatcgcctgaaccgctggaacaataaccgtaacggtgaagatccggtggcgatccgtaaagcactgcaagaatgtatgcagcataacttctcggtcttccgtgaaggtgatgcgatggcgaaagggcttgagcagttgaaagttatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgcgatgatgaaaactggctgtgccactccctgtatctgccagagtcggaatccatgacgcgccgaagcgtcaacatggaaccgaaactgcgcccggcattcccgccgaagattcgtacttactaatgcggagacaggaaaatgagactcgagttttcaatttatcgctataacccggatgttgatgatgctccgcgtatgcaggattacaccctggaagcggaagaaggtcgtgacatgatgctgctggatgcgcttatccagctgaaagagaaagatcccagcctgtcgttccgccgctcctgccgtgaaggtgtgtgcggttccgacggtctgaacatgaacggtaagaatggtctggcctgtattaccccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggttgtatgaatgtattctctgcgcatgttgttcaacctcttgtccgtctttctggtggaatcccgataagtttatcggcccggcaggcttgttagcggcatatcgtttcctgatcgatagccgtgataccgagactgacagccgcctcgacggtttgagcgatgcattcagtgtattccgctgtcacagcatcatgaactgcgtcagtgtatgtccgaaggggctgaacccgacgcgcgccatcggccatatcaagtcgatgttgttgcaacgtaatgcgtaaacccaggcctgataagacgcgcaagcgtcgcatcaggcaaccagtgccggatgcggcgtgaacgccttatccggcctacaaaagaaatgcagaaaccgtaggcctgataagacgcgcaagcgtcgcatcaggcaaacagcgccggatgcggcgtgaatgccttatccggcctacaaaagaaatgcaggaaatctttaaaaactgcccctgacactaagacagtttttaaaggttccttagcggacgcagaaaacacgacaagtccgcaacaagtgaaccccggcacgcacatcagatatgaaatgtgcgtggtagtatccacggcgaagtaagcataaaaaagatgcttaagggatcacgatgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgaactgctggaagcactcaagcaaacctactgcggcccgattggtgccgagtatatgcacattaccagcactgaagaaaaacgctggatccaacagcgtattgagtctggtcgcgcgactttcaatagcgaagagaaaaaacgcttcttaagcgaactgaccgccgctgaaggccttgaacgttacctcggcgcaaaattccctggcgcaaaacgcttctcgctggaaggcggtgacgcgttaatcccgatgcttaaagagatgatccgccacgctggcaacagcggcacccgcgaagtggttctcggaatggcgcaccgtggtcgtctgaacgtgctggtgaacgtgctgggtaaaaaaccgcaagacttgttcgacgagtttgccggtaaacataaagaacacctcggcacgggcgacgtgaaataccacatgggcttctcgtctgacttccagaccgatggcggcctggttcacctggcgctggcgtttaacccgtctcaccttgagattgtaagcccggtcgttatcggttctgttcgtgcccgtctggacagacttgatgagccgagcagcaacaaagtgctgccaatcaccattcatggtgacgccgcagtgaccgggcagggcgtggttcaggaaaccctgaacatgtcgaaagcgcgtggttatgaagttggcggtacggtacgtatcgttatcaacaaccaggttggcttcaccacctctaacccgctggatgcccgttcgacgccgtactgtactgatatcggtaagatggttcaggcaccgattttccacgttaacgcggatgatccggaagccgttgcctttgttacccgtctggcgctcgatttccgtaacacctttaaacgtgatgtcttcatcgacctggtatgctaccgccgtcacggccacaacgaagccgacgagccgagcgcaacccagccgctgatgtatcagaaaatcaaaaaacatccgacgccgcgcaaaatctacgctgacaagctggagcaggaaaaagtcgcgacgctggaagatgccaccgagatggttaacctgtaccgcgatgcgctggatgctggcgattgcgttgtagcagagtggcgtccgatgaacatgcactctttcacctggtcgccgtacctcaaccatgaatgggacgaagagtacccgaacaaagttgagatgaagcgcctgcaggaactggctaaacgcatcagcacggtgccggaagcggttgaaatgcagtctcgcgttgccaagatttatggcgatcgccaggcgatggcagccggtgagaaactgttcgactggggcggcgcggaaaacctcgcttacgccacgttggttgacgaaggcattccggttcgcctgtcgggtgaagactccggtcgcggtaccttcttccaccgccacgcggtgatccacaaccagtctaacggttccacttacacgccgctgcaacatatccataacggccagggcgcgttccgcgtctgggactctgtactgtctgaagaagccgtactggcgtttgaatacggttatgccaccgcagaaccacgcaccctgaccatctgggaagcacagttcggtgacttcgccaacggtgcacaggtggttatcgaccagttcatctcctctggcgaacagaaatggggccggatgtgtggcctggtgatgttgctgccgcacggttacgaagggcaggggccggagcactcctccgcgcgtctggaacgttatctgcaactttgcgctgagcaaaacatgcaggtttgcgtaccttctaccccggcacaggtttaccacatgctgcgtcgtcaggcgttgcgcgggatgcgtcgtccactggtcgtgatgtcgccgaaatccctgctgcgtcatccgctggcggtatccagcctcgaagaactggcgaacggcaccttcctgccagccatcggtgaaatcgacgagcttgatctgaagggcgtgaagcgcgtagtgatgtgttctggtaaggtttattacgacctgctggaacaacgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccagcctccgcctctccggcggtagggtatatgtccgttcaccagaaacagcaacaagatctggttaatgacgcgctgaacgtcgaataaataaaggatacacaatgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcgcgggtaaagaaaccagcgccaaatctgaagagaaagcgtccactccggcgcaacgccagcaggcgtctctggaagagcaaaacaacgatgcgttaagcccggcgatccgtcgcctgctggctgaacataacctcgacgccagcgctattaaaggcacgggtgtgggtggtcgtctgacccgtgaagatgtggaaaaacatctggcgaaagccccggcgaaagagtctgctccggcagcgcctgctccggcggcgcaaccggccctggctgcacgtagcgaaaaacgtgtgccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcatccgtctgggctttatgtccttctacgtgaaagcggtggttgaagccctgaaacgttacccggaagtgaatgcgtctatcgacggtgatgatgtggtctaccacaactatttcgacgtcagtatggcggtttctacgccgcgcggtctggtgacgccggttctgcgtgatgtcgataccctcggcatggcagacatcgagaagaaaatcaaagagctggctgttaaaggccgtgacggcaagctgacggttgaagatctgacccggtggtaacttcaccatcaccaacggtggtgtgttcggttccctgatgtcaacgcctatcatcaacccaccgcagagcgcaattctgggtatgcacgctatcaaagatcgtccgatggcagtgaatggtcaggttgagatcctgccgatgatgtacctggcgctgtcctacgatcaccgtttgatcgatggtcgcgaatccgtgggcttccttgtaacgatcaaagagttgctggaagatccgacgcgtctgctgctggacgtgtagtagtttaagcttcacctgcactgtagaccgacgtggatagggtgtcggtctacggtttaaaagataacgattactgaaggatggacagaatacatgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgcgtggtctttatggcctccaccgaaggcggcgtggaaattgaaaaagtggcggaagaaactccgcacctgatccacaaagttgcgcttgatccgctgactggcccgatgccgtatcagggacgcgaactggcgtttaaactgggtctggaaggtaaactggttcagcagttcaccaaaatcttcatgggtctggcgaccattttcctggagcgcgacctggcgctgatcgaaatcaacccgctggttattaccaaacagggcgatctgatttgcctcgacggcaaactgggcgctgatggcaacgcactgttccgccagcctgatctgcgtgaaatgcgtgaccagtcgcaggaagatccgcgtgaagcacaggctgcacagtgggaactgaactacgttgcgctggacggtaacatcggttgtatggttaacggcgcaggtctggcaatgggtacgatggacatcgttaaactgcacggcggcgaaccggctaacttcctggacgttggcggcggcgcaaccaaagaacgtgtaaccgaagcgttcaaaatcatcctctctgacgacaaagtgaaagctgttctggttaacatcttcggcggtatcgttcgttgcgacctgatcgctgacggtatcatcggcgcggtagcggaagtgggtgttaacgtaccggtcgtggtacgtctggaaggtaacaacgccgaactcggtgcgaagaaactggctgacagcggcctgaatattattgcagcaaaaggtctgacggatgcagctcagcaggttgttgccgcagtggaggggaaataatgtccattttaattgataaaaacaccaaggttatctgccagggctttaccggtagccaggggactttccactcagaacaggctattgcatacggcactaaaatggttggcggcgtaaccccaggtaaaggcggcaccacccacctcggcctgccggtgttcaacaccgtgcgtgaagctgttgctgctactggcgctaccgcttctgttatctacgtaccagcaccgttctgcaaagactccattctggaagccatcgatgcaggcatcaaactgattatcaccatcactgaaggcatcccgacgctggatatgctgaccgtgaaagtgaaactggatgaagcaggcgttcgtatgatcggcccgaactgcccaggcgttatcaccccgggggaatgcaaaatcggtatccagccgggtcacattcacaaaccaggtaaagtgggtatcgtttcccgttccggtacgctgacctatgaagcggttaaacagaccacggattacggtttcggtcagtcgacctgtgttggtatcggcggcgacccgatccctggctctaactttatcgatatcctcgaaatgttcgaaaaagatccgcagaccgaagcgatcgtgatgatcggtgagatcggcggtagcgctgaagaagaagcagcggcgtacatcaaggaacacgttaccaagccagttgtgggttacatcgctggtgtgactgcgccgaaaggcaaacgtatgggtcacgcaggtgcgatcattgccggtggtaaagggactgcggatgagaaattcgctgctctggaagccgcaggcgtgaaaaccgttcgcagcctggcggatatcggtgaagcactgaaaactgttctgaaataaatatctgtaataagaaatagccctcgccgcttccccctacaggaagggcgaagggctgtcggtttcgacatggttggccatcttatgatggccttttttattcgggcactaatctgaaaagtttgcccactgcttttctcccatcctctgcgcaataatgcccggcaaaatatcccctctccgttctgtaaaagcatttatacaagaagaaaattgttctgccggttgctctggccctgatgggtgtaaattcggacgtttatgcggccgatgtaaatatcgatattttaagtgcgacagtgaaagataaacgcattgagggagtatcggtgacgctgcaacgcaatggcgcacaatctgtttctggaaccacaaatgcatcgggcagcgttaatctgggttctacatttgctgatgatcaagatgctttattgatcgtcaaaaaagagggctattctaatctggtggtcaaatgttcgtgtgctggcatgacttatgcgattagtccggcaatgactagtctggatggcatgcgtgtagttttgagctggggcgaaaagccttttgatcttgattcacatttgatcttccctggcggacatatctattttgatagtaaagaggggactgatgctaatctggatgttgatgatacggatagctatggatcagaaactgtcactatcagcaaaaagcattttggcgaaagttacatctatgccgtgcaggactatagcaacaaagggttgcccaacagtaattatctctctgccagtaaggcaaaagtgtttgtttatgtagggagctccctggtgcgtagttatagtgtccctgctggaaaacgagggaacatctggaccgtgtttaaactcaatccaaacggcgagtttgaagatatcaactctgttaccagcgccaattttaacgacaccacattaggcgtcagggatttagccactgtgataatgcctgcgacgggttcttcaactccggcttcacctgcgatgcaaaacagtggagatactcaactggcaagaaaatataatcgtgaaggcgaagctgtttacaaaaccggtcaacttgagcaagccattcaactcttccaacaggcaacagaattagacggcaattacggacaggcatttagtaacctggggctggcgtatcagaaaaatggcaacatcgcggaagcaatttgggcaaatcgtaaagcgatctcgttagccagtggagcaaatgcggcgacaacgcgcgctaactcctattataacattgccaaaatttatgaaactgctggacaggacgctgatgcattgcagcattatcaactcgctcttcacgatgccattttataaaaatgaaagtggaatcatattttttaattttatatgcttgcttgtttttctggtcaagttatccatcattcactgttttattatcttaaggatgatggaaataaaaggttttttaatgataataaaacatattcttatgttatttaatcacgaattttttaatatgattatgtatcaatacgttatattacccgatgtgctactgaattatcgactattactttaatatttagtgatcgtaaacatggttctccagattactaaatttctggcatcttacaatatcatcatcttcaaatagttaaattaagattatggcactgccaaaacagataaattgaagcagtctggtagatattgcagaacaaccttgattccaacggcgaaatcatgtttatcctccaggttgccgcccatatggagctgaatatcattcagtccacgcttgatgagttgatatcgctatatccatagacagggtagctttttacacgagagtgtccggtgttttctaacggctggcaatcattccgttttgttgtttcgtatcactgctataacaatttctcttgaatttcaatctttgagcgaatcattgaatacagatcgggaaatattaataccatatatattttattttgaaaatccttgttccatctgactatacctaaggtatctatttcttcttgtgattattaccaatgaaacaataagtgacggatttacagtacgttgctcataaagacaacaatcaattaacgttgataaaaatatgttatgtaaaatggcaataaagtagctactctaactaattagtattataaaaagtcgataaagcggctctgttaaataaaatactggttttttatctatatatttccatgtgggtaattttactgtgctattttgttacaataaattaacaataaagttaccagtggctcatgattcacacataattaacatatgtggttgattttgatataaatcaatttttaattcttgaaaaaaatctgcaaaacacgataaattgttgtagatcaaattggtgagatcgtgacaatttcgctataaattgatcactgtcgaaaaatgcaaattttgctcaataaaaacctgttttattgtaaggattttgcggcgtaatataattacgggatcaatttggtttattcattaacacatttgtaacttttttatcattgtcttttcctcttttgatgaaatggcaacgatagaggcgagcaaataattttgtattggggcatgcgtgtgaccctttctaacggggttcactctcggagtcttcatgcgatgagcaaggagtcatgatgttagatatagtcgaactgtcgcgcttacagtttgccttgaccgcgatgtaccacttcctttttgtgccactgacgctcggtatggcgttcctgctggccattatggaaacggtctacgtcctttccggcaaacagatttataaagatatgaccaagttctggggcaagttgtttggtatcaactttgctctgggtgtggctaccggtctgaccatggagttccagttcgggactaactggtcttactattcccactatgtaggggatatcttcggtgcgccgctggcaatcgaaggtctgatggccttcttcctcgaatccacctttgtaggtctgttcttcttcggttgggatcgtctgggtaaagttcagcatatgtgtgtcacctggctggtggcgctcggttcaaacctgtccgcactgtggattctggttgcaaacggctggatgcaaaacccaatcgcgtccgatttcaactttgaaactatgcgtatggagatggtgagcttctccgagctggtgcttaacccggttgctcaggtgaaattcgttcacaccgtagcttctggttatgtgactggcgcaatgttcatcctcggtatcagcgcatggtatatgctgaaaggtcgtgacttcgccttcgctaaacgctcctttgctatcgctgccagcttcggtatggctgccgttctgtctgttattgttctgggtgatgaatccggctacgaaatgggcgacgtgcagaaaaccaaactggctgctatcgaagccgagtgggaaacgcaacctgcacctgctgcctttactctgttcggcattcctgatcaggaagaggaaacgaacaaatttgcgatccagatcccttacgcgctgggcatcattgcaacgcgttccgtggatactccagttatcggtctgaaagaactgatggtgcagcatgaagaacgcattcgtaacgggatgaaggcgtactctctgctcgaacaactgcgttctggttctactgaccaggccgttcgtgaccagttcaatagcatgaagaaagatctcggttacggtctgctgctgaaacgctatacgccaaacgtggctgatgcgactgaagctcagattcaacaggcaaccaaagactccattccgcgtgtagcgccgctgtactttgcgttccgtatcatggtggcgtgtggcttcctgctgctggcaatcatcgcgctctctttctggagtgtcatccgcaaccgcattggcgagaaaaaatggctgctgcgcgccgcgctgtacggtattccgctgccgtggattgctgtagaagcgggctggttcgtggctgaatatggccgccaaccgtgggctatcggtgaagtgctgccgacagctgtggcgaactcgtcactgaccgcaggcgatctcatcttctcgatggtgctgatttgcggcctgtataccctgttcctggtggcagaattgttcttaatgttcaagtttgcacgcctcggcccaagcagcctgaaaaccggtcgctatcactttgagcagtcttccacgactactcagccggcacgctaagacaggagtcgtcaaatgatcgattatgaagtattgcgttttatctggtggctgctggttggcgttctgctgattggttttgcagtcactgacggtttcgacatgggggtgggcatgctcacccgtttcctcggtcgtaacgacaccgagcgtcgaattatgattaactccatcgcaccacactgggacggtaaccaggtttggctgatcaccgcaggcggcgcactgtttgctgcctggccgatggtctatgccgctgcgttctccggcttctatgtggcgatgatcctcgtgctggcgtctttgttcttccgtccggtcggttttgactaccgctccaagattgaagaaacccgctggcgtaacatgtgggactggggcatcttcattggtagcttcgttccgccgctggtgattggtgtagcgttcggtaacctgttgcagggcgtaccattcaacgttgatgaatatctgcgtctgtactacaccggtaacttcttccagctgcttaacccgttcggcctgctggcaggtgtggtgagcgtagggatgatcattactcagggcgcaacctatctgcaaatgcgtaccgtgggcgaactgcacctgcgtacccgtgcaacggctcaggtggcggcactggtgacgctggtctgcttcgcactggctggcgtatgggtgatgtacggtatcgatggttatgtcgtgaaatcgacaatggaccattacgcagcctctaacccgctgaataaagaagtggttcgtgaagctggcgcatggctggttaacttcaacaacacgccaattctgtgggctattccggcactgggtgtggttctgccgctgctgaccatcctgactgcacgtatggataaagccgcgtgggcgtttgtattctcctccctgacgctggcctgcatcatcctgactgccggtatcgcaatgttcccgtttgtgatgccgtccagcaccatgatgaacgcaagtctgacaatgtgggatgcaacttccagccagctgacgcttaacgtcatgacctgggttgcggtggttctggtaccgatcattctgctctacaccgcctggtgttactggaaaatgttcggtcgtatcaccaaagaagatattgaacgtaacacccactctctgtactaagtaaggagctaaaaatgtggtatttcgcatggattctgggaacgcttcttgcctgttcgtttggggtaatcaccgcgctggcgcttgagcacgtcgaatcaggcaaagccggtcaagaagacatctgatgagtaagattatcgcaaccttgtatgcggtaatggacaagcgccccctgcgggcgctttccttcgtgatggcacttctgttagcaggatgtatgttttgggacccatcacgtttcgccgcgaagaccagtgaactggaaatctggcatggcttactgcttatgtgggccgtctgtgctggtgtgattcacggcgtgggctttcgtccgcagaaggttctctggcaagggattttttgcccattgcttgccgatattgttctcattgtcgggctgattttcttcttcttttaaatcagaatctcttaannnnncattccattcattaattaattaatgaatgaatgnnnnncgcgtatagtagcagcgtttaaaagctctaacttttgttgcattaccgggatgtaaagtgaatacaacgctgtttcgatggccggttcgcgtctactatgaagataccgatgccggtggtgtggtgtaccacgccagttacgtcgctttttatgaaagagcacgcacagagatgctgcgtcatcatcatttcagtcaacaggcgctgatggctgaacgcgttgcctttgtggtacgtaaaatgacggtggaatattacgcacctgcgcggctcgacgatatgctcgaaatacagactgaaataacatcaatgcgtggcacctctttggttttcacgcaacgtattgtcaacgccgagaatactttgttgaatgaagcagaggttctggttgtttgcgttgacccactcaaaatgaagcctcgtgcgcttcccaagtctattgtcgcggagtttaagcagtgactgacatgaatatccttgatttgttcctgaaggctagccttctggttaaacttatcatgttgattttgattggtttttcaatcgcatcctgggccattattatccagcggacccgtattcttaacgcagcggcgcgcgaagccgaagcgtttgaagataaattctggtctggaatcgaactctctcgcctctatcaagagagccaggggaaacgggataatctgagcggttcggaacaaatcttttacagcggcttcaaagagtttgtgcgcctgcatcgtgccaatagccatgcgccggaagccgtagtggaaggggcgtcgcgtgcgatgcgtatttccatgaatcgtgaacttgaaaatctggaaacgcacattccgttcctcggtacggttggctccatcagcccgtatattggtctgtttggtacggtctgggggatcatgcacgcctttatcgccctcggggcggtaaaacaagcaacactgcaaatggttgcgcccggtatcgcagaagcgttgattgcgacggcaattggtttgttcgccgcaattccggcggtaatggcttataaccgcctaaaccagcgcgtaaacaaactggaactgaattacgacaactttatggaagagtttaccgcgattctgcaccgccaggcgtttaccgttagcgagagcaacaaggggtaagccatggccagagcgcgtggacgaggtcgtcgcgatctcaagtccgaaatcaacattgtaccgttgctggacgtactgctggtgctgttgctgatctttatggcgacagcgcccatcatcacccagagcgtggaggtcgatctgccagacgctactgaatcacaggcggtgagcagtaacgataatccgccagtgattgttgaagtgtctggtattggtcagtacaccgtggtggttgagaaagatcgtctggagcgtttaccaccagagcaggtggtggcggaagtgtccagccgtttcaaggccaacccgaaaacggtctttctgatcggtggcgcaaaagatgtgccttacgatgaaataattaaagcactgaacttgttacatagtgcgggtgtgaaatcggttggtttaatgacgcagcctatctaaacatctgcgtttcccttgcttgaaagagagcgggtaacaggcgaacagtttttggaaaccgagagtgtcaaaggcaaccgaacaaaacgacaagctcaagcgggcgataattatttcagcagtgctgcatgtcatcttatttgcggcgctgatctggagttcgttcgatgagaatatagaagcttcagccggaggcggcggtggttcgtccatcgacgctgtcatggttgattcaggtgcggtagttgagcagtacaaacgtatgcaaagccaggaatcaagcgcgaagcgttctgatgagcagcgcaagatgaaggagcagcaggctgctgaagaactgcgtgagaaacaagcggctgaacaggaacgcctgaagcaacttgagaaagagcggttagcggctcaggagcagaaaaagcaggctgaagaagccgcaaaacaggccgagttaaagcagaagcaagcggaagaggcggcagcgaaagcggcggcagatgctaaagcgaaggccgaagcggatgctaaagctgcggaagaagcagcgaagaaagcggcggcagacgcgaagaaaaaagcagaagcagaagccgccaaagccgcagtcgaagcgcagaaaaaagccgaggctgctgctgcggcgctgaagaagaaagctgaagcggcagaagcagctgcagctgaagcaagaaagaaagcggcaaccgaagctgctgaaaaagccaaggcagaagctgagaagaaagcggctgctgaaaaggctgcagctgataagaaagcggcagccgacaaaaaagcagcagaaaaagcggctgctgaaaaggcagcagctgataagaaagcagcggcagaaaaagccgccgcagacaaaaaagcggcagcggcaaaagcagcagctgaaaaagccgctgcagcaaaagctgccgcagaggcagatgatattttcggtgagctaagctctggtaagaatgcaccgaaaacgggggggaggggcgaaagggaacaatgcttcgcctgccgggagtggtaatactaaaaacaatggcgcatcaggggccgatatcaataactatgccgggcagattaaatctgctatcgaaagtaagttctatgacgcatcgtcctatgcaggcaaaacctgtacgctgcgcataaaactggcacccgatggtatgttactggatatcaaacctgaaggtggcgatcccgcactttgtcaagctgcgttggcagcagctaaacttgcgaagatcccgaaaccaccaagccaggcagtatatgaagtgttcaaaaacgcgccattggacttcaaaccgtaatcgcgatgttgactgttccgacggtcaacatcaggcaccggttgccacggggttctggtagttttgtgtattttagtttgttaacattctgctaaattatcgtgggccatcggtccagataagggagatatgatgaagcaggcattacgagtagcatttggttttctcatactgtgggcatcagttctgcatgctgaagtccgcattgtgatcgacagcggtgtagattccggtcgtcctattggtgttgttcctttccagtgggcggggcctggtgcggcacctgaagatattggcggcatcgttgctgctgacttgcgtaacagcggtaaatttaatccgttagatcgtgctcgtctgccacagcagccgggtagtgcgcaggaagtacaaccagctgcatggtccgcgctgggcattgacgctgtggttgtcggtcaggtcactccgaatccggatggttcttacaatgtcgcttatcaacttgttgacactggcggcgcaccgggtactgtacttgctcagaactcgtacaaagtgaacaagcagtggctgcgttatgctggtcataccgccagtgacgaagtatttgaaaaactgaccggtattaaaggtgcgttccgtacccgtattgcctacgttgttcagactaacggcggtcagttcccgtatgaactgcgcgtatctgactatgacggttacaaccagtttgtcgttcaccgttcaccgcaaccgctgatgtctccggcgtggtcaccagacggttctaaactggcttatgtgaccttcgaaagcggtcgttccgcgctggttattcagacgctggcaaatggcgctgtacgtcaggtggcttcattcccgcgtcacaacggtgcacctgcattctcgccagacggcagcaaactggcattcgccttgtcgaaaaccggtagcctgaacctgtacgtaatggatttggcttctggtcagatccgccaggtaactgatggtcgcagtaacaataccgaaccgacctggttcccggacagccagaacctggcatttacttctgaccaggccggtcgtccgcaggtttataaagtgaatatcaacggcggtgcgccacaacgtattacctgggaaggttcgcagaaccaggatgcggatgtcagcagcgacggtaaatttatggtaatggtcagctccaacggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtgataataattaattgaatagtaaaggaatcattgaaatgcaactgaacaaagtgctgaaagggctgatgattgctctgcctgttatggcaattgcggcatgttcttccaacaagaacgccagcaatgacggcagcgaaggcatgctgggtgccggcactggtatggatgcgaacggcggcaacggcaacatgtcttccgaagagcaggctcgtctgcaaatgcaacagctgcagcagaacaacatcgtttacttcgatctggacaagtacgatatccgttctgacttcgctcaaatgctggatgcacacgcaaacttcctgcgtagcaacccgtcttacaaagtcaccgtagaaggtcacgcggacgaacgtggtactccggaatacaacatctccctgggtgaacgtcgtgcgaacgctgttaagatgtatctgcagggtaaaggcgtttctgctgaccagatctccatcgtttcttacggtaaagaaaaacctgcagtactgggtcatgacgaagcggcgtatgccaaaaaccgtcgtgcggtactggtttactaagagaattgcatgagcagtaacttcagacatcaactattgagtctgtcgttactggttggtatagcggccccctgggccgcttttgctcaggcaccaatcagtagtgtcggctcaggctcggtcgaagaccgcgtcactcaacttgagcgtatttctaatgctcacagccagcttttaacccaactccagcaacaactctctgataatcaatccgatattgattccctgcgtggtcagattcaggaaaatcagtatcaactgaatcaggtcgtggagcggcaaaagcagatcctgttgcagatcgacagcctcagcagcggtggtgcagcggcgcaatcaaccagcggcgatcaaagcggtgtggcggcatcaacgacgccgacagctgatgctggtactgcgaatgctggcgcgccggtgaaaagcggtgatgcaaacacggattacaatgcagctattgcgctggtgcaggataaatcccgccaggatgacgcaatggtggcatttcagaatttcatcaaaaattaccctgattcaacttacctgccaaacgccaattattggctgggtcagttaaactacaacaagggtaaaaaagatgatgcggcgtattattttgcttcggtagtgaaaaactatccgaagtcaccgaaggctgcagatgcgatgtttaaagtcggcgtcatcatgcaggacaaaggtgacaccgcaaaagcgaaagccgtataccagcaggttatcagtaaataccctggtactgatggcgctaaacaggcgcaaaaacgtctgaacgcgatgtaatgcataacacacgaccagaagtcgcattatttctggtcgtgtcgtgcgaatcataagcagttgagtgatctacatcgaaatttttgttgcgctcaagtctgaaatcagtaatatatgccgccgttgccacgggatatcaaacaaaccgaaagcaacgaaaaagtgggtcgttagctcagttggtagagcagttgacttttaatcaattggtcgcaggttcgaatcctgcacgacccaccactaacatagttagttgtagtatccagcgtagtatcgggtgattagctcagctgggagagcacctcccttacaaggagggggtcggcggttcgatcccgtcatcacccaccaccgggtcgttagctcagttggtagagcagttgacttttaatcaattggtcgcaggttcgaatcctgcacgacccaccactgattacggtgggttcggtggaagtagtttgtagtatccagcgcagtatcgggtgattagctcagctgggagagcacctcccttacaaggagggggtcggcggttcgatcccgtcatcacccaccactcgggtcgttagctcagttggtagagcagttgacttttaatcaattggtcgcaggttcgaatcctgcacgacccaccaattttaaacattggttccgagtagaaatctttcaggtaacacccgtatgggtcgttagctcagttggtagagcagttgacttttaatcaattggtcgcaggttcgaatcctgcacgacccaccatcctgaatgattaaagcagcataatcccgcaaggggtcgttagctcagttggtagagcagttgacttttaatcaattggtcgcaggttcgaatcctgcacgacccaccaatgcaaaaaagcgccctaaaggcgcttttttgctattcaggcatctctcaatttcaattcttgaccctgatgacatactccgcgcttgctgcgtaaacaactctacgtcggaggaataagacgcaaagtgtggcattcggcatctcatacgtaattcgagtgacttttccccaccattcgactatcttgtttagcatataaaacaaattacgccgataatagcgaatatcacgcttaagtcggttttaacgttaagcctgtaaaacgagatggtaagatgagcgtgatgtttgatccagacacggcgatttatcctttccccccgaagccgacgccgttaagcattgatgaaaaagcgtattaccgcgagaagataaaacgtctactaaaagaacgtaatgcggtgatggttgcccactactataccgatcccgaaattcaacaactggcagaagaaaccggtggctgtatttctgattctctggaaatggcgcgcttcggtgcaaagcatcccgcttctacgttgttagttgctggggtgagatttatgggagaaaccgccaaaattctcagtccggaaaaaacaattctgatgccgacacttcaggctgaatgttcactggatctcggctgccctgttgaagaatttaacgcattttgcgatgcccatcccgatcgtactgtcgtcgtctacgccaacacttctgctgcggtaaaagcgcgcgcagattgggtggtaacttcaagcattgccgtcgaacttattgatcatctggatagtttgggtgaaaaaatcatctgggcacctgacaaacatctggggtgttacgtgcaaaaacagacgggcgcagacattttatgctggcagggtgcctgcattgtgcatgatgagtttaagactcaggcgttaacccgcttgcaagaagaatacccggatgctgccatactggtgcatccagaatcaccgcaagctattgtagagatggcggatgcggtcggttccaccagtcaactgatcgctgctgcgaaaacattgccacatcagcggcttatcgtggcaaccgatcggggcattttctacaaaatgcagcaggcggtgccagataaagagttactggaagcaccaaccgcgggtgagggcgcaacctgtcgcagctgcgcgcattgcccgtggatggccatgaatggccttcaggccatcgcagaggcattagaactggaaggaagcaatcacgaggtttatgttgatgaaaggctgctagagagggcgctggtgccgctcaatcgtatgctggattttgcggctacactacgtggataattgataataaggcgtcacattacgctttgggggaacgatggatttttttagtgtgcagaatatcctggtacatataccaataggggcaggcgggttatgatctctcatggatcgaagcggtaggcacgatcgccgggttgctgtgtattggccttgccagtctggagaagatcagtaactacttctttggcctgatcaacgtcaccttgtttggcattattttctttcagattcagctgtatgccagcctgctattacaggtgtttttctttgccgcgaatatttacggctggtatgcgtggtcgcgacaaaccagtcagaacgaggcggagttgaaaattcgctggttgccattgccgaaggcgctaagctggttggcggtttgcgttgtttcgattggtctgatgacggtatttatcaatccggtgtttgcatttttgacccgcgtggcagtcatgatcatgcaagcattaggattacaggttgcgatgcctgaactacagccggacgctttcccgttctgggattcatgcatgatggtgttatctatcgtggcaatgattctgatgacgcgtaagtatgtggaaaactggctgttgtgggtgattattaacgtgattagcgtcgttatttttgcacttcagggcgtttacgccatgtctctggagtacatcatcctgacctttattgccctcaacggcagccggatgtggatcaacagcgcacgcgaaagaggttcacgcgcgctgtcccattaatggtgatgatgtgaatggccagacaccccttcattcaggtggcagtctggcccatgacaaggttgatattccatctgaatagtggcgtgctcaatctgatagtgatccatcaggtagtgttggatctgatctaacaaggcatcgtgatcgtgtggcgggatcacctgcacatgcagcgtcatcaccggcttctcgcctaccatccatacatgcacatggtgcacattgcggacttccgggatttcccggcacaagcgacgcttcagttcagcgatatccagcgataccggtgcaccttcaagtaattcattcacactatctttcaacagtcgccacgcgctacgcagaaccagaagcgacaccagtattgagagaatggggtcagcaggtgtccagccggtccagataataatcaacgcggcaataatagccccaaccgaacccagcaggtccccgagcacatgcagtgccgctgctcgcacgttgaggtttttctcttcgctaccgtgatgaagtaaccagaaagaaagtatatttgccaacagcccagccacggcaattgccatcatcatgccgccctcgaccggacgcggtgtgcggaagcgttctatcgcctcccagacaatcaaaatggtaatcaccaccagggcgatagcattcacaaatgctgcgagcgtggtcaatcttagccaaccgaaagtgtggcgaatggtgggaggtcgacgtgaaaattgcacggcgagtagggcgaaaagcagggcggcagtatcggtcaacatatgacccgcatcggccagcaatgccagagaaccggaaagaaaaccgccaatgacttctacgagcataaacccggcagtcacgccgaaagcatacaacaagcgacgagcattattatcttctggcaggtgtgaggaagcgtgtgagtgtgagtgcgccatgacgagtcatcccttaattattctcacttaactttatgacatcatactgcttgtagaagggaaaaattaaaagggagagactccgctctcccattattggctattttgcagggttactgcgtggtaccgtcggttttggtatcgacatcattattgatgccatcaccagtttgtacctttttattgatatccgggcagcgaccatctttacacatggtgttcttgtgctcttcatctttggtcatgccgtcattgttcattgaagaaccatccggatgcagcattgtgccgtcggaaccggtatttaccccgttattgtcgacgttatttggcgcgacattttcacgggcgtcaggggctacctggcccgcatcagctgcggcgtttgcctggccgttattgctttgcgctccgctatcggcagccagtgcggcaccgctggcaaggcttagagtggcagtcaaaaatagtgtggccagttttgtcattttcataggatgctcctgttatggtcgttatgtcggataacctcttccaacagtgcatttgcaggtgaatatcaggcattggtttaagatttcagccagcttatgaaacgcagcagagaatcttgaaataattaacaaacaaaggagttacagttagaaattgtaggagagatctcgtttttcgcgacaatctggcgtttttcttgctaattccaggattaatccgttcatagtgtaaaaccccgtttacacattctgacggaagatatagattggaagtattgcattcactaagataagtatggcaacactggaacagacatgaattatcagaacgacgatttacgcatcaaagaaatcaaagagttacttcctcctgtcgcattgctggaaaaattccccgctactgaaaatgccgcgaatacggtcgcccatgcccgaaaagcgatccataagatcctgaaaggtaatgatgatcgcctgttggtggtgattggcccatgctcaattcatgatcctgtcgcggctaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataacagcttccagatcaacgacggtctgcgtattgcccgtaaattgctgcttgatattaacgacagcggtctgccagcggcgggtgagtttctcgatatgatcaccccacaatatctcgctgacctgatgagctggggcgcaattggtgcacgtaccaccgaatcgcaggtgcaccgcgaactggcgtctggtctttcttgtccggtaggtttcaaaaatggcactgatggtacgattaaagtggctatcgatgccattaatgccgccggtgcgccgcactgcttcctttcagtgaccaaatggggtcattcggcgattgtgaataccagcggtaacggcgattgccatatcattctgcgcggtggtaaagagcctaactacagcgcgaagcacgttgctgaagtgaaagaagggctgaacaaagcaggcctgccagcacaggtgatgatcgatttcagccatgctaactcgtcgaaacaattcaaaaagcagatggatgtttgtgctgacgtttgccagcagattgccggtggcgaaaaggccattattggcgtgatggtggaaagccatctggtggaaggcaatcagagcctcgagagcggggaaccgctggcctacggtaagagcatcaccgatgcctgcattggctgggatgataccgatgctctgttacgtcaactggcgaatgcagtaaacgcgcgtcgcgggtaaagtttaattgtcggatgcgccgtcagagtggcgtatccgattaatcaccggaggcctgataaaacgcgcagcgtcgcatcaggcaatgtgctccattggtagcaacgaaaaataaaaaagccgactcattttgcagtcggctttctcatttttaagcgaatgacgtttacttcgctttaccctggttagcaaccgccgctgctttcgccgcgatctcgtcagcattacccagataatagcgtttcagcggtttgaagttctcgtcaaactcataaaccagcggcacgccggtcgggatattcagctcaagaatctcttcttcgctcatgttatcgagatatttcaccagcgcacgtaacgagttaccgtgtgcggcgatgatgacgcgctcaccgctcttcatacgcggcagaatggtttcattccagtaagggatcacgcggtcaatggtcagcgccaggctttccgtcagcggcagttctttctcgctcagtttcgcgtaacgcggatcgtgacccggataacgctcatcatctttagtcagttccggcggagtcaccgcaaaaccacgacgccactgtttcacctgctcgtcgccatacttttcagcggtttccgctttgttcagaccctgcaacgcaccgtagtgacgttcgttcagtttccaggatttctcaacgggcagccatgcctgatccagttcgtccagcacattccacagggtatgaatagcgcgtttcagcacagaggtgtaagcaaagtcaaagctgtaaccttcctctttcagcagcttacctgctgcttttgcttcgcttacgcctttctcagacagatccacgtcgtaccaaccggtgaaacggttttctttgttccactgactttcgccatgacgaaccagaaccagcttagttacagccatatacttactcctcaaatcatcttttaatgataataattctcattatattgccgtgacgaagcaacagcaatgcttacgcataaccatagcgaaaatagtgtcgcagtgtaaggttgttgtgaatattgagttgcaaatatgtcggtgtttgctggtgatttgaacaatatgaagataaagccctcatgacgagggcttaacattactgagcaataaactgatattccgtcaggctggaatactcttcgccaggacgcaggaagcagtccggttgcggccattcagggtggttcgggctgtccggcagaaattcgctttccagagccagcccttgccagtcggcgtaaggttcggttccccgcgacggtgtgccgccgaggaagttgccggagtagaattgcagagccggagcggtggtgtagaccttcagctgcaatttttcatctgctgaccagacatgcgccgccactttcttgccatcgcctttggcctgtaacaagaacgcgtgatcgtaacctttcactttgcgctgatcgtcgtcggcaagaaactcactggcgatgattttggcgttgcggaaatcaaaagaggttccggcgacagatttcaggccgtcgtgcggaatgccgccttcatcaaccggcagatattcttccgccagaatctgcaacttgtgattgcgcacgtcagattgctcgccgtcaagattgaaatagacgtgattagtcatattcaccgggcaaggtttatcaactgtggcgcgataagtaatggagatacggttatcgtcggtcagacgatattgcaccgtcgcgccgagattacccgggaaaccctgatcgccatcatctgaactcagggcaaacagcacctgacgatcgttctggttcacaatctgccagcgacgtttgtcgaacccttccgggccgccatgcaattggttgacgccctgacttggtgaaagcgtcacggtttcaccgtcaaaggtataacggctattggcgatgcggttggcataacgaccaatagaggcccccagaaatgcggcctgatcctgatagcattccgggctggcgcagccaagcagcgcctcgcggacgctgccatcggaaagcggaatacgggcggaaagtaaagtcgcaccccagtccatcagcgtgactaccatccctgcgttgttacgcaaagttaacagtcggtacggctgaccatcgggtgccagtgcgggagtttcgttcagcactgtcctgctccttgtgatggtttacaaacgtaaaaagtctctttaatacctgtttttgcttcatattgttcagcgacagcttgctgtacggcaggcaccagctcttccgggaacaacgcgacgatacagccaccaaatccgccgccggtcatgcgtacgccacctttgtcgccaatcacagctttgacgatttctaccagagtgtcaatttgcggtacggtgatttcgaaatcatcgcgcatagaggcatgagactccgccatcaactcgcccatacgtttcaggtcgccttgctccagtgcgctggcagcttcaacggtgcgggcgttttcagtcaggatatgacgcacgcgtttcgccacgattgggtccagttcatgcgcaacagcgttgaactcttcaatggtgacatcgcgcagggctggctgctggaagaaacgcgcaccggtttcgcactgttcacgacgggtgttgtattcgctgccaaccagggtacgtttgaagttactgttgatgatgacgacagccacacctttgggcatggaaactgctttggtccccagtgagcggcagtcaatcagcaaggcatgatctttcttgccgagtgcggaaatcagttgatccatgattccacagttacagcctacaaactggttttctgcttcctgaccattaagcgcgatttgtgcgccgtccagcggcagatgataaagctgctgcaatacggttccgaccgcgacttccagtgaagcggaagaacttaaccctgcaccctgcggcacattgccgctgatcaccatgtccacaccgccgaagctgttgttacgcagttgcagatgtttcaccacgccacgaacgtagttagcccattgatagttttcatgcgcgacaatgggcgcatcgagggaaaactcgtcgagctgattttcataatcggctgccattacgcgaactttacggtcatcgcgtggcgcacagctgatcacggtttgataatcaatcgcgcagggcagaacgaaaccgtcgttgtagtcggtgtgttcaccaatcaaattcacgcggccaggcgcctgaatggtgtgagtggcagggtagccaaatgcgttggcaaacagagattgtgttttttctttcagactcatttcttacactccggattcgcgaaaatggatatcgctgactgcgcgcaaacgctctgctgcctgttctgcggtcaggtctcgctgggtttctgccagcatttcataaccaaccataaatttacgtacggtggcggagcgcaacagaggcggataaaagtgcgcgtgcagctgccagtgttgattctcttcgccattaaatggcgcgccgtgccagcccatagagtaggggaaggagcactggaagaggttgtcataacgactggttagctttttcaacgccagtgccaaatcgctgcgctgggcgtcggtcaaatcggtgatccgcaaaacgtgggctttgggcagcagtagcgtttcgaacggccaggcagcccagtaaggtacaacggctaaccagtgttcggtttcgacaacggtacggctaccgtctgccagctcgcgctgaacatagtccaccagcattggcgatttctgtgcggcgaaatattctttttgcagacggtcttcgcgctcagcttcgttaggcaggaagctatttgcccaaatctgtccgtgcggatgcgggttagagcagcccatcgccgcgcctttgttttcaaagacctgcacccatgggtacgtttcccccagctctgcggtttgctcctgccaggttttgacgatttccgtcaatgccgcaacgctcagttctggcaacgttttactgtgatccggtgaaaagcagatcacccggctggtaccgcgcgcgctctggcaacgcattagcggatcgttgctttctggcgcatctggcgtgtcagacatcaaggccgcaaagtcattagtgaaaacgtaagtcccggtgtaatcggggtttttatcgcctgtcacccgcacattacctgcgcagaggaagcaatctggatcgtgcgcaggtaacacctgtttggctggcgtttcctgcgccccctgccaggggcgcttagcgcggtgcggtgaaaccagaatccattgcccggtgagcgggttgtagcggcgatgtggatgatcaacgggattaaattgcgtcatggtcgttccttaatcgggatatccctgtggatggcgtgactgccagtgccaggtgtcctgcgccatttcatcgagtgtgcgcgttacgcgccagttcagttcatggttggctttgctggcgtccgcccagtaggccggaaggtcgccctcgcgacgcggtgcaaaatgataattaaccggtttgccgcaggctttgctgaaggcattaaccacgtccagcacgctgctgcccacgccagcgccgaggttgtagatgtgtacgcctggcttgttcgccagtttttccatcgccacgacgtgaccgtccgccagatccattacgtggatgtaatcgcgcacgccagtaccgtcttcggtcggataatcgttaccaaaaatcgccagcgagtcgcgacggcctacagcaacctgggcgatgtatggcatcaggttattcggaatgccttgcggatcttcgcccatatcgcccgacggatgcgcgccaactgggttgaagtagcgcagcagggcaatgctccagtccggctgggctttttgcagatcggtgaggatctgttccaccatcagcttgcttttgccgtaagggctttgcggtgtgccggtcgggaagctttcaacatatggaattttgggctgatcgccataaacggtggcggaggagctaaagataaagtttttgacgttagcggcgcgcatggcgctaatcaggcgcagagtaccgttgacattgttgtcgtaatattcaagcggtttttgtaccgattcgccaacggctttcagcccggcgaagtggatcacggtgtcgatagcgtgatcgtgcaggatctcggtcatcaacgcttcgttacggatatcgccttcaacaaacgttggatgtttgccgcctaaacgctcgataacaggcagtacgctgcgcttactgttacagaggttatcaagaatgatgacatcatgaccgttttgcagtaattgcacacaggtatgacttccaatgtaaccgctaccaccggtaaccagaactctcataattcgctccattaggcttatggtatgaaataaccatagcataacaaagatgcgaaaagtgtgacatggaataaattagtggaatcgtttacacaggaatttagccgttttttatgcgcgattaagtgattataaaacagcggctttatgaatgattgcgctttttatctgaaaaaaaagacgcggtttcatgcctggatgcgtcaaaccgttggccggataacacgtttacgccgcctccggcacggtcagcactaccgactcagtttatttttgtcagcgcatagcgataaaagtcaccgtccggcacgaactcaagacgatgggtaatacaggcaggcgcatcttcagcgtggtgcgaaacaaacaacaattgcgttttaccttcgctaatcagcacatcaacaaaacggcggataagctggcgattgagcggatcaagcccctgtagtggttcatcgagaataagcaacgtcggatgtttcactagcgcacggacgatcagcgccagacgctgctgtccccaggaaagactatggaaaggagcgtcagccgtgcgtttatcaatgccgagaatatccagccactgctgcaccagtttttgctggcgatccgaaacggcctgataaatgccaatcgaatcaaaatagccagaaagaatcacattacgcacagtagtgctgacccggtaatccagatgcaaactactgctgacgtaaccgatatgctttttgatatcccagatggtttcgccgctgccgcgacgtcgtccgaaaagcgtcaaatcgttgctgtaaccttgcggatgatcgccagtaatcaggcttaataacgtcgattttcccgcgccatttggcccgacaatttgccagtgttcgcctggattcacctgccagctaaggttattaagaatggggcgatcgttataagaaaccacgccattgttcagcacaatgcgcggttcgttggcgggtaaggcgtgacgtgctgaaggttcatctggctccggcatttgcacaccttcaagcagttcgctatgcgccagttgcgcaacgagtgcttgttggagcagttcttctttagcgccagtttccgctaacgtgcaatccgccagcacgccagcaaactggacaaattccgggatctcatcgaagcgattgagcaccagtaccagagtaataccggactgatgtaacgaggcgagtagctcagccagatgctgacgtgaggcaacatccaggccatcgaacggctcatcaaggatcaacaagtcaggctccgacatcagcgcctgacacagcagggtttttcgcgtctcgccagtggaaaggtatttaaagcgtcggtcgaggagggcggtaataccgaactgctgcgccagttgcatgcaacgcggagcatcctttacttcatcctgaatgatctcagccgtggtacgcccggtgtcatcttcgccaggactaagcatatcggtgttattccgctgccattcgtcgctgacgagcttttgcaattgctcgaaggagagacgagtgatgtgggaaaactggctttgccgttcacctttcaaaagcggaagttcccccgacagcgcgcgggccagcgccgatttcccgcttccattcgaaccgacaaacgcccaactatcacccgcgtttaacgttagccgaggcaattgcagcgtttttgtgtcgccaagacgaaacgtgccttgcaaaatttgcaacgatgacattttatatcccattttgtgcagcgattactgacagggatacgtgtttcataacaaattgtcaacacgcttagcacagcgtggcgataatcacgctgtcggcattaaagtaggccgtgacattctgtccttgctgaagagaagtcgcttcatttaccggcactgtggcgcacagtgtttgcccgtcgggtagcgccattaatacttcgcactgctctgcgccgcgctcaatatgactaataatacctggtaattggttgtcagcgttttgcgcgaccgcatcgtcctgagtaatacctacccacggcgcttttagcaatatcaacacttctttgccttcatccagccccagacgcgcgccgctttgtgcggtaactgcgactttcaggcgtgtttttccatcagccagtaagacatcaacatgctgttgaacgtcatcatgatcgcgggcggtgatggtaccgaaccactggttacgggcgctggtttgcagtgaaaaacgtgagatcgcggccagcaggctgttcagcggcagggcgtcatcgtcacttaacacatcaaaggctttttgctgtatttgcgccagtaagtcatagagctgaatcagtcgctgaccatagcgggtcagtactgcgccgccgccacctttaccgcctgttgcgcgctcaaccagaatatgctcacttaactgattcatctcgttaatggcatcccaggcgcttttatagctgataccggcatctttcgctccctggctaatggaaccggaaagcgcaatgtgttttagtagcgaaatgcggcgcgggtcggcgaataatttttgttggagcttaagggtgagaaggatttcggcctgcataacaatgtcctggcaaaagtcttattgtgacggaaaacgaacgccacgcaaagctgaccgcacaaaaggggagtgcttttctgtgcttagcggttagaatagtctcatgactatatctggagttgaccatgttagagttattaaaaagtctggtattcgccgtaatcatggtacctgtcgtgatggccatcatcctgggtctgatttacggtcttggtgaagtattcaacatcttttctggtgttggtaaaaaagaccagcccggacaaaatcattgattccctgaatgcccgcttagtcgggcattttctttttctcaacttcctgctttttctgccgatattttttctcatctacctcacaaaggttagcaataactgctgggaaaattccgaacttgccgttatattgacgcctacataacgttacattaaggggttaccaatggctcgtaaatggttgaacttgtttaccggggcggcactctctttcgctgttgctggcaatgcactggcagatgaagggaaaatcacggtgttcgccgccgcatcactgactaacgcaatgcaggacattgctacgcagtataaaaaagagaaaggcgtggatgtggtttcttctttcgcttcgtcatctactttggcccgtcagattgaagcgggtgcgcctgcggatctatttatttctgccgatcagaaatggatggattatgcggttgataaaaaagcgatcgatacggcttcgcgccagacactgctcggcaatagcctggtcgttgtagcaccgaaagccagcgagcagaaagatttcaccatcgacagcaaaaccaactggacttcgctgctgaatggcggtcgcctcgcggttggtgatccggaacatgtccctgctggcatttatgcgaaagaagcactgcaaaaactgggcgcatgggatacgctctccccgaaactggctccggcggaagatgttcgtggcgcgctggcgttggtcgaacgcaatgaagcgccgctgggtattgtttacggttctgacgcagttgccagcaaaggggtaaaagtggttgccaccttcccggaagattcacataaaaaagtggaatatccggttgctgttgtggaagggcataacaatgcgacagtgaaagcattttatgattatctgaaggggccgcaggctgcggaaatctttaaacgttacggatttacaaccaagtaatgatactgaccgatccagaatggcaggcagttttattaagcctgaaagtttcttccctggctgtgctgtttagcctgccgtttgggatcttttttgcctggttactggtacgttgcacgtttccgggcaaagctctgctcgacagtgtactgcatctaccgctggtgttaccgcccgtggtcgtcggttacctattattagtttcgatgggacggcgcggatttatcggtgaacgtctgtatgactggtttggtctttctttcgcgtttagctggcgcggtgcggttctcgctgccgctgtcatgtcttttccgctgatggtgcgggcgattcgtctggcgctggaaagtgttgatatcaaactggagcaggccgcaagaacactgggggccgggcgctggcgcgttttctttactatcacgttaccgctgaccttaccgggaattattgttggtacggtgctggcattcgctcgttcgctcggtgaatttggcgcaaccatcacctttgtgtcgaacattcctggtgaaacgcgaaccattccttctgccatgtataccctgatccagacccctggcggggaaagtggcgcggcgagactgtgtattatttctattgcgctggcgatgatctccctgttgatttcagaatggctggccagaatcagccgtgaacgggcggggcgctaatcatgctggaactgaatttttcccagacgttgggcaaccattgcctgacgattaatgaaacgctgcccgccaatggcatcaccgctatttttggtgtctctggtgccggaaaaacctcgctgattaacgccatcagtgggctgacacgtccgcaaaaagggcggattgtcctcaatggtcgggtactaaatgatgccgaaaaaggtatctgcctgtcgccggaaaagcgtcgcgttggctatgtttttcaggatgcgcggctgttcccgcattacaaagtgcgtggcaatctgcgctacggcatggcgaaaagcatggtcaatcagttcgataagctggtggcgcttttaggcattgaaccgttgcttgatcgtttaccaggcagcctgtccggaggcgaaaaacagcgcgtggcgattggtcgggctttgctgacagcaccggaattgctgttgctggatgaaccgctggcgtcactggatattccgcgtaaacgcgaactgttgccttatctgcaacgtctgacgcgggaaatcaacattccgatgttgtatgtcagccattcgctggatgagatcctccatctggcagacagagtgatggtactggaaaacggtcaggtgaaagcctttggcgcgctggaggaagtgtggggcagtagcgtgatgaatccgtggctgccgaaagagcaacaaagtagcattctgaaagtgacggtgcttgagcatcatccgcattacgcgatgaccgcgctggcgctgggcgatcagcatttgtgggttaataagctggacgaaccgctgcaagctgcgctacgtatccgcattcaggcttccgatgtttctctggttttacaaccgccgcagcaaaccagcattcgtaacgtattgcgggcaaaagttgttaatagttatgacgacaacggccaggtggaagtggagctggaagtcggcggtaaaacgctgtgggcgcgtatcagcccgtgggccagggatgaactggcgatcaaacctggcctgtggctgtacgcgcaaattaaaagtgtgtcgataaccgcctgattaaatcaggtggctataaatgaactgggcaatgctgtcggtggtgttatcaccaatcacaatgttggcgcgcgcttttaccgcgtcatcggcgttgcccatcgccacgcctgtaccagcggcctccagcatactgatatcattaaagttatcgccgaaggccacgacgttttccatcgaccagccttgcgcctcaacccatttcgtcaaacgtttacctttgctgttgccgccgcgtgcaatatcaacctgatcgtgccaggaccattcacactcaagtcccagttcatgttcgacatgcttaccaaaatgctgcaattgcggcaggtcatcgtgcgtcagggcgaacttccatacggcgttaacttgttgcgccgtttcagccagagaagcgacttgtgtgaaagtcggacgctgttccggcggcagggtttgcgcccagttagacgtgcgaatgacatgcccggtcgggtgctcatagaccatcgcatcatccacatacatcagaccgtgaatgtggtgttcattcagcatctcaatgagttgcagggctttattaacgggcattgggtccgcttccagcactgtttttgcatgataatcatacaaataggtgccattacagcaaatagcaggtgtatccagcgccagcgcctgataaaaaggatgaatagcgacgtgatggcgacctgtgacgatgattaattgatagcctgcttcgcgagcgcgggccagggcttctatcgatgaaggaagcagggtctttttcggggtcaataaggtgccgtctaagtcgagagcaatcacgcgtgtggtcatggcgtattccagattaaggttaagaattttcttctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaacctgaatcatgaaggcgcactgacgctgacacaggtagtcgatgtgccggggcaggtgcagccgatggtggtcagcccggacaaacgctatctctatgttggtgttcgccctgagtttcgcgtcctggcgtatcgtatcgccccggacgatggcgcgctgacctttgctgcagagtctgcgctgccggggagcccgacgcatatttccaccgatcacctggggcagtttgtctttgtcggttcttataatgcgggtaacgtgagcgtaacgcgtctggaagatggcctgccagtgggcgtcgtcgatgtggtcgaggggctggacggttgccattccgccaatatctcaccggacaaccgtacgttgtgggttccggcattaaagcaggatcgcatttgcctgtttacggtcagcgatgatggtcatctggtagcgcaggaccctgcggaagtgactaccgttgaaggggccggcccgcgtcatatggtattccatccaaacgaacaatatgcctattgcgtcaatgagttaaacagctcagtggatgtctgggaactgaaagatccgcacggcaatatcgaatgtgtccagacgctggatatgatgccggaaaacttctccgacacccgttgggcggctgatattcatatcaccccggatggtcgtcatttatacgcctgcgaccgtaccgccagtctgattaccgttttcagcgtttcggaagatggcagcgtgttgagtaaagaaggcttccagccaacggaaacccagccgcgcggcttcaatgttgatcacagcggcaagtatctgattgccgccgggcaaaaatctcaccacatctcggtatacgaaattgttggcgagcaggggctactgcatgaaaaaggccgctatgcggttgggcaggggccaatgtgggtagtggtcaacgcgcactaaccgctgatttaaccggcgcagtctctcctgcgccggtgtattaacctatctcctgtaacgcatgtctctggcgttcgacgatattggtccacaaattgtctttatcgtcagtccacaaattaatcagcaaggcaaaaaagcgttcagctgccggagaaagcacggcatctttgcggcgaataatccccaatgtccgacgtataacgggttccaccagtgggataccaataatcgaagaatagggcgcatggggcattgccagaccaggaagcgccgaaatccccagtcccgcctccaccagccctaatgacgtcgaaagatgacgcacttcgtaaaaccagtccagcttccagggcttgtcggctagctgttgttctatcaatagtcggttgccgctggaggagcgtacgccaatcattttgtaacccactaactcctgccattctacaagctgctttttggccaatggatggtcacgccgacaggccagcacgaacggctcgttgaccagtggggtaaaatcaatggatgaatttgtgacgttgttcatgtttatgccaaagtctgattcgttacacagcaccgattccatgcaattattcgtgccttgttccagaatccgcactttaatattgggatacagctcattaaatttaccgattgccagcggtaaaaaataaaatactgcggtcggaatacacgctaacgtcaccataccacgatgataagcattcatatcacgaatattaaaaagcgtttcatcgaatttttttattaattcccgcgcctccgggagcaacctttttcctgcttttgttaacgtaaccttgcgagttgtacgctcaaatagttgaatgtgtaaatcttcctccatcttttttattcttcgcgttaatgcaggttgcgtaatattgagtaatttagcagcattgttaaatgaactggactctgccagtatgacaaatgccttcatacttgataattcatgcttcattattactccggaaaatggaagcgtcgattttgggtggctggccattaaaaattttaactgcatttagccaacttaaattaatgaaaaaatgttattaatcgttgagctaaagtcattagagatgctttgcccttaatgtaaccatatcgcaataagttatgtttttaaattgagggcattattatgaaaaaaataccctgcgtgatgatgcgaggtggaacctcgaggggcgcgttcctgttagcggaacatttacccgaagatcaaacgcagcgcgataaaatattgatggcaattatgggttccggtaacgatctggaaattgacggtattggcggcggtaatccgctgaccagtaaagtcgccattattagccgctccagcgatccgcatgcagatgtcgattatctgtttgctcaagttatcgtccatgagcaacgtgtcgataccacgcctaactgcggcaatatgctgtctggcgttggggcattcgccattgaaaatggtttgattgcagcgacttcgccagttacccgcgtacgtatccgcaacgtcaatacgggtacgttcatcgaagctgatgtgcaaacgccaaatggtgttgtcgagtacgagggtagcgccagaattgacggcgtaccgggtactgccgcaccggttgcgctcactttcctgaatgccgccggaacgaaaaccggaaaagtcttcccgactgataatcagattgattattttgacgatgtcccggtgacctgtatcgatatggcgatgccagttgtcattattcctgctgaatatctgggaaaaacaggctatgaattaccggcagagctggatgccgacaaagcattattagcccgcattgaatctatccgtctacaagcgggtaaagcaatgggcttaggcgatgtcagtaatatggttatccctaaacctgtacttatttctccagcgcagaaaggcggggcaattaatgtgcgttattttatgccgcattcttgccatcgcgctttggcgataaccggtgctattgctatttccagtagttgtgcattggaaggtaccgtcacccgacaaatcgtcccttctgtaggatacggcaatatcaatattgaacaccccagtggtgcgctcgacgttcatttaagtaatgaaggtcaggatgccacgacgttacgcgcatctgttattcggacgaccagaaaaatattttccggtgaagtttatcttccctgaaaaattttgttgtcgtgataatgatactcaataaaggaattctgtatgagtcatacagaaagaacaggatattaaatgaataaaaaatcgttatggaagctaattctgatattagcgatcccatgtattattggctttatgccagctccggcaggattaagcgaactggcgtgggtgctttttggtatttacctggcggccattgtggggctggttatcaagcctttcccggaacctgtcgtactgttaattgccgtcgccgcatcgatggtcgtggtgggtaacttatcaggtggggaatttaaaaccaccgccgtattaagcggttactcttccggtaccacctggctggtgttttctgcgtttactttaagcgccgcgtttgtaaccacaggcttaggtaaacgtattgcctatctgctgattggtaaaattggtagcactaccctgggtctgggttacgttacggtatttctcgatctggtactggctccggcaacaccgtctaacaccgcgcgtgcgggcggcatcgtgttaccgatcatcaacagcgtggcagtggctttgggatcagaaccggaaaaaagtccgcgtcgtgttggacattacctgatgatgtccatttacatggtcaccaaaaccaccagctatatgttctttaccgcaatggcggggaacattctggcgctgaaaatgatcaacgacattctgcacctgcaaattagctggggtggatgggcgttagccgccggattgccgggcatcattatgctgctggtcaccccgctggtgatttacaccatgtatccaccagaaattaagaaggtggataacaaaaccatcgctaaagcgggccttgccgaactgggaccgatgaaaatccgcgaaaaaatgctgctcggtgtctttgtactggcgctgctgggctggattttcagtaagtctctgggggttgatgaatccaccgtggcaatcgttgttatggcaactatgctgctgctgggcatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcatcatcgtgcgttatttcttcgcttctggtagtgcctatatcgttgccatgttaccggtatttgccatgctggcgaacgtctccggcgcaccgttaatgttaaccgcgctggcactgttgttctctaactcctatggcggcatggttactcactatggcggcgcggcaggtccggtcatctttggcgtgggttacaacgatattaaatcctggtggttggtcggtgcggtactgacgatattaaccttcctggtgcatatcaccctcggcgtgtggtggtggaatatgctgatcggctggaacatgctgtaaatatactcgtcatacttcaagttgcatgtgctgcgtctgcgttcgctcaccccagtcacttacttatgtaagctcctggggattcactcgcttgtcgccttcctgcaactcgaattatttagagtatatccatttattatctttctgcgcacttcacggtgcgcagatatctggagcatttgatgatcaagttatctgaaaaaggcgtgtttctcgccagcaataacgaaataattgccgaagaacatttcaccggcgaaataaaaaaagaagaagcaaaaaaaggcactattgcctggtctattctctcttctcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgtgctgtgggcggcaccattaacggtgatgaccatgtttttggtttatcggcggcccagcgttatggcggtatttttgtgccaccgcatattgcggtcatccatcaatatatgcgtgaaatgatggcgggcggcggcaaaatgatcctcggatcagacagccatacccgttacggtgcgttagggacaatggcggttggcgagggcggcggcgagttggtaaaacagctgcttaatgacacctgggatatcgactatccgggcgtggttgcggtgcatctgaccggaaaacctgcgccgtatgtggggccgcaggatgtggcgctggctatcatcggtgccgtgttcaaaaacggttacgtcaaaaacaaagtgatggagttcgtaggtcccggtgttgcagcgctctctaccgatttccgtaacagcgttgacgtgatgaccactgaaacgacctgtttaagttctgtctggcaaaccgatgaagaagtccataactggctggcgctgcacggtcgcggccaggattactgccaacttaaccctcaaccaatggcgtactacgatggcagcatcagcgttgatttaagcgccatcaaaccaatgattgcgctgccattccacccgagcaacgtgtatgaaatcgacacgctgaaccagaatctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcgctgcgcggtcaatcctgcggcaacgataccttctcgttggcggtttacccgtcatcacagccggtgtttatggatctcgccaaaaaaggtgtggtagcagatttgattggcgcaggcgcaatcatcagaaccgcgttctgcggcccatgctttggtgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaactcgattgctgggacaacgtgccggagtacgccttcgatgtaacgccgtataaaaatcgcgtctatcaaggctttgtgaaaggggcgacccagcaaccgctgatctacggaccgaacatcaaagactggccggaattgggcgcgctgactgacaatatcgtcctcaaagtgtgctcgaagatcctcgacgaagtaaccaccaccgacgaactgattccttccggtgaaacctcttcttatcgttcaaatccgattggtctggcggagtttaccctgtcacgccgcgatccaggttatgttggcagaagtaaagcgactgctgagctggaaaatcagcgtctggcgggaaatgtcagtgagctggcagatatgtttgcgcgcattaagcagattgctggtcaggaacatgttgatccgctgcaaactgaaattggcagcatggtttatgcggtgaaaccaggcgatggttctgcgcgtgaacaggcggcgagttgtcagcgtgtgattggcggtctggcgaatattgccgaggagtacgcgactaaacgctatcgttctaacgtcatcaactgggggatgttaccgctgcagatggcggaagtaccgaactttgacgtaggtgattacatttatatccctggcattaaagcggcgctggataatcctggaacgacgtttaaaggttatgtgatccatgaagatgcaccggtaacggagattacgctctatatggaaagtctgactgctgaagagcgcgagattatcaaggcgggtagtttgattaacttcaataaaaaccgtcagatgtaaaaagcgccatgtgaatgtaggtcgcatccggcacttattgtcggatgcgatgctggcgcatcttatccgaccgacaaatcgcatcgaaccgtaggccggataaggcgtttacgccgcatccggcacatagttaacagctcctacttcttcgcctctgcaaccactttgctacccacgccgcggttattgtattcccacatgcggttgtagttagtgtcattcagattgcgctgtacttcgtcgttatcatcaacgctgccggtgttacccgcaaacggacgattagagatcaccgcatcagcccacggtttggctgtgttaaaaccttcgttgatggcgctatcacggatcactacctgaccgttggtattggcatcaacatccagcgagcggcccagttgcgccacgccatcaccggaagcattgaaacggctgtttacggcgaggaaaccgtagtaaatgttggacagcgtagccggtgcaaacacatacgcttcttgctgggtacgggagttcaccacgcggaattcggtgttatcgaacaccactgcgccgcgaccagaaacgatatccacatccccttcaatatagctgttggtcaccagcgtacgcggctggcgattcgtttccagacggttctgcacaccgctgttggtgacaaagaaggtgttctgacgaccgagaatgttgacgttattgatctgcactttgtcgccatcagtacgcagtgccaccgccggatggttacccgcatctacgctatcgcccagcgtgttttcgatggtcaggttttgcagttgcaggccattgttttgtgaccagaagaccgcagagcagagaacaccgatactgtcgctgcgtttactctggcagctatcgtacatataccacgccggtttacctggcatatatttgccgcgcgggttgacgtcgtgacgccagtcggcagggctcatgccaccatcaagggaaagcccaatcttcacatcaatcggtttttcacctgtaccgtacagagtaattccacccggagcggcagggacatacaccgttccctgatactcaccaggcatcacggcaatatactggcgcttgttggtacgcttgataattgccgcatctaccgccgcctgaatcgtggtatgcgttacaccttgagtacccgccgggccgacaacaaagtcaggttgcgcaggcagggtaatcggggaaggattccacgctgccgcacctggtgtcagggatgcaaaatagtgttgagcatcgaaattctgcgcttcttttgccgacagaatcgggcgcgaagaggtaccaggcgcggtttgatcagaaggacgttgatcgggcggtgttgagctacaggcggtcagcgtcacgccaaaagccaatgccagcgccagacgggaaactgaaaatgtgttcacaggttgctccgggctatgaaatagaaaaatgaatccgttgaagcctgcttttttatactaacttgagcgaaacgggaaggtaaaaagacaaaaagttgtttttaatacctttaagtgataccagatggcattgcgccatctggcagagtgattaactaaacatcgcagtaatcgaggcactcgccagagagtgaaaatgaacgttaaacccgaccatcgcgccgctggcaccttcatcgacatcaatacgttctacatccagcgcgtgaacggtaaaaatgtagcgatgggtttcgcctttcggcggcgctgcgccatcgtacccggttttaccaaagtcggtacgcgtctgcaaaacgccgtctggcatagctaccagaccagagccaaacccttgcggtaatacgcgggtatcagcgggtaaattaacaactacccagtgccaccagccggagccggttggcgcatccgggtcatagcaggtgacaacaaaacttttcgttcccacaggaacatcatcccacgccagatgcggtgaaatattatcgccatcgtaacccatgccgttaaagacatgacgatgcggcagcttatcgccatcgcgcagatcgttactgatgagtttcatgaaccctcctttcttgtttgcagaaagtgtagccagaaaccctcacgctgacttcccgttattggcaaaaaaatgtttcatcctgcaccgcacggttaaccgctgcggtcagacgctgcaactgttgcgggagaataatatagggcggcatcaggtaaatcagtttgccaaaaggccggatccagacaccctgttcgacaaagaatttttgcagcgctgccatattcaccggacgagtggtttcgaccacgccgattgcccccagtacgcgcacatcggcaaccatttcggcgtcacaggcgggggcaagttgctcgcgtagctgcgcttcaatagccgccacctgatgctgccagtcgccagattcaagaatcgccaggctggcgtttgctgctgcgcaggccagcggattgcccataaaagttggcccatgcataaagcagccggcttcgccgttactgatggtttccgcaacctcgcgcgtggtgagcgtggcggaaagggtcattgtgccgccggttaaggctttaccgagacacaaaatatccggcgcgatttctgcatgttcacaggcaaacagtttgccggtacgaccaaatccggtggcgatctcgtcggcaatcagcaagataccttcgcgatcgcacattttgcggattcgttttaaccattccggatggtacatgcgcatcccgcctgcgccctggacaatcggttcaatgatcaccgccgcgatttcatgacgatgcgctgccatcaggcgggcaaagcccaccatatcgcgctcatcccattcgccatccatgcggctttgcggggcgggagcaaacaggttttctggcagatagcctttccacaggctgtgcattgagttgtccggatcgcacaccgacatcgcgccaaaggtatcgccatgataaccattgcggaaggttagaaaacgctggcgcgcttcgcctttggcctgccagtactgcaacgccattttcatcgccacttctaccgctacggagccggagtccgcgagaaaaacgcactccagcggttgcggcgtcattgccaccaatttgcggcacagctcaatggcgggcgcatgggtgataccgccaaacatcacatgcgacatagcatcaatttgcgacttcatcgccgcattaagctgcgggtgattgtaaccgtggatcgccgcccaccaggacgacataccgtcaaccaggcgcctgccgtcagacaaaattagctcgcaaccttcggcgcttgccaccggataaaccggcagcggggaggtcatggatgtgtatgggtgccagatatggcgttggtcaaaggcaagatcgtccgttgtcataatcgacttgtaaaccaaattgaaaagatttaggtttacgagtctacaccgaattaacaacaaaaaacacgttttggagaagccccatggctcaccgcccacgctggacattgtcgcaagtcacagaattatttgaaaaaccgttgctggatctgctgtttgaagcgcagcaggtgcatcgtcagcatttcgatcctcgtcaggtgcaggtcagcactttgctgtcgattaagaccggagcttgtccggaagattgcaaatattgcccgcaaagctcgcgctacaaaaccgggctggaagccgagcggttgatggaagttgaacaggtgctggagtcggcgcgcaaagcgaaagcggcgggatcgacgcgtttctgtatgggcgcggcgtggaagaatccccacgaacgcgatatgccgtacctggaacaaatggtgcagggggtaaaagcgatgggtctggaggcgtgtatgacgctgggcacgttgagtgaatctcaagcgcagcgcctggcgaatgccgggctggattactataaccacaacctcgacacctcgccggagttttacggcaatatcatcaccacccgcacctatcaggaacgtctcgatacgctggaaaaagtgcgagaagctgggattaaagtctgttcaggtggcattgtgggcttaggcgaaacggtgaaagatcgcgccggattattactgcaactggcaaacctgccgacgccgccggaaagcgtgccaatcaacatgctggtgaaggtgaaaggcacaccgctggcggataacgatgatgtcgatgcctttgattttattcgcaccattgccgtagcgcggatcatgatgccgacctcttacgtacgcctttctgccggacgcgagcagatgaacgaacagactcaggcgatgtgctttatggctggcgcaaactcgattttctacggttgcaaactgctgactacgccgaatccggaagaagataaagacctgcaactgttccgcaaactggggctaaatccgcagcaaactgccgtgctggcgggcgataacgaacaacagcagcgtctggagcaggcgctgatgaccccggacactgacgaatattacaacgcggcagcactatgatctggcaggagaaaatcgacgcggcgcttgatgcgcggcgtgttgctgatgccttgcgtcgccgttatccggtggcacaaggagccggacgctggctggtggcagatgattgccagtatctgaacttttccagtaacgattatttaggtttaagccatcatccgcaaattatccgcgcctggcagcagggcgcggatcaatttggtgtcggtagcggcggttccggtcacgtcagcggttatagcgtggcgcaccaggtgctggaagaagaactggccgaatggctgggctattcgcgggcgctgctgtttatttctggttttgccgctaatcaggctgtcattgccgcgatgatggcgaaagaggaccgtattgttgccgaccggcttagccatgcctcattgctggaggctgcaagtttaagcccgtcgccgcttcgccgttttgctcataacgatgtcactcatctggcgcgactgcttgcttccccctgtccggggcagcaactggtagtgacagaaggtgtgttcagcatggacggcgatagtgcgccactggaggaaatccagcaggtaacgcaacagcacgatggctggttgatggtcgatgacgcccacggcacgggcgttatcggggagcaggggcgtggcagctgctggctgcaaaaggtaaaaccagaattgctggtggtgacgtttggcaaaggatttggcgtcagcggggcagcggtgctttgctccaatacggtggcggattatctgctgcaattcgctcgccatcttatctacagcaccagtatgccgcccgctcaggcgcaggcattacgtgcgtcgctggcggtcattcgcagtgatgagggggatgcacggcgcgaaaaactggcggcactcattacgcgttttcgtgccggagtgcaggatttgccgtttacgcttgctggctcatgcagcgccatccagccattgatcgtcggtgataacagccgtgcgttacaactggcagaaaaactgcgccagcaaggctgctgggtcacggcgattcgcccgccaaccgtacccgctggtactgcgcgactgcgcttaacgctaaccgcagcgcatgaaatgcaggatatcgaccgtctgctggaggtgctgcatggcaacggttaataaacaagccattgctgcggcatttggacgggcagccgcacactatgagcaacacgccgatctacagcgccagagtgctgacgccttactggcaatgctcccacagcgtaaatacacccgcgtactggatgcgggttgtggaccaggctggatgagccgccgctggcgagagcgtcacgcgcaggtgactgcgttagatctctctccgccaatgcttgttcaggcacgccagaaggatgccgcagaccattatctggcgggagatatcgaatccctgccgttagcgactgcgacgttcgatcttgcatggagcaatctcgcggtgcagtggtgcggtaatttatccacggcactccgcgagctgtatcgggtggtgcgccccggaggcgtggtcgcgtttaccacgctggtgcagggatcgttacccgaactgcatcaggcgtggcaggcggtggacgagcgtccgcatgctaatcgctttttaccgccagatgaaatcgaacagtcgctaaacgccgtgcattatcaacattatattcagcccatcacgctgtggtttgatgatgcgctcagtgccatgcgttcgctgaaaggcatcggtgccacgcatcttcatgaagggcgtgacccgcgaatattaacgcgttcgcagttgcagcgattgcaactggcctggccgcaacaacaggggcgatatcctctgacgtatcatctttttttgggagtgattgctcgtgagtaaatgttattttgtcaccggaacggataccgaagtggggaaaactgtcgccagctgcgcgcttttacaagccgcaaaggcagcaggctaccggacggcaggttacaaaccggtggcctctggcagcgaaaagaccccgaaaggcttacgtaatagtgacgcgctggcgttacagcgcaacagtagcctgcagctggattacgcaacggtaaatccttacaccttcgcagaacccacctcgccgcatatcatcagcgcgcaagagggcaggccgatagaagcattggtaatgagcgccggattacgcgcgcttgaacaacaggctgactgggtgttagtggaaggtgctggcggctggtttacgccgctttctgacactttcacttttgcggattgggtaacacaggaacaactgccagtgatactggttgtgggcgtgaaactcggctgtattaatcacgcgatgttgactgcgcaggcaatactacacgccggactgactctggcggggtgggtggcgaacgatgtcacgcctccgggaaaacgtcacgctgaatatatgaccacgctcacccgcatgattcccgcgccgctgctgggcgaaattccctggcttgcagaaaatccagaaaatgcggcaaccggaaagtacatcaatcttgccttaatgtagtcatcctgtacttggttaaattgtgagcgagatcgcgtctccgattgactgcaatttaaccaattaaattctaaaaannnnncattccattcattaattaattaatgaatgaatgnnnnnaggcacagatgcgcgatggtggtctgtctccggaggtggacgatgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcaggtcagtatgttgcgtgttgggttcagcgcagagtttaaacaggtggtgaactgatgcaggatatccggcaggaaacactgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggaggcagtatcaggcgtatcccattcaggggagcggttttgaactgaatggcaaaggcaccagtacgcggcccacgctggcagtctctaacctgtacggcatggtcaccggtatggtggaagatatgcagagtctggtcggcggaacggtggtccggcgtaaggtttacgcccgttttctggatgcggtgaacttcgtcaacggaaacagagacgccgatccggagcaggaggtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtgcggttatcacggtccggcagtcgcggatgaatatgaccagccgacgtccgatatcacgaaggataaatgcagcaaatgcctgagcggctgtaagtttcgcaataacgtcggcaactttggcggcttcctttccattaacaaactttcgcagtaatcccatgacagagacagaatcagcgattctggcgcacgcccggcgatgtgcgccagcggagtcgtgcggcttcgtggtaagcacgccggagggggaaagatatttcccctgcgtgaatatctccggtgagccggaggcgtatttccggatggctccggaggactggctgcaggcagagatgcagggtgagattgtggcgctggtccacagccaccccggtggtctgccctggctgagtgaggctgaccggcggctgcaggtgcagagcgatttgccgtggtggctggtctgccggggggcgattcacaagttccgctgtgtgccgcatctcaccgggcggcgctttgagtacggggtgacagactgttacacactgttccgggatgcttaccatctgggcggggattgagatgccggattttcatcnnnnncattccattcattaattaattaatgaatgaatgnnnnngtatgctggtcctgtccagagccgggcaggcggcagggctgacgtttaaccagaccagcgagtcactcagcgcactggttaaggcgggagtaagcggtgaggctcagattgcatccatcagccagagtgtggcgcgtttctcctctgcatccggcgtggaggtggacaaggtcgctgaagccttcgggaagctgaccactgacccgacgtcggggctgacggcgatggcgcgccagttccataacgtaacggcggagcagattgcgtatgttgctcagttgcagcgttccggcgatgaatccggggcattgcaggcggcgaacgaggccgcaacgaaagggtttgatgaccagacccgacgcctgaaagagaacatgggcacgctggaaacctgggcagacaggacagcacgggcattcaaatccatgtgggatgcggtgctggatattggtcgtcctgataccgctcaggagatgctgattaaggcagaggctgcgtttaagaaagcggacgacatctggaatctgcgcaaggatgattattttgttaacgatgaagcgcgggcgcgttactgggatgatcgtgaaaaggcccgtcttgcgcttgaagccgcccgaaagaaggctgaacagcagagtcaacaggacaaaaatgcgcagcagcagagcgataccgaagcatcacggctgaaatataccgaagaggcgcagaaggcttacgaacggctgcagacaccgctggagaaatataccgcccgtcaggaagaactgaacaaggcactgaaagacgggaaaatcctgcaggcagattacaacacgctgatggcggcggcgaaaaaggattatgaagcgacgctgaaaaagccgaaacagtccggcgtgaaggtgtctgcgggcgatcgtcaggaagacagtgctcatgctgccctgctgacgcttcaggctgaactccggacgctggagaagcatgccggagcaaatgagaaaatcagccagcagcgccgggatttgtggaaggcggagagtcagttcgcggtactggaggaggcggcgcaacgtcgccagctgtctgcacaggagaaatccctgctggcgcataaagatgagacgctggagtacaaacgccagctggctgcacttggcgacaaggttacgtatcaggagcgcctgaacgcgctggcgcagcaggcggataaattcgcacagcagcaacgggcaaaacgggccgctattgatgcgaaaagccgggggctgactgaccggcaggcagaacgggaagccacggaacagcgcctgaaggaacagtatggcgataatcctctggcgctgaataacgtcatgtcagagcagaaaaagacctgggcggctgaagacctgcttcgcgggaactggatggcaggcctgaagtccggctggagtgagtgggaagagagtgccacggacagtatgtcgcaggttaaaagtgctgccacgcagacctttgatggtattgcgcagaatatggcggcgatgctgaccggcagtgaacagaactggcgcagcttcacccgttccgtgctgtccatgatgacagaaattctgcttaagcaggcaatggtggggattgtcgggagtatcggcagcgctattggcggggctgttggtggcggcgcatccgcgtcaggcggtacagccattcaggccgctgcggcgaaactccattttgcaaccggaggatttacgggaaccggcggcaaatatgagccagcggggattgttcaccgtggtgaatttgtcttcacgaaggaggcaaccagccggattggcgtgggaaatctctaccggctgatgcgcggctatgccaccggcggttatgtcggtggcaccggaagtccggcgcaaatgcggcgttcagagggtatcaggtttgagcagaacaacaacgtggtgattcagaacgacggtacgaatggtctgccaggtccacagatgatgaaggcggtgtatgacatggcccgcaagggtgcccgtgatgaaatccaggcacagatgcgcgatggtggtctgttctccggaggtggacgatgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcgggtcagtatgctgcgtgttgagttcagcgcagagtttgaacaggtggtgaactgatgcaggatatccggcaggaaacattgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggcgacagtatcagccgtatcccattcaggggagtagttttgaactgaatggcaaaggcaccagtacgcgccccacgctgacggtttctaacctgtacggtatggtcaccgggatggtggaagatctgcagagtctggtcggcggaacggtggtcaggcgtaaggtttacgcccgttttctggatgcggtgaacttcgtcaacggaaacagcgacgccgatccggagcaggaggtgatcagccgctggcgcatcgagcagtgcagcgaactgagtgcggtcagtgcctcctttgtactgtccacaccgacggaaacggatggtgccgtttttccggggcgcatcatgctggctaatacctgcacctggacctatcgcggtgatgagtgcggttatcacggtccggcggtcgcggatgaatatgatcagccgacttccgatatcacgaaggataaatgcagcaaatgcctgagcggctgtaagtttcgcaataacgtcggcaactttggcggcttcctttccattaacaaactttcgcagtaaatcccatgacagagacagaatcagcgattctggcgcatgcccggcgatgtgcgccagcggagtcgtgcggcttcgtggtgagagcgccggagggggaaagatattttccctgcgtgaatatctccggtgagccggaggcgtatttccggatggctccggaggactggctgcaggcagagatgcagggtgagattgtggcgctggtccacagtcatcccggtggtctgccctggctgagtgaggccgaccggcggctgcaggtgcagagtgatttgccgtggtggctggtctgccggggggcgattcataagttccgctgtgtgccgcatctcaccgggcggcgctttgagcacggggtgacggactgttacacgctgttccgggacgcttaccatctggcggggattgagatgccggactttcatcgtgaggatgactggtggcgtaacggccagaatctctatcttgataatctggaggccacagggctgtatcaggtgccgttgtcagcggcgcagccgggcgatgtgctgctgtgctgctttggttcatcggtgccgaatcatgccgctatttactgtggtgacggcgagctgctgcaccatattcctgaacaactgagtaaacgagagaggtataccgacaaatggcagcgacgcacacactccctctggcgtcaccgggcatggcgcgcatctgcctttacgggatttacaacgatttggccgccgcatcgannnnncattccattcattaattaattaatgaatgaatgnnnnnggatggtggaagatctgcagagtctggtcggcggaacggtggtcaggcgtaaggtttacgcccgttttctggatgcggtgaacttcgtcaacggaaacagcgacgccgatccggagcaggaggtgatcagccgctggcgcatcgagcagtgcagcgaactgagtgcggtcagtgcctcctttgtactgtccacaccgacggaaacggatggtgccgtttttccggggcgcatcatgctggctaatacctgcacctggacctatcgcggtgatgagtgcggttatcacggtccggcggtcgcggatgaatatgatcagccgacttccgatatcacgaaggataaatgcagcaaatgcctgagcggctgtaagtttcgcaataacgtcggcaactttggcggcttcctttccattaacaaactttcgcagtaaatcccatgacagagacagaatcagcgattctggcgcatgcccggcgatgtgcgccagcggagtcgtgcggcttcgtggtgagagcgccggagggggaaagatattttccctgcgtgaatatctccggtgagccggaggcgtatttccggatggctccggaggactggctgcaggcagagatgcagggtgagattgtggcgctggtccacagtcatcccggtggtctgccctggctgagtgaggccgaccggcggctgcaggtgcagagtgatttgccgtggtggctggtctgccggggggcgattcataagttccgctgtgtgccgcatctcaccgggcggcgctttgagcacggggtgacggactgttacacgctgttccgggacgcttaccatctggcggggattgagatgccggactttcatcgtgaggatgactggtggcgtaacggccagaatctctatcttgataatctggaggccacagggctgtatcaggtgccgttgtcagcggcgcagccgggcgatgtgctgctgtgctgctttggttcatcggtgccgaatcatgccgctatttactgtggtgacggcgagctgctgcaccatattcctgaacaactgagtaaacgagagaggtataccgacaaatggcagcgacgcacacactccctctggcgtcaccgggcatggcgcgcatctgcctttacggggatttacaacgatttggccgccgcatcgannnnncattccattcattaattaattaatgaatgaatgnnnnnctggtcggcggaacggtggtccggcgtaaggtttacgcccgttttctggatgcggtgaacttcgtcaacggaaacagagacgccgatccggagcaggaggtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtgcggttatcacggtccggcagtcgcggatgaatatgaccagccgacgtccgatatcacgaaggataaatgcagcaaatgcctgagcggctgtaagtttcgcaataacgtcggcaactttggcggcttcctttccattaacaaactttcgcagtaatcccatgacagagacagaatcagcgattctggcgcacgcccggcgatgtgcgccagcggagtcgtgcggcttcgtggtaagcacgccggagggggaaagatatttcccctgcgtgaatatctccggtgagccggaggcgtatttccggatggctccggaggactggctgcaggcagagatgcagggtgagattgtggcgctggtccacagccaccccggtggtctgccctggctgagtgaggctgaccggcggctgcaggtgcagagcgatttgccgtggtggctggtctgccggggggcgattcacaagttccgctgtgtgccgcatctcaccgggcggcgctttgagtacggggtgacagactgttacacactgttccgggatgcttaccatctggcggggattgagatgccggattttcatcgcggggatgactggtggcgtcacggtcagaatctctatcttgacaatatggaggctactggtttttaccgtgtcgcactgacagaggcgcagccgggcgatgtgctgctgtgctgttttggttcatcggtgccgaatcacgccgccatttactgcggcgacggtgagctgctgcaccatattcctgaacaactgagtaaacgagagaggtataccgacaaatggcagcgacgcacacactccctctggcgtcaccgggaatggcacgcatctgcctttacggggatttgcaacgatttggccgccgcatcgaccttcgtgtgaaaacgggggctgaagccatnnnnncattccattcattaattaattaatgaatgaatgnnnnngcttcctttccattaacaaactttcgcagtaatcccatgacagagacagaatcagcgattctggcgcacgcccggcgatgtgcgccagcggagtcgtgcggcttcgtggtaagcacgccggagggggaaagatattttccctgcgtgaatatctccggtgagccggaggcgtatttccggatggctccggaggactggctgcgggcagaaatgcagggtgagattgtggcgctggtccacagtcaccccggtggtctgccctggctgagtgaggccgatcggcggctgcaggtgcagagtgatttgccgtggtggctggtctgccgcggggcgattcacaagttccgctgtgtgccacatcttaccgggcggcgctttgagcacggggtgacggactgttacacgctgttccgggatgcataccatctggcgggaattgagatgccggattttcatcgcggagatgactggtggcgtaacggccagaatctctatcttgacaatatggaggcgactggtttttaccgtgtcgcactgacagaggcgcagccgggcgatgtgctgctgtgctgttttggttcatcggtgccgaatcatgccgccatttactgtggtgatggcgagctgctgcaccatattcctgaacaactgagcaaacgagagaggtataccgacaaatggcagcgacgcacacactccctctggcgtcaccgggcatggcacgcatctgcctttacggggatttacaacgatttggccgccgcatcgaccttcgtgtgaaaacgggggctgaagccatccgggcgctggccacgcagcttccgtcgtttcgccagaaactgaatgagggctggtatcaggtgcgcattgccgggcgtgatgcaggcgaaaatgaattatctgcccgtcttaatgaaccgctggcaaatggtgccgtgattcacatcgtgccgcgtctggcgggagctaaaagtggcggtgtgtttcaggtggtgctgggggcggcgctgattgcggtggcatggtggaaccctgtgggctggctgggtgctgcggctgtatcgggcatgtatgcggcaggggccagtatgattctgggtggtgtggcccagatgctggcaccgaaagccaggacgcccacggcagccagtacagataacggcaaacagaacacctatttctcctcactggataacatggttgctcagggcaatgttctgcctgttctgtacggtgaaatgcgtgtggggtcgcgggtggtttctcaggagatcagcacggcagacgaaggtgacggtggtcaggttgtggtgattggtcgctgatgcaaaatgttttatgtgaaaccgcctgcgggcggttttgtcgtttatggagcatgacgaatgggtaaaggcagcagtaaggggcataccccgcgcgaagcgaaggacaacctgaagtccacgcagttgctgagtgtgatcgatgccatcagcgaagggccggttgaaggtccggtggatgggttaaaaagcgtgctgctgaacagtacgccggtgctggacagtgaggggaataccaatatctccggtgtcacggtggtgttccgggcaggtgagcaggagcagacaccgccggaggggtttgaatcctccggttccgagacggtgctgggtacggaagtgaaatatgacacgccgatcacccgcaccattacgtcggcaaacatcgaccgactgcgctttaccttcggtgtgcaggcactggtggaaaccacttcaaagggtgaccggaatccgtcggaagtccgcctgctggttcagatacagcgtaacggtggctgggtgacggaaaaagacatcaccattaagggcaaaaccacctcgcagtatctggcctcggtggtggtggataacctgccgccgcgcccgtttaatatccggatgcgcaggatgacgccggacagcaccacagaccagctgcagaacaaaannnnncattccattcattaattaattaatgaatgaatgnnnnntccctgcgtgaatatctccggtgagccggaggcgtatttccggatggctccggaggactggctgcaggcagagatgcagggtgagattgtggcgctggtccacagtcatcccggtggtctgccctggctgagtgaggccgaccggcggctgcaggtgcagagtgatttgccgtggtggctggtctgccggggggcgattcataagttccgctgtgtgccgcatctcaccgggcggcgctttgagcacggggtgacggactgttacacgctgttccgggacgcttaccatctggcggggattgagatgccggactttcatcgtgaggatgactggtggcgtaacggccagaatctctatcttgataatctggaggccacagggctgtatcaggtgccgttgtcagcggcgcagccgggcgatgtgctgctgtgctgctttggttcatcggtgccgaatcatgccgctatttactgtggtgacggcgagctgctgcaccatattcctgaacaactgagtaaacgagagaggtataccgacaaatggcagcgacgcacacactccctctggcgtcaccgggcatggcgcgcatctgcctttacggggatttacaacgatttggccgccgcatcgaccttcgtgtgaaaacgggggctgaagccatccgcgcactggccacacagctcccggtgtttcgtcagaaactgagcgacggctggtatcaggtacggattgccgggcgggacgtcagcacgtccgggttaacggcgcagttacatgagactctgcctgatggcgctgtgattcatattgttcccagagtcgccggggccaagtcaggtggcgtattccagattgtcctgggggctgccgccattgccggatcattctttaccgccggagccacccttgcagcatggggggcagccattggggccggtggtatgaccggcatcctgttttctctcggtgccagtatggtgctcggtggtgtggcgcagatgctggcaccgaaagccagaactccccgtacacagacaacggataacggcaaacagaacacctatttctcctcactggataacatggttgcccagggcaatgttctgccggttctgtacggtgaaatgcgcgtggggtcacgcgtggtttctcaggagatcagcacggcagacgaaggggatggtggtcaggttgtggtgattggtcgctgatgcaaaatgttttatgtgaaaccgcctccgggcggttttatcgtttatggagcatgacgaatgggtaaaggcagcagtaaggggcataccccgcgcgaagcgaaggacaacctgaaatccacgcagctgctgagtgtgattgatgccatcagcgaagggccggttgaaggtccggtggatggattaaaaagcgtgctgctgaacagtacgccggtgctggacagtgaggggaataccaatatatccggcgtcacggtggtgttccgggcaggtgagcaggagcagtcaccgccggagggatttgaatcctccggctccgagacggtgctgggtacggaagtgaaatatgacacgccgatcacccgcaccattacgtcggcaaacatcgaccgtctgcgctttaccttcggtgtacaggcactggtggaaaccacctcaaagggtgaccggaatccgtcggaagtccgcctgctggttcagatacagcgtaacggtggctgggtgacggaaaaagacatcaccattaagggcaaaaccacctcgcagtatctggcctcggtggtggtgggtaacctgccgccgcgcccgttcaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgccctgaaggaccgccataatgccgttgaggtgaactggattgacccggataacggctgggagacggcgacagagcttgtggaggacacgcaggccattgcccgttacggtcgtaacgtcacgaagatggatgcctttggctgtaccagccgggggcaggcacaccgcgccgggctgtggctgattaaaacggaactgctggaaacgcagaccgtggacttcagcgtgggtgcagaagggcttcgccatgtaccgggcgatgtcattgaaatctgcgatgatgactatgcgggtatcagcaccggcgggcgcgtgctggcggtgaacagccagacccggacgctgacgctcgaccgtgaaatcacgctgccatcctccggcaccacgctgataagcctggttgacggacaggggaatccggtcagcgtggaggtccagtccgtcaccgacggcgtgaaggtgaaagtgagccgtgttcctgacggcgttgcagaatacagcgtgtgggggctgaagctgccgacgctgcgccagcgcctgttccgctgtgtgagtatccgtgagaacgacgacggcacgtatgccatcactgccgtgcagcatgtaccggaaaaagaggccatcgtggataacggggcgcactttgacggcgaccagagcggcacggtgaatggtgtcacgccgccagcagtgcagcatctgaccgccgaagtcactgcagacagcggggaatatcaggtgctggcgcgatgggacacaccgaaggtggtgaagggcgtgagcttcatgctccgtctgaccgtgacagcggatgacggcagtgagcggctgatcagcacagccaggacgacggaaaccacataccgcttcacacaactggcgctggggaactacaggctgacagtccgggcggtaaatgcatgggggcagcagggcgatccggcatcggtatcgttccggattgccgcaccggcagcgccgtcgcagattgagctgacaccggggtattttcagataaccgccacgccgcatcttgcggtttatgatccgacggtacagtttgagttctggttctcggaaaagcggattgcggatatcaggcaggttgaaaccacagcacgctatccttggcacggcgctgtactggatagccgccagtatcaatatcaaaccgggccatgattattatttttacatccgcagtgtgaacaccgttggcaaatcggcatttgtggaggctgttggccagccgagtgatgatgcatccggctatctgaattttttcaaaggagagatagggaaaacccatctggctcaggagttgtggacgcagattgataacggtcagcttgcgcctgacctggctgaaatcaggacgtccattacgggtgtcagcaatgaaatcacgcagaccgtcaataagaaactggaagaccagagtgcagcgatccagcagatacagaaggttcaggttgatacaaataataacctgaacagcatgtgggctgtgaagctgcagcagatgcaggacggacgcctttatatcgcgggtattggtgccggtgttgagaatactcctgacggtatgcagagtcaggtgctgctggcggcggacaggattgcgatgattaatcctgcgaatggcaacacaaagccgatgtttgttgggcagggcgatcagatattcatgaacgaagtgttcctgaaatatctgacggctcccaccattaccagcggtggcaatcccccaacgttttcactgacacctgatggtcgactttctgcgaaaaatgcggatatcagcggtaacgtgaacgcgaactccgggacgctcaacaacgtcacgattaatcagaactgtcggattctgggaaaactgtcagctaaccagattgaaggtgatattgtcaaaacggtgggaaaagcctttccgagaaatggcagttatgccagcggtacaataacggtcactgtgtacgatgaccaggcttttgaccgtcagatagtagtcccccccgttctgtttcgtgggggtaagcatgaaaacttcaacagcaacaaccaacagtcatactggtattcaacctgtaagctgcaggtactgaagaacggacaggaaatctttcagcaacccgcgacggatgtcagcagggtattttcatcagtcattgatatgcctgccggacacggccatgtcaccctgactttcaatgtttcttcatatggtgctaataactggacgccaacgaccagtatcagcgaccttcttgttgttgtgatgaagaaatctacagccggtatcagtatcagttgaattttataacccagatacgggcgccagaaatggcgccttttttatttgtggagtgaatatggcagtacagatttcaggcgtgctgaaagacggtgcaggaaaaccgatacagaactgcaccattcagctcaaagcaaaacgtaacagcaccacggttgtggtgaacacggtggcctcagaaaatccggatgaagccggacgttacagcatggatgtcgagtatggccagtacagcgttatcctgctggttgaaggttttccgccttcacatgccggggccatcaccgtgtatgaggattctaagccggggacattgaatgattttctgggcgctgcaacagaagatgatgttcgtccggaggcactgtatcgttttgaaaagatggtggaagaggtggcacgcaacgctgaagccgcctctcagagcgcagcggcagcaaagaaatcagaaacagcagcggcatcgtccaggaatgcggcgaaaacatcagagacgaatgcaggtaacagcgcgaaagcggcagcttcttcaaaaacagccgcacaaaacgcagcaacagcggcagaacgttcagagacaaatgcccgtgcgtcagaagaagcctccgcagacagtgaagaggcttcccgccgtaatgcagagtcagccgctgaaaatgccggagtcgccaccacaaaagcgcgggaggccgcagcagacgcaacaaaggccgggcagaaaaaggatgaggctctgtcggcagcgacacgggctgaaaaggcggcagaccgcgcagaagtcgcagcggaagtgactgcagagccctatgcgaatatagtgccgccgctgcctgatgtgtggataccgtttaacgattcactggatatgattgcgggtttttctccgggctataaaaaaatagctattggtgacgatgtggttcaggtcgccagtgataaacaggttaatttcagtcgcgcatcaacggcaacatatatcaacaaatctggcgaactgaaaacggcggaaattaatgagccgcgatttgagtgtgatggcctgcttattgagggacaaagaacgaactacatgctcaattcggaaagtccagccagctgggggaagtcatcaaacatggatgtgcccgaaaccgggacagatagttttggttttacttatggaaagtttgtctgcaacgattctctggttgggcaaacttcggctattaatatggcatcaattgctgcaacaaagtcagttgatgtctcaggcgataacaagtacgtgacaacctcatgccgttttaaaacagaacgacaggtaaggttacgtatacggtttgataagtatgatggtagtgcaacaacttttcttggcgatgcgtacattgatacgcaaacgcttgaaattaatatgacaggtggggctgccggcagaattacggcacgagtcaggaaggataagaccacaggctggatttttgcagaggcaacgattcaggcaattgatggtgagttaaaaataggctctcagatacagtattctcctgagcggggtggggcaacagtatctggtgactatatttatcttgccaccccacaagtagagaatgggccgtgtgtatcatcatttattatttcaggaggcagcgcaacgacaagagccagtgatttggttagtatccccaccagaaataatctttataagttaccatttacttttttacttgagattcataaaaactgggatattgcaccaaacgccgcaccccgcgtgtgggatatagcagcagccaataccgggcaatcagcaattgcagcaatcaacagaggtagtggtaagttatatatgagtctgtcaaacccttcaggcttgtatgttaatagcgcagcgacagatgtatttgcagagaaaaccacatttggatgtattgcaaaagctgatggtcactttcatgtggtgacaaatggtaaagcggttaatgaagtttattgtgaatataatggtgtgaccgctgataaaaatatccgatttggagggcagacgaatactggagaacgacatctgtttggccatattcgcaatttccgcatatggcataaagaattaaatgacaggcaattaaaagaggtcgtatgaaagatttaactttgaagtttcatgacaaactgcagtttaaggccttcctgtcatctcttgactgggaggaggatgaagacctccagaataaactgttagtcgatgaaattggtttcacctacacagaaacaggggtaacagaagagggagaacctgtctgtgtccggaatgacggttattttgtcaacattcgcattcttgatgacttgtttgatgtttctgtattctctgattatgtcgtggagctggaaacaccgcttcgggaatggagctgaaaggaggaaataatggatataagccccttacttcatgcgctttgtgctgtggctgcgcagatactggttggtctttttaccggaaactgggcttacggagcgatagccggttgtacgttcttcattgcgcgtgaacatacccaggcagaatatcgctggattgaaatgttcgggcatggcaagcgaatgaatatgccgtggtggggcggttttgatccgcgagcttgggatgtggcaagcctgatggattttgctgtgccggtggtggcgtgtctgctggtctggctgttggttaatcgtgggtgaaaaaaggtgagctgtatatgcaacggaggaagaaaccccgttgctggaagccaggaaaaagtatcgggtgttgctgtcctcggatgttgtgctaattgggtgataacagatcctgtgtatgggagtttccctttttgcgtgcgttgatgctggtaacggcaaacgtcatgatgaacaaaaccgcgaataagacgacaatcgtcggagctggtgcgctgtcgataaaaaaggacaaccagacaccagtcattgacactattaccgatatgccagtcgccagtaggagcgcaatatgaaagcgttgtgtcaggagtaccgcaatggcgccaggcgcaatgagcagagaaatggagagaatgatacctaccgctttcagcgtcgccacaatggtcagagagaccatgcacagcagcccataatgcagccatctcgtatgcaaaccgcttacctgcgcctgttgataatcaaagctgaacagcaaaaaatcccgccattttacgctaataacaagtgtaaccagcccggcaataatcatcgtctggattatatcgccgatggttatcccgagcatgtcgccgaaaagaatatggtcaagatgtacgtctggtttgactgcaatatacaagatcagacctgcggcaaacatgccagaaaaaacaatccccatcactgtatcttgcttgattcggctgttgtctttcaggtatcccgtcgccaccgcgcagaatactccggcgacgaatgcccctgtagccaaaggtaaccccagaatccaggcaagcacgattccaggaaaaaccgcatgactcatcgcgtcacccatcagtgcccaacctttcaggaccagaaagaccgacagcagcgcacagggtatggaaactaccagtgaaatcagcagtgcgtgactcataaaggtgaactgcagtggctccagtaataatgccatcatgagcgatcctccagcgccttatgcgcacgccgacgatttgccaaaagcccatgggtgggcgcaaagacaaatgctaaaagaaacagcagtgtctgcgccaccacgatgattccacctgtcgcgccgtccagaaagtaactgacccacgcgccgaggaaactggtcacactgccaatagttacagcaatcatgagcaggcggggaaaacgatcggttaacaaccatgctgttgcaccgggagtcaccaccagacagatcaccagaaaggcaccaaccgtttgcagcgccgcaacggtcgaaaccgacagcagggtgaagaagatgagttttaatctgcccggatgcaatccaatagcacgggcgtgattctcgtcgaaaaaggtcaccataagatctttccatttgaaaaaaagcacgatgatcgagagaatgccaatgatagtgagttgcaggatatccgccggatcgattgccagaatattgcccaggacgatggtctgaatgttcacagatgtcgggttcaatgacaccataaacagccccaggccaaaaaaggacgagaagatcagaccgatgatggcatcttcttttaagcgggtgcgttggttaagaaacagcatgctgcccgcagccagtccgccggaaaagaaggctcccagagaaaacggaagccccagcatatatgcccccgcaacacccgggacaatagagtgcgacaacgcatcgccaatcagcgaccagccttttagcatcagatagcatgacaggaaagcgcagagaccgccgaccatcgccgagacccacatcgcattgagcatatattcatagctgaagggttccagtagcacgttcatctttcttccctctgcaccgctgacggtcgatgagccacaaaagggcgttcatcgtcagtaataatgctttcttccgagccgttaagtgtgacatggcgcagtacgccgctaaaagccagctccaggttctcggctgtaaaagtggtgtctgtcggcccgcttgccaggacggtgcctttgaccatgaccgtataatcgcaaaatgtcgtgacggatccgagattgtgtgttgagacaagcatcgttttgccttccgcgcgtaactccctcaacaggctgatgattttggcttcggttttcacatcaacgccggtaaaaggttcatccagcaggatcacatcaccctgctgtgcaatcgctctcgccagaaagacgcgtttcttttgtccaccggaaagctcgccgatttgtcgatggcgaaaattcaccatatcgacacgttccagcgcatcggtgacaatttgacgatccctctttttggcgatacgcaacatacccatatgcccatagcggcccatcatcaccacatcttccaccagtacaggaaatgaccagtcaacatcttctgactgagggacgtaggcaaccaggtttttctgtaacgcctgtcgcgtgggaatacccagaacagatatctttccgctggtcagacgcacaaatcccataatcgctttaaacaacgtcgattttccggaaccgtttaccccaaccagagcggcaatagatccacttggtactgtgaaggatgcatcgcgcagtgctgtgtgcccgttacgccaggtgacagtaacatcattaacgacaatgcctgcagattgcatcattatttctcccttttcccagctttaattccctgtaccagcgtactggtagtaaccttaagaaggtcgatatacgtcggtaccgggccgttttctgtgctcagggaatcgacatagagcacaccgccgtagtgtgcgccggtttcacgcgcaacctgacgcgctggtttatcggaaatcgtactctcgctaaagactgccgggatatgatttttcttaactatatcaacaaccttacgtacctgctgcggtgttccttgttgatcggcattaatcggccacagataaagctcttttagccccaaatcgcgtgcgagataagaaaaagccccttcactggtgaccatccatcgctgattctcagggagttccgtaatctgcttacgcaggggggcaagggtttgggtaatcttggctttataagtatcggcattgcgttggtaggtttgtgcatttgccggatcgtattttatcaacgcatcacgaatattatcgacgtaaatcagagcattatctggcgacatccatgcatgggggttaggtttgccctcatagggtccttcggtgatccctacaggcgtcacacccgaagagacaattacttctggaaccccattgagatgctggtaaaagcgttggaaccacaattccagattcataccattggcgagaatcagttgtgccccctgcgcacgtttaatatcgccaggggtaggctgatactcatgaatttctgcaccaggcttggttatggatgagacttctgcagcatctcccgccacgtttttggccatatccgcgatgatggtaaatgttgtaatgaccttgaatttttcagttgcacttgcctgaaatgcgatcgagcaggtgagtgcgaggccccccaagagcatggttactttttttatcgagtgcataatttagtacctatagtgagcaaaattagaacaaacatagcaacggctatgttttatagcacaacctatacaaaatgaaaatgattatcattagcggttttgaggcccaaaacagggattaggttgtttccggctggcgacgcgttattgaggaaaaaagtaaggcagctagtaggctttgaaataacgttttgcggttggctgatgcaatttcgagagtgcatgtattgaatgatttctagccgttactgattttcgtattttttgtatgggaggatttgcacctctcctcaccgagcctccatgactttactccactgtctctagggctgctgtgtgccaggagcggaagcaggggggccagagactccttaaaagttgatagctcgttttgcagggagacttacacggtaagcgttattccgaagagcttaaaattgaagcagtcaaacgggttgttgagcgtgtttatgcgctgccatctgattaatcgacggaagcagttccgtttggtctatgatgcagttgtccggcaggcgctctgtgacgcaaaagaacgataggagtagcattgaagtgaacgaggttatgcttgtcttatattatcctctattttaaaaacatcagctggttgtgtaagagtttttattgttttatcttgttgactttgcttttatgaaaacagagtgattgatacaatgaaaaccttaagtgggaaagagtttaggaaattatttaatcgttatgagacaggattctatctaagtgagtttgaatacttaaaggactttgatcctttgtttcctgaatgcgtagggaaagaattaaagttgggttataaacgaaaagttgatgtatggtgcgaagaggatgctgcgctatatgcagaatttatagctacaaaagaaaggctgaaaagaggccggttaatcctaaaaataaaccaagtgtggtcgcgtgtatatcctgcttatatttatgcaattgaagaaagaataaatgtcagggcaaaggggagagagtcatttaagtatgaaactgtgcaagaaaaacaatgtaaactttccataatgttagatggtctgaaagaccttgaatgtgaaatagctatgatttcaagtgagtttgaaattgaaaaacactctatgcactatttttatatgatttttgatattgaacgctatataaatgactgcagttactttgttttttctgctgctaaagttgttaaaggcgtgattcaatgcattggttacattgacaaaaataacaaagcaagttgcgatgaattttattcaggcagctatgaatgcttggatgatgatcaggaaacactgaactatttaaatgaatcatgcgcagagggtatagacgctgataaagatctcatcaggaagaatgagttattagccttatccctgaaggaattgtatcaacttctcgtttcaaaaaaataacaagtaatacggcgagcgatatgacgtgccatgggatatccgcacccagcagcatgttgtctccacgatgtccgcagttcgctcataatagacattcactacagttatagtagaaggtatgcatgctgctgagtggggaaagtgtgaaagaaaagaagacagctgctttgtttgtcgtcacgtttatcttcattggctatgcaagtcgtaatacaaggcgggacaaaactgagacacataaggcctcgcaatggcttgcaaggccacacatgtattgagatgttaataaaatgtagacttgtaattttgatataaatggtagagaaaatctttccccaaaataaaaacgaacgtcaatgaaatcaaacggttgaataaagttgattttggctaatacaaagacaagaaaataatatttatgattaaatatcagcgagttgaatacataatttttatatactgctgcgccatatgggctggactgaagccgcagacctgattgttaaaggtatggaaggtgcaatcaacgcgaagaccgtaacctatgacttcgaacgtctgatggaaggcgctaaactgctgaaatgttcagagtttggtgacgcgatcatcaagaacatgtaatctctacatgtgttaaatattgaaacgggcgtataacacgcccgttgtttttataaatatgttaaccgttataaaataacgtatcaaaagtcaagtgaacacatttcaaatatcaatttgatcgtattggtctggtgattatttatggggagcaataaaaagacagtattaatcatccatagggatagtctctgcacttttatttccattatgctaatgccttactgaattatgaagcattttttaagctcccaactttagctagattaatggtttattattttctacatcttcaatatataaaagcgtattatcaatggcgtagtaactgcgtttgttatgattaacatcagtaacccaccggaaaacgccagcgcctgccagtgttgaacagtattcccgaaatgtagattttccgcgaatatgaagcaatgcggcctcttttattttagctgggttcttggtcgtactaacttttaacaggttcctggttcctcttaataacaaaaccgtgtcatcgtgagtaataattctgatgttatccgtagccagataataaatgtaatgtgcaatacggtgatgttttaattctgaataaaaccaggagaagttttgctcttttctcacttgctcaaacatcttttgaaaaacaacgacctgatccatcaggataataacctcttgttaggtgtgagactgcgtagtgtgcacgatcggttttaccacttcaatctggtctgtcctttggctgtgatatgtacaaagtgtgaaagggggattacctgaattctcccggtgggcattttgcaacggaccagctccgctacaaacgctggtgtgggttcagattataacattctgtctaaggggcgggataaaggtgaatttagggggcatgaaagatgactttataaccttgctcaccccagtgttgtaaaagttcgttttgccttctcgttggtgccatgcctgtccagacaatcaatgtttgcgttgggaacagttccgggcgcggcgattcaatgggatcagcaagaacagaaatgtgccatcctgacaatgataaacgccatgcttccagccacaatcgtgctctctcttcaacattccacgccatcagaatggcctctttaccgggcttacggcgcatttcgaaaagtgaggccgctgcgtattcaattaatgcgccgtcaaacatactgctcataatgcgggaggtgttgtgatcaagcacgagacgctggcgaacaggaaggtaaacatgattaatcaattgatctactgggtactctcgacccagtgaaataattcgcgcgcgtagtttggctggattagccatacgaagaattgacatcatctcttcttgcaggcggttccagtcatcttgcgtatcctggctggtagtttccagtaatgctttaactttgcctacaggaacgccattacttatccaacgcttaatctcttcgatgcgttgtatgtcttcttcatcaaagagtcggtgtccgccttcactgcgttgtggttttaacaaaccgtagcggcgttgccaggcccggagagtgacaggattaatcccgcaacgttcagcaacatcaccaatgctgtaataagccacaattcctccttgcgatcataaatctccgtcgcctctacacgacccaataatactttgtacaatatatgctaaaattgtacaaagtataaataagatttcagctaaattggatgaaacattatttttaatgtggattaaattaaaacataacgtattcattttcacgatgatttccagaaatcatgcgaaataatgtgctgaaaattattttttctccggccacgcaactgaagggataccattcaatttagctttggaaaacagatctccctgaaacatctcaattcctgcagattcaagccacatccactcttctggtgttgccacgcccatagcagagacttgaatttcaagtgatgtacagcatttcatgatcgcctgaataattgcctgccgtggtccgcttttatgaacattggtaatcaattcctgactgattttaattctgtcaggctggaagcgtgacaggagtaacaaaccagcaaaacctgcgccaaaatgatcaattgctacactgataccggccgcctttagcgatttaaccgcttcggcaaactcatcaaaccgagatatgacttcactttcagtaaattcaacgatgatttgttcaggtaccagagcattggcctttatttcatcaagtaaaaaagagactgcgtcaggtttgttaaccagggtcataggtaatagattgattgaaatcattttatcaccgagcttaagtgcgtgtgccatcgcaaatgcaagcgccttacttttgagatccgctgtgtagatttcctcgtctttacgctgcccaaccgctatagctgacgggctgtcttcatttttttgcacaatggcttcaaaagcgattatccgccgcgataaagggtcgacaataggatgaaaggcaaagtggtcgtttatatttgatgaaagggtacaagaatcaagttctttatcagatccgtcagcgataaaaagccaggagtcttcagcaggaatctcgaaataggttgattgttcagttgcaaggacaaaagtacgaaaaaattgtagcgctctgtcatcataagttagctgaaattttgatgtgcctttgtcgaatacggcctgtaaaacgtcatctcgctcgtgcaggcgtaaatcaaataattccattcctgctttgccaaaacggcgagcaggcgcgtaatcgcacaacagttcaacaatattatagtgccgtggatcctggcatatggcccgatatatcatttgaacctgttcttccggaccttccagaagctggaaaaaatgagaaccattaaacagtaagatccctgttacgtcagaccgcatgttcctgcgatttgctatcgaaaccatttcttcaatttttttgacaggttcgtcgccacgtatatggctacgataaataagggtggtaagcattaacaatccagggtaatgggcgaggcgagagtaagacggtaacagacatatcttcttgtgtctttcttttaataccaaaacataaccgtttctttacattgataaaaagtggaaaaggttgaagacggtttggcgaaaaaacctgtataggttgtcatttaaatgatgcaatatgttttatcgtaatgcattgttttatatgaattagcactaattgcgaaaaattaatttatcattctgtacacatatttcgtacaagtttgctattgttacctcacttaacattgattaacatttttaacagaggcgtagcatgcatcaaaattcagtgacttcagattctgcaggagcaatcactcgttactttgcaaaagctaacttgcctactcagcaggaaactctcggagaaattgtgactgagattttgaaagatggacgtaatctgagtcgaaagtcgctttgtgccaaacttctttgccggctggaacaagcgacaggggaagaggaacagaaacattataatgcactaattgggttgctttttgaataatgcaacagcctgattatttaacaggttagctatgaagtcgttatgaagacatctgataatgaaagtataaaatatgaaattactggccaggcggtgctccagatactgcgcatgaagataaatttttcgttgcagactcttattaagcaattactcgtaatgaaatcggctgaggaaaatactttccgacgagatttaattgacagcataattcgtgattttagcaacagtgatacaggagggccaaaccgaagaacagcgatagctgacaataaaagtatgttcactggtaagaaaataaacagaatacattaaaatttcataagtaagatgagaggttaccatgcttgaagatactactattcataatgcaatatctgataaagcgttatcaagttactttcgtagttcaggtaatttgttagaagaagagtctgctgtgttagggcaggctgtgaccaatttaatgctttcaggcgataatgttaataataaaaatattatcttaagtctgatacactccctggaaacaacaagtgatattctcaaagctgatgtgattagaaaaacactggaaatcgtgttgcgatacacagctgatgatatgtaacttttaattataaagtataagtttatagaaaactcattcatcttatttttgtctgtcgctttagactatacacagcataattttattggatcactattcctgcgaggctgacatgaataattcaatcccagagagatttatttttcaatgtgctttgtttaaaaatctcgagagggaggtgttcatgacacatggatatgttgatagtcatattattgctcaggctttacgcttgcgtttaaaagatgagaccagtgttattctttctgatctctatctgcaaatcttgcagtacattgaaatgcataagactacactaacggatatcattattaatgacagggaatctgtgctctcttaaaacttgagtaaggtttttgaataaacatcagctgtatcactatgctgatgcaaagtgagcatttcaggcgttatgctttcttaatatatccgcaatatcagagggcaaacaggaatggagagcgctcgttttccattcttgacgcctgatatcccgcctaatttgtttaattctgcctacattgtgctaaaaaattaataggctagatgaagttggagaaaattttatcttcggcgtggatatttgtgatgctctctaccatgctctctgtagaccccagcgcgagcgaatgaacgtctctttagcttctacagacttatcgataaaggctttgggattttgatatttattctgttaatcgcctgcgccgctgccttcctgcttgataggtatttcaataaaagcgcaacgcctgaagagatcctgcgacgggctataaataatggggagatcgtccctttttaccaacctgtggtaaatggtcgggaagggacattgcggggagttgaggtgttagcccgctggaaacaacctcacggtggatatatatcacccgcggcatttattccacttgctgaaaaatgcggattaatcgttccgcttacgcaaagcctgatgaatcaggttgccagacagatgaacgctatcgcgagtaaactgccggaaggttttcatattgggattaattttagcgcctcgcatattatttcgccgacgtttgtcgacgagtgcttaaattaccgtgacagttttacccgccgcgatttaaaccttgttctggaagtcaccgagcgtgagccattaaatgttgatgaaagtctggttcagcggttgaacattctgcatgaaaatggttttgtcatcgcgctggatgatttcggtactggttactcagggctttcttatctgcatgacttgcatattgattatatcaaaattgatcatagtttcgttggccgcgtcaacgcagacccagcatcaacccgaattctggattgtgtattggatctggcgcgtaaactttcgatcagtatcgtcgctgaagatgtcgaaacgaaagaacaatttgactatctgaaccaaaataatatcacatttcagcagggttattatttctataaacctgttacatacatcgacctggtcaagattatcctttctaaaccgaaggtgaagattgtggttgagtgaaaattgatcagcaaggccatggtgcggtgtaattatagacagctaattagctcgttgcctcttgttactattgttcattcttttgtttgctataattgtgtgaaagttttgactggattgccattagtagcatgaacaatagtaataatctggattatttcactctctatatcatcttttccattgcatttatgctgatcactctcctggtcatccttattgcaaaacccagcaccgggctgggagaagtgcttgtgacgataaatttgcttaatgccctggtttggctggcgatcaatctggttaatcgattaagggaaagactcgtcagccacagggatcagcactaatctttcagtttctcactgccagtatgcggctgaatgggttgctggcagtgaacccctggatcattgaaggaaaggaattattgcacaaatagttgtcaaccctggtgttatcacagttgttttatatatcagtgaaataatttccatggcaactgttgataattttgatgtcgaagagttatttgttaaacaaaatagttaccccaaagtgatcaatgtcatgaaaataagctaaaaatgataatgctggcttatttatcatttaaatattgtcgctgtttatctatttaaatttcttgtgcttttgtttttatctttgccttccgttttggtaatctgaactcataggttatttgaccaggaatgtttgttaatccaatgaatggatggttaatctatgaaactgaaaaaactccccggatttagtttaggacttattgctctggcggtgggtaatgcatatgtaacgcaattgttggatatttatagtataatttcctatataaccgatgaagaatcaccgattgaaatcaaaaataatacttctacaagtaatggggagtatctaatcacttaagacgaaagccatgctgtgaaagtggatgacggtgtaactggatatatacataatgccagtgtgatgactagtggtgatggatcttatggtatttctgttgatagccaaaacaaagtattatatataagcgatagcaatattaagacgctctgaaagcgtatctgacaaagaaaatggagggataacagccagcgcagtagtcagtgaatttggtggcaccatcgttatgaatggtgataattcagtcgagacgagggggcatattcagcgggacttttaagtcagattaatgattctgggactgtggaaaataacacccgtcttgaaaccacagataaaacgaacattgttacctatggggaaaaatgcagtaggagttcttgcatgttcaagtcctggagagtctcgaacatgtgtcgatgctgtagatgatgaagtttgtgattctaacagttacgaagttattagccgtgctgatttaaaaatgaatggtggttccataacaactaatggtattaatagctatggtgcttatgctaatgggaaaaaagcatatattaatttagattatgtggtacttgaaactgtggctgatggaagttatgcagttgctattcgacaaggtaacattgatataaaaaagttctattacaacaaatggcactaaagcccccattgcaaaaatatacaatggtagagagttatttttttccaatgtcacttcagaatcaacagaaacgcctacccccgtcctgcgacccgaagctggcagttacgtcgccaacctggcagccgctaacactctttttgttatgcgtctgaacgatcgtgcagatgaaacgcgctatatcgatcctgtaactgaacaggagcgttcaagccgattttggctacgtcaaattggcgggcataatgcctggcgtgacagcaacggacagttgagaacgacctcggcacaggccatctggatgggcgtcgatcataatgtgcacacggaagccaatggctcacgtattgagaatgacgcaaataacaatatccagacccgacttggtttccacacctttattcgtactcaggagaaaaacagcggtccgcacggtgacgactttgaaccttttgttgaaatgaacgggatccataacagtaaagattttgctgtctcaataaacggtgtgaaagttgaacaagccggggcgcgtaatctgggggaaattaaacatggcgtaaatggcaatctgaatcctgcggccagcgtctggggtaatgtgggcgtgcagctgggtgataatggctacaatgacaacgcaatgatggtgggcctgaaatataagttctgatcccgccattagctaaaaaaccgcgtcgaattcatcgacgcggtaacatatgaaatattattttttgccgatagcacgcatggtgtcatcaattgccgtgatcaacagcatttgcggatctttagcgcaaacctgattcagtttttctaccactttggcgctcagttccggagattgctcaatttttaaatcacggctggcaacgctggcattacccattaccgcaacaatttctgcaacctgtgcgctgtcagtttttgccatttcgttggcttctgcgcaagtaatataggtttctgatggcaaaccgttcttaatattgtagtcctgcgcccaggtcattggtgcgaaaacaaacagacccgccagtaaagcaaattttttcatcatcattccttatttcattttacccagaattgcaccacccgtaccgccaatcacggcacctttaatcgccccttcgaggccattgccggtcagaacgccagtgacagcaccaacggcggcacccacttttgcacctttacgcgcatttttaccgtcgcggcctttttctgttactgcaccaacaccagcgccaacagctgcacctttcagtacgccattaacaccattgccagtaagtaaaccaacgcctgcgcctagcaatgcacctttcgtggtgcgattcatatccgccatcgctggcgtggagcagaacaatgctgagataagcccgaaggcaagtatttttttcttcaacttagttgtccggtattaagtaagttgcacacacaataatttcgtcttcaattaagatctgcttaactaaagaacgctcgctattattcagataattcaaaatgagcgtgactgtgatgataggaattatgttttttacgggaatgagaataatctcaaatgagaaataactcattgattgacaatatttttattcaagaagtgtcattgactgttaacgcaatgttgtaaaggtaagataatctgatttatcaatattattgtgtgattgttatgtgagcagaagatattcattagcaacgattacattagtcattttattttgtggacggcctcattgtcgaaaaataagcgtacgacagtattatcagaaaagagtgattttttatccaacaacacttcagcgcactgcgtttaaaaaatacctctttcttatacgggatatcatcatttcatcatgatgtctttgatgagcggtgaacacaatacatttgcgctgtctcttcaggatgaatcccctggtctggttcctgcgggctgatgttgcagcagagctaaggtcacttagacgctactatcatttatccaatgcatggaatcgaaatcagtcgatacccgcagtatatatcgtgaactgggcgcaacgctgagttacaacatgcgtctggggaacggtatggaaattgaaccctggctgaaggcggctgtgcgcaaagaatttgtcgatgataatcgagtgaaagtgaatagtgacggtaattttatcaatgatttgtcgggtagacgtggaatataccaggcaggtattaaagcctcattcagcagtacgttaagcgggcatctcggggtggggtatagccgtggtgccggtgtggagtccccgtggaatgcggtggtcggtgtgaactggtcgttctgaccatcaacgattaaactgcgtttcggcgctgtttttgtttaccgggtgctaaaagggaaaattctggggcaaaaaaaagcccgtcagttacggcgggaaacctcatcctatgggagaacaatgaataatgaaattgcggggttatcatctcccaggatatccacgctaacaataaggttatttactcaaccaggcgtaaacattttgttctgtgcgtgggaacagccttaaggtgtaaagggggagggggaaatagcaatgaatagtatcagcaagaatactcgccgctttaccacaacgtggatgagagggatgaaaaactcaaggcagagatgactctgccttgaagataaatgcgcttttacagggggcttatttcagctcttctgcttccggtaaggtcacgttcagctcaagaatagaaatatcgccatctttttgctcaagctgtacggttaccatctcaggatcaatttgtacatatttacaaatgacctcaagaatatctttacgcaactgcggcagataatgcggttctgcatcgctgcgacggcgttcagcaacaataatctgcaaccgttcttttgcaatgttggctgtgtttttcttccgcgagagaaagaaatcgagtaatgccataacttatcctccgaacaagcgtttgaggaagcctttcttctcttcttcaatgaagcggaaaggacgttcttctcccaacagacgttctacggtatctgcgtaggctttacccgcatcggcgttaatgtcgagaatgaccggttcaccctggttagaggcgcgcaatactgattgatcctctgggatcacgccgacgagtttgatgcgcaggatctccagcacatcttccatgctcagcatgtcacctctgcttacgcggcctgggttatagcgcgttaacagcaggtgctctttaatcggctcttcgccattttctgcgcggcgtgatttcgacgccagaatgcctaaaatacggtcagagtcgcgtactgaggagacttccggattggtggtaataatggcttcgtctgcaaaatagagtgccattaacgcaccggtttcaatccctgccggggagtcacaaacgataaattcaaaatccatcgctttcagatcatcaagaactttggcgaccccttcacgggtgagggcatcttatcgcgagttgcnnnnncattccattcattaattaattaatgaatgaatgnnnnnacagacaacggataacggcaaacagaacacctatttctcctcactggataacatggttgcccagggcaatgttctgcccgttctgtacggtgaaatgcgcgtggggtcacgcgtggtttctcaggagatcagcacggcagacgaaggggatggtggtcaggttgtggtgattggtcgctgatgcaaaatgttttatgtgaaaccgcctccgggcggttttatcgtttatggagcatgacgaatgggtaaaggcagcagtaaggggcataccccgcgcgaagcgaaggacaacctgaagtccacgcagttgctgagtgtgatcgatgccatcagcgaagggccggttgaaggtccggtggatggattaaaaagcgtgctgctgaacagtacgccggtgctggacagtgaggggaataccaatatctccggcgtcacggtggtgttccgggcaggtgagcaggagcagacaccgccggagggatttgaatcctccggctccgagacggtgctgggtacggaagtgaaatatgacacgccgatcacccgcaccattacgtcggcaaacatcgaccgtctgcgctttaccttcggtgtgcaggcactggtggaaaccacctcaaagggtgacaggaatccgtcggaagtccgcctgctggttcagatacagcgtaatggtggctgggtgacggaaaaagacatcaccattaagggcaaaaccacctcgcagtatctggcctcggtggtggtgggtaacctgccgccgcgcccgttcaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcannnnncattccattcattaattaattaatgaatgaatgnnnnntgcgggcggttttgtcgtttatggagcatgacgaatgggtaaaggcagcagtaaggggcataccccgcgcgaagcgaaggacaatctgaagtccacgcagttgctgagtgtgatcgatgccatcagcgaagggccggttgaaggtccggtggatgggttaaaaagcgtgctgctgaacagtacgccggtgctggacagtgaggggaataccaatatctccggtgtcacggtggtgttccgggcaggtgagcaggagcagacaccgccggagggatttgaatcctccggctccgagacggtgctgggtacggaagtgaaatatgacacgccgatcacccggaccatcacgtcggcaaacatcgaccgtctgcgctttaccttcggtgtgcaggcactggtggaaaccacctcaaagggggaccggaatccgtcggaagtccgcctgctggttcagatacagcgtaacggtggctgggtgacggaaaaagacatcaccattaagggcaaaaccacctcgcagtatctggcctcggtggtggtggataacctgccgccgcgcccgtttaatatccggatgcgcaggatgacgccggacagcaccacagaccagctgcagaacaaaacgctctggtcgtcatacaccgaaatcatcgatgtgaaacagtgctacccgaacacggcactggtcggcgtgcaggtggactcggagcagttcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgccctgaaggaccgccataatgccgttgaggtgaactggattgacccggataacggctgggagacggcgacagagcttgtggaggacacgcaggccattgcccgttacggtcgtaacgtcacgaagatggatgcctttggctgtaccagccgggggcaggcacaccgcgccgggctgtggctgattaaaacggaactgctggaaacgcagaccgtggacttcagcgtgggtgcagaagggcttcgccatgtaccgggcgatgtcattgaaatctgcgatgatgactatgcgggtatcagcaccggcgggcgcgtgctggcggtgaacagccagacccggacgctgacgctcgaccgtgaaatcacgctgccatcctccggcaccacgctgataagcctggttgacggacaggggaatccggtcagcgtggaggtccagtccgtcaccgacggcgtgaaggtgaaagtgagccgtgttcctgacggcgttgcagaatacagcgtgtgggggctgaagctgccgacgctgcgccagcgcctgttccgctgtgtgagtatccgtgagaacgatgacggcacgtatgccatcactgccgtgcagcatgtaccggaaaaagaggccatcgtggataacggggcgcactttgacggcgaccagagcggcacggtgaatggtgtcacgccgccagcggtgcagcacctgaccgcnnnnncattccattcattaattaattaatgaatgaatgnnnnntgaactgtttttttatccagtataatttgttggcataattaagtacgacgagtaaaattacatacctgcccgcccaactccttcaggtagcgactcatgagtaaaccgttcaaactgaattccgcttttaaaccttctggcgatcagccggaggcgattcgacgtctcgaagaggggctggaagatggcctggcgcaccagacgttacttggcgtgactggctccgggaaaaccttcaccattgccaatgtcattgctgaccttcagcgccctaccatggtacttgcgcccaacaaaacgctggcggcccagctgtatggcgaaatgaaagaattcttcccggaaaacgcggtggaatatttcgtctcctactacgactactatcagccggaggcctatgtaccgagttccgacacctttattgagaaagatgcctcggtaaacgaacatatcgaacagatgcgtttgtccgccaccaaagcgatgctggagcggcgtgatgtggttgtggtggcgtctgtttccgcgatttatggtctgggcgatcctgatttatatctcaagatgatgctccatctcacggtcggtatgattatcgatcagcgcgcgattctgcgccgactggcggagctgcaatacgctcgtaatgatcaggcattccagcgcggtactttccgcgttcgtggtgaggtgatagatatcttcccggcagaatcggatgacattgcacttcgcgtggaactgtttgacgaggaagtggaacgattgtcgttatttgacccgctgaccgggcagattgtttccactattccacgttttaccatctacccgaaaacgcactacgtcacgccgcgcgagcgcatcgtacaggcgatggaagagatcaaagaagaactggccgccagacgcaaagtgctgttggagaacaacaagttgcttgaagagcagcggctgacccagcgtacccagtttgatctggagatgatgaacgagctgggctactgttccgggattgagaactactcgcgcttcctctccggtcgtggaccgggtgagccaccgccgacgctgtttgattacctgcctgccgatgggctgttggtcgtcgatgaatctcacgtcaccattccacaaattggcggcatgtatcgcggtgaccgggcgcgtaaagagactctggtggagtacggcttccgcctgccatcagcgctggataaccgtccgctgaaatttgaagagttcgaagcattagcgccgcaaaccatctatgtttcggcgacgccgggtaattacgagctggaaaaatccggtggcgatgtggtggatcaggtggtgcgtccaacaggcttactcgacccgattatcgaagtgcggccagtggcaacacaggtggatgatcttctttcggagattcgtcagcgagcggcaattaacgaacgcgtactggttacaactctgaccaagcggatggcggaagatctcactgaatatctcgaagaacacggtgagcgcgtgcgttatcttcactcagatatcgacaccgtcgaacgtatggagattatccgcgacttgcgtctgggtgagttcgacgtattggtagggatcaacttactgcgcgaaggtctggatatgccggaagtttcgctggtggcgatcctcgacgctgacaaagaaggcttcctgcgttccgaacgttcgttgatccagaccattggtcgtgcggcacgtaacgttaacggtaaagcgattctctatggcgataagatcaccccatcaatggcgaaagcgattggcgaaaccgaacgtcgccgcgagaaacagcagaagtacaacgaagaacacggcattacgccgcaaggcttgaacaagaaagtggtcgatatcctggcgctggggcagaacattgccaaaaccaaagcgaagggcagaggaaaatcgcgcccgattgttgaaccggataatgtgccgatggatatgtcgcctaaagcgttacagcagaagatccatgaactggaagggttgatgatgcaacacgcgcagaatctggagttcgaagaagcggcgcaaattcgtgaccagttgcatcagttgcgtgagctgtttattgccgcgtcgtgacaagatgacgaagccggaatattcttccggcttcgtgttaacctaaagcctgtaatgccttttccagcgcgctatgcaacaactggcggtcatgacgatacggaatatcgctggcctccagcacttcctgaatcacaatccgctctttcaccgccgagacatcctcttttggcccgacgatgaccgcatcaattacctttttaccaacatactgctccataattgccagcttgctttccagcttcagattagccgcaggtaaactcaactcacgccccagattgccgatatagaccatcggcgctggcgtgcggcgtaatgcctgtgcgatttccttcagcagcagaattggcatcaggctggtgtaaaaactgccaggcccaataatgatgagatccgcttcactgatagcgtgaaccgcctcacgcgttgcgggtacattcggcgttaacaataactcttgaatcggcgcagttaactggtcgatattgacctcgccgtatacttcatgcccctgatcgtcaatcgccatcagatcaacaggatgctccgacatcggaatcaaatgtgcgtccactttcagcagatttcgaatcagattgatcgcttcaagaggtcgcacgctaaggtgatccagtgcctttaacatcaggtttccaaggttgtgcccggaaagttcgccattaccgccgaaacgatattcaaacattgcggaagcgacgctgggttcagttatcagctgattgaggcagttgcgcatatcgccccaggcaatgccgccttctgagcggcgaatacgccccgtcgagccaccgttatcggtggtggtgacgatacccgttaaacgagaacccaaagacgaaagtgatgagagaacgcgtcccagtccatgccctccgccgagagcaacgacacgatcaagatcagccagcgtacgattgcgcatatagtttcctggagtcagattatccgcgctacagtagcgcaaattgcgaggaaacagcaattaacctgccaatattgaggatacaaactattttcttctacctctaaaggacgatgcacgctatgcctccctgatgatgtatatcaaagtaaaaccgccattttcccttattctgtagcgaaatagcacgatcatgacgctatatacatgattacatagcgaaagtgtggatggtaaaaatctcatttacacgctagtatcggcttaaccactaaacactctagcctctgcacctgggtcaactgatacggtgctttggccgtgacaatgctcgtaaagattgccaccagggcgaaggaagaaatgacttcgcctcccgtatctggaaaggtgtacatggcttcacaactgactgatgcatttgcgcgtaagttttactacttgcgcctgtcgattactgatgtgtgtaactttcgttgcacctactgcctgccggatggttacaagccgagcggcgtcaccaataaaggctttctgaccgtcgatgaaattcgccgggttacgcgcgccttcgccagtctgggcaccgaaaaagtccgtctgacaggtggtgagccatctttacgccgcgactttaccgatatcatcgccgctgtgcgagaaaacgacgctattcgccagatagcggtcaccaccaatggttaccgtctggagcgcgatgtggcgaactggcgcgatgctggacttactggcatcaacgtcagcgtcgacagtctggacgctcgccagtttcatgccattaccgggcaggataaattcaaccaggtcatggcaggaatcgatgctgcatttgaggccggttttgagaaggtcaaagtcaataccgtgctgatgcgtgatgttaatcatcaccagctcgacacctttctgaactggatccagcatcgtcccatccagctgcgtttcatcgaactgatggaaacgggcgagggcatcgagctcttccgtaagcatcacatctctggtcaggttctgcgtaacgagctactgcgtcgcggctggatccaccaattacgtcaacgcagcgacggtcccgcgcaagtcttttgtcatccggattacgccggagagattggccttatcatgccgtatgaaaaagacttctgcgccacttgcaaccgcctgcgcgtttcctccattggtaaactccatctctgcctgtttggtgaaggcggcgttaacctgcgcgatctgctggaagacgatacccagcaacaggcgctggaagcgcgtatttcagcggcgctgcgggagaaaaaacagacccatttcctgcatcaaaataacaccggtattacgcaaaacttatcgtacattggtggctaaaacgtcaaaaggagagatcagatgagtcaggtaagcactgaatttatcccgacccgtattgctattcttacggtttctaatcgtcgcggtgaagaagacgatacctccggtcactatctgcgcgactcggcgcaagaagcgggccatcacgttgtcgataaagccattgtgaaagaaaaccgctacgctattcgcgctcaggtatctgcgtggatcgccagcgacgatgtacaagtggtgttgattacgggtggtactggcctgacggaaggagatcaggctcccgaagcgctgctgccgttgttcgaccgtgaagttgaaggttttggtgaagtgttccggatgttgtcgttcgaagagattggcacttccacgttgcaatctcgtgcggtagcgggcgtcgctaacaaaacgctgattttcgccatgccgggttcgaccaaagcgtgccgtaccgcatgggaaaatatcattgcgccgcagctggatgcccgtacgcgtccgtgtaatttccatccacatttgaagaaataagtatgtcgcaactgacccatatcaacgccgctggcgaagcgcacatggtggatgtctccgccaaagcggaaaccgtgcgtgaagcgcgcgccgaagcctttgtcaccatgcgcagcgagacgctggcgatgattattgatggtcgccaccacaaaggcgacgtatttgccactgcgcgtatcgccggtattcaggcggcaaaacgcacctgggatctgatcccgctgtgtcacccgctgatgctcagcaaagttgaagtcaatttacaggccgagccggagcacaatcgggtacgtatagaaaccttatgccgcctgaccgggaaaaccggtgtcgaaatggaagcgttaaccgcggcctccgtggcggcgctgaccatttatgacatgtgcaaagcggtgcaaaaagatatggtgattggtccggtacgtttgctggcgaagagcggcggcaagtcgggtgactttaaggtggaagcggatgattaacgttctttttttcgcccaggtgcgagagttggtgggaacagatgcaaccgaagtggctgcggatttcccaaccgttgaaagcgttacgccaacatctggctgcgcagagcgatcgctgggcgctggcgctggaagatggcaaattgctggctgctgtcaaccagacgctggtgagttttgaccattcgctgactgacggcgacgaagtggctttcttcccgccggtaaccggaggttaagatggcagaaaccaaaattgttgtcggcccgcagccgttcagcgtaggagaagagtacccgtggctggctgagcgtgacgaagacggtgcggtagtcacctttaccggtaaggtgcgcaaccataacctgggcgacagcgtcaaagcattaaccctcgaacactatccgggaatgacagaaaaagcactggcagaaatcgttgatgaagcgcgtaaccgctggccgctggggcgcgtcacggtaattcaccgcattggtgaattatggccgggcgatgaaattgtttttgtcggtgttaccagtgcgcatcgcagcagtgcgtttgaagccgggcagtttattatggattatctcaaaacccgcgcaccgttctggaagcgcgaagccacgccggaaggcgaccgttgggtcgaagctcgggagagcgatcagcaggcggcaaaacgctggtagtttattgttagccggataaggcaccgctgcgtccggcaatttcaccgctcagtacatacgtttacgctgcgtcgatgcacagcctcatcattttgcagtatccttaagatattccttatatcttcaggagaaagtcatggacagattcccacgttctgattcaatcgtacaaccccgggctggcttgcaaacttatatggcgcaagtctatggctggatgaccgttggcttgttgctgacagcatttgttgcctggtatgcggctaattccgcggccgtgatggagctgttgtttactaaccgtgtctttttaatcggtctgatcatcgcgcaattagcattggttattgtgttatcagcgatgattcaaaagctgagcgcaggtgtaacgacgatgctctttatgctttattcggcgctgacgggtcttacgctttccagtattttcattgtctataccgctgcttctatcgccagtactttcgtcgttactgccgggatgttcggcgcaatgagtctgtacggttacaccacgaagcgtgatctaagcggctttggcaatatgctgtttatggcgttaatcggcattgtgctggcatcgctggttaacttctggctgaaaagcgaagcattgatgtgggcagtcacctacatcggcgtgattgtctttgtcggattgacggcgtatgacacccagaaactgaaaaatatgggtgagcagattgatactcgcgacacgtcgaacctgcgcaaatattccattcttggcgcgttaaccttgtatctggacttcatcaacctgttcctgatgttgctgcggatcttcggcaaccgccgttaattctttttcaccatcaatatcccggccatgtgtcgggattttttttcttactaaaaacgacacttaacaagtaccaggtataaaatatgccttatggacgagcggaagcgttttctgtatccataaatgcaaaagtattttgtatgcgtagttttaaatttattgatggtgaatattaatgttttttctaaggacaactaaaagaatggaatcatactcgcaaaatagcaataaagtagattttcagcacgaagccaggatattaaacggcatatggctcattaccgctttgggtttggtggcaaccgcagggctggcctggggcgctaagtatctcgaaattacggcaacaaaatatgattcaccgcaaatgtatgttgctataggattattattactttctatgtatggcttaagtaaagatatcaacaagataaataccgccatcgcgggcgtaatatatttgtttttaatctctttggtggcgattgtcgttgcgagtttagcgcctgtatctgccattatcgtcgtgttcagcactgcgggatcgatgtttttaatcagtatgctggcaggtctattgtttaaatttgatcctggttctcaccgttttatcattatgatgacgttgacagggttggccctggtaatcatcgtgaatgccacattaatgagtgaacgacccatttgggtaataagttgcttaatgattgtcttatggtcaggcattatctcgcatggacgaaataagctccttgaactgacaggaaaaagccatagtgaagaattatggagtccggttcgttgtgcttttgtaggtgcattaacactctattactattttatcggcttctttgggattcttgccactatagctataacgcttgtctggcaaaggcatacgcggttttttcattagccgtaaatgcacatactaaagaacttaactatacttcacatcgccgcttcatttttcgcccgtagcttcttcgcctggctttccagcaacaggtaacagatcagcgccagcagcagtgggataaagtaatacagcacacggtaagcgagcagggcggcgataattgtgcctttggaggtatgctccccagccagtagcgcgataaacaccgcttccagcacaccaattcccgccggaatatgcacgatgacgccagcaatactactaaccagcaacacgcccactacaaagaaatagcttacgctttgaccaagtaacagccagataatcgctcccattaccatccagttaacgctggaaatcagcatctgggcgagggcgaatttccacgaaggcagcaccagcttttgccctttgatggtcatatggcggtgcttcgcgaaagcgcaaaaccacaaataaaccgcgataatcatcagtaagccaataccgagaatacgcagcgtagtttgatcgacataccagtgatccggcaactccaccacgcctgcggtaaagataacccccgctagcaaaatatagcctagccagttggtggtaatactgagcgaaaaaatccgcgtaatagtgctgcccggtaaccccagtcgggagtacaaacgatagcgcataccaatgccgccgacccaggtactgagtgtcaggttgaaggcgtagcagataaacgacaccagcatcacctggcgcttcgccagtttgtgaccgcagtagaaacgggcgagcaggtcgtagcaaccgtaaatcagataactgacgaccaccagcccgaccgcactaagcagcgcaacgcgattgtagtcgcggatgaccttccagacctcttcccagtccacttttttggcgtagaccaccagcaacacaatcaccgcgataaaaaacagccaggtgaggagtttctttgctaagcgccagcgcgggtgtgatttactcatcagggttttacccccgtgttttcagtttctacccgatcctgcgtttccattgtcggttgtgcggggggaccaacctgcgccagacgtggtgtgtgcgccggaagccagcccaccagcgccgggaagtggcgtaaaaagtggaacgccagcacgcttttggtcaggttccaccaggtgcgtttcggcagcatggtctcatcgacctgctgacaatctgcggcgataatgccgttcagattatcgcgcagcgtctggttaaaattacgatcgtggatgatgacatttgcttcgagattcagtgacaaactgagcggatcgagattactggaccctactgtcgcccagtgatcgtccatcaatgccactttgccgtggagcgggcggcggcggtactcaaacacctgaacgccgcctttaaccagatagttatacagcaaatgtgcgccgactctgacaatcggcatatccggttcgccctgaatgatcagtttgatccgcaccccgcgccgtgccgctttacgcaaggcgtgtaaaaaacgatagccggggaagaagtaggcgttggcgataatcacttcccgccgcgcctgagtgagcattttcagatagtgacgttcgatatcatcgcgatgttcttcgttatcgcgccagaccagcaatacctgcgcttctcccggctggcggttctcttccgctttatgatgacgtcgccaccagcgtcgcgccgcgctctgtcctggcaggttttccagctcaaactggagaatatcttcgacaatcggcccttcgaggcgaaccgcgtaatcctgtttggcctccgggccgtagctggacatatgctcggcggagtaattcagcccgccaataaaggcgatacgcgcgtcgatcaccacaattttgcgatgcatccggcgaaacacattggtgcgcataccaaaaaggcgagggcggggatcgtagtagcggaacaccacgccagctgccgtcagttcattgacaaactcatcgctgagatccggcgaaccgtagccatccagcaagacttccgcttttaccccgcgttgcgctgctgccaatagcgccgcatgcagctgtttgccgacgtcatcctcaaaccagataaacgtttcaagaatgatgcgttcttgtgcctctccaatcgccttaaacaccgcgggataatattgctcgccgttttccagcaactggatcttattgccttcgcgccagctacatttcataaatgaatctccgcacttaaaggggcatgatcagaaaggtgtcgccatgtccgcagcggcaacgcggttggtgcgctggcgctggcatttttgacgtagatcctgtccagtcgtagtagaggaaattgcaccggaaacgtgcgcgccgggcgtccgtgggcgcgggtaaaaatctcatccagcccggcctgcacttttaacggatgattagctttttgccgccagtcgttgaaatcacccgctaccaataccggttcgccgtccggtagctcattcacccattcggcgagcatcgcaagctgcgcctgacggtgcgcctcacgcaggcccagatgtacgcacatcacatgaatcgctttcccggtcatcggcggcacaatgcggcagtagagcacgccgcgcttttccgcaccatcgaccgaaacatcacgattctcataatgttcaatgggataacgtgaaagaaccgcattaccgtgatgtccttccgggtatacggcattgcgaccgtaggcgaaatcgctccacatggtgtcggcgagaaactcgtagtgcgaggtatcgggccagttttccacatgcagcggatgaacttcgtgcgcgcccatcacttcctgcaggcaaacaatatcggcgctgacggtacgcacggcgtcgcgaagttccggcaaaatgaagcgtcggttaaacgcggtaaagcctttgtgaatattgatggtgagcaccttgaacgaaaattgttgtgtttgatcgggcataattttcctgtctttgcctcttatctcattgaaatagtgtagtcggcgtcacaaaaaggtgcggtcttacggaattttccgtaaagttcggtactctgaataagtagagataaattcttcaggagagaagccatgaagtggcaacaacgtgttcgtgtcgcaactggcctaagttgctggcagattatgttgcatttactggtagtggcgctgctggtggtgggctggatgagtaaaactctggttcacgtcggcgtaggattatgcgcactgtattgtgtcacggtagtgatgatgctggtgtttcagcgccaccccgagcaacgctggcgtgaggtggcagacgtgctggaagagctgaccacgacctggtattttggcgcagcgctgattgttctgtggctgttgtcccgcgtactggaaaacaactttgtgctggcgattgcagggctggcaatccttgccggcccggcggtagtgtctttgctggcgaaagataagaagttacatcaccttacgtctaaacatcgcgtacgccgctgaccctgtcgtggccgttatcaccagtagcggccacaaactattccacacaatatccagactcgcatccttcaaataaatctgcttggtaatgtccgtaaagtggcgaatagggttaatccacgtcagattttgcagccacactggcatgttttccaccggcgaaacgtaaccggaaaggagaatggcgggcatcataaagacaaacacgccgataaacgcctgctgttgtgttgaacagagtgatgaaatcaacagaccgaatcccaccagcgataaaccgtaaatcaccatcgtgaagtagaacagcgccagcgatccggcgaaggggatttgatacgcccagataccaatcgccagcacaatggtggcctggaaggtggcgacaattaatgccggtacggctttgccgatgaatatctgccaggtggtgaggggcgaaaccagcaactgatcgagcgtaccttgttcacgttcacgggcgacggaaagtgaagtgactatcattacgccgatagtggtgatcatggcgatcagcgacggcaccacaaaccatttgtagtcgagattcgggttataccagttgcgtaccaccagctcgctgttgttgggtttcggttttccttccagcagctcctgctgataatttttgacgatctgttgcaggtagttggcggcaatttgcgcactgttggagttacgcccgtcgaggatcaactgcaacggcgcggtctggaaggtatccagtttgcgcgagaagtcagccgggaaacgcaccagtagtaacgccttttgtgtgtcgatggtcgggcggatctcctgcgggcttttcagcagcagcacatgggtaaaggcgctggcgcgggcaaaacgttgagtaagttctaccgagtgctcgccgttatcttcatcgtagatggcgatggtggcgttggtcacttccagcgtggcggcgaacgggaacaggatcacctgaattagcacgggtaaaatcagaattgcgcgggtttgcggttcgcgcagcagcgactgcaactctttgcggattaacgtccataagcgatgaaacatgctcttctccctaatccagccgacgtttgattttcagccacgtcaggccgataaacatcaccgccgaagcgatcaaaaacagcacgttcactatcagcaccactggaatattcccggcgaggaacaggctttgcagggtgctgacgaaataacgtgcgggaacaatgtacgtcaccgcgcggatcaccgcgggcatactgtctatctgaaatataaagccggaaagcataatcgacggcagaaaagccgcgttcagggccacctgagcggcgttgaactggttgcgggtaatcgtggaaatcagcagccccatccccagggtactgagtaaaaacaggctggagataaaaaacagaatcagcagcgacccgcgatacggcacgccgagaataaacaccgacaccagcatacacagcaacatcgccagcatcccgagaaagtaataagggatcagcttacacagcagcagctccgtgcgggtaatctccgtagagagcaaagcctccatggtgccgcgttcccattctcgcgctaccaccagcgaggtgagaatcgcgccgatgaccgtcatgataatggtcaccgcaccggggataataaagtgctggcttatcgccgcggggttaaaccagtagcgggtttgtacatcaataagcggttcaaaagtctgcccgttatcctccgcgcgctgcatttgccagatctgccagatcccttcgacatacccctgcacaaagttagcggtattcggctcactgccgtcggtgatcacctgaatcggtgcggtggcgttggcgcgctccatctgttcggcgaaatccaccggaataaccaccagaccgcgaattttccccgcctgcattttggcgatcagttcctgacggttatcgctgatggtggcgtcgatgtagggcgaaccggtcatggtgtgggtgaaatccagcgccgcttcgctacgctgttccagtaaaatcccgacgcgcagcttgctggagtcgaggttaatgccgtatccaaaaataaacagcagtagcagtgggatcactaccgcaatcagccagctactcggatcgcgaacgatctgccgtgtctctttgacgcacagcgcccgcacgcgacgccaggacaggatcggattactcattgctatgctccttatcccagtcgtggatcaactgaataaaggcttgctccatagtgggatcgggttgttcatcgttggccgactgcgctttcaaatcgtccggtgtgccgctggcgattaatttcccgcggtacaccaagccgatgcggtcgcaatattccgcttcatccataaagtgggtggtgaccatcaccgtgacgcctttctctaccatactgttgatatgtagccaaaattcacggcgggtgaggggatcaacgccggacgtcggttcgtcgagaaacagaatgtccggttcatgcatcagcgaacaggccagcgccagccgctgtttaaaacctaatggcagttcatcggtcgcgtgggaggcgatacttttcaggccgaacgcctcgctcatacgggagattttttcgttctgcgcccgaccgcgtaagccatacacaccagagaaaaagcgtaaattctgttcgaccgtcaggttgccgtagagcgaaaatttttgcgccatatagccgagatgctggcgcgctttaccggaactctctttcagatccatgcccagcaccagggcctgaccagaggtcggtaccagcaaaccgcacatcatcttaaaggtggtcgatttacccgcgccgtttggtccgagcaaaccaaaaatctccccgcgtttaacggcaaagttgacgtgatcggtggcggcaaaatcaccaaatttcttggttagttccttcgcttcgatcaccgtctcgccgggtgtgccttctaccgtatgtaatattgcgcccagcggcgattccgaggttccggcaccgcccagcaaatcaataaacgcatcttcaaaacgcggcgtagtttcgttgatgtcgatttccggcatcccgtcggcatggcgaatatcgtctggcgtggtctcttttttgaggatcagacgtaccgatttcccctgaatcatgccgtcgctgacctgcggcagtttcaatgcccgttgcaacagtttgcggttgccctcgtgcgggctggtcatcagaaagctgcgtccggccatagtttgagtcagggccgtcggttctccctgatacagcagctcgccttcgttcatcagtaacacgtcacggcactgctcggcttcgtcgagatacgaggtactccagaggattaacatcccttcgcccgccagctcatgcaccatctgccacagttcgcgccgtgagatagggtcaacgccgacgccgggttcatcgagcagcaacactttcggttcgcctaccagggtacaggccaggccgagtttttgtttcatcccaccggagagcttgcccgccaggcgtccggtaaacgggccaagagatgtaaactccagcaggcgagcaaaagtctgcttccgtgcctcgccggtgacgctgcgcaaatccgcgtacagattgagattttccatcaccgtcagatcttcatacaggccgaatttctgcggcatatagccgagcacggcgtgcagcgcagcgtcgtttttgatcggatcaaagccaatcaccgtggcactgccgctgtcgggtttcagtaatcccgccagcatccgcatcagcgtggttttgcccgcaccgtccggcccaaccagccccgtcacataaccggcgtgaatggtgcagtcgagcggtgcgacggcgggcttgtccatgcccggaaagcgtttttccaggccgttcagcgtgataacggcatcattcatgtcctgcctcgtcaccgaattgcaccgttaccggcattccctggcgtaacgcatcatcggcgtcggtcaccacaatacgcaggcgatagacgaggtcggtacgcagatccggtgtttcgacggttttcggggtaaattcagcagtcggcgaaacgaaaccaatctgcccgtgatacggtttgttcggacgaccatcggtataaagcagcactttgcgccccggctgggcctggtcaagattacgttcatcaacataggcgcgtacccacaccggacgcgtcagcgagacggtaaataccgtgccaccttcattaagcaccgtgccgggctctaccgcgcgcgttaacagcgtgccatcagacggtgctatcaacgttgagtcctgcaaattcagctccgcctgcgccagttgcgcctgcgcttgttcgaggctggctttcgcctgggcgatgtcctgttcgcggttaccggaacggtactgacgcaatttatcctgcgctgatttcagcgtggcctgcgcctggtcgcgcgaggagcgggcattttccaggtcatttgccgaaatggtgcggcttttccacagtccttgctggcggttatagaagttctgcgcatagtcataggcagcttgcgcctgtttcaccgctgcggcggcctgagcgatttcttcatcgcgatacccggcaagcatcaggtcatactgcgcctgagccaccgaaacgcccgctttcgcctgcatcagggcaatctcatacggcttgtgatccagttcgcccagcacctggcccgctttgatcgcatcaccttcgtccaccgccagcgactcaacgcgccccccaacacggaaactaagattcaccgtacgaatatccacgttgccatacagcgtcaggccgttatcctggcggctttgataccaccagtagcctccggcaaccacggcggcaagtactactaccgccagtccgatcacgacaggttttttcatcactacaaactcctttgcgataatccttgcaaaatcaggtcaatatgacaggtcaccgtctggttgatcagttcggtcttttcttcatcgaacgcggtccagccggtacgtaacagaatagtttctttgccaagacgaaacgccagaatctcaccaatcaacgcatgggtatgaaggatcatgcgggtatcgctagcgtcgcagccggtccaggcggcaatcaggcgtgtaaggtgactgtgtagcggactaatcacctgttcgtgcaccaggtggtaggctgccgtgggagagagctgctcacgggagataaatttgctgaggttgacggtgtcatcctgggtgagcagcttaatcatgtttctgcaggcgcgaaggatcagttcacggatggctgcccgatccggctgtggttgtgcgaacaaacgttcggcttcttcggcgtgtggacggaactgctcgccaataaaatcagcaatccactgggcgcaggcgaggtacaaatcttctttcgaaccgaagtagtaggtgatggctgcgatattctgcccggcctgggcggctatctcgcgggtggtggcgttcattccatattcaccaaactgtgccagtgccgcagcaatcagctgttttttcgcctgttcacccttgattgtcatggcaggattattcatcgcacagtccattcttaatcaaatgattgattaagattatgactccataggggagttgtccagtatggctaagaattttagctacgccagtcacagggataatttatgcgctgcgtcacaaaaactgctacactccgctccctcatgacattgtggtttttgtcattttccttttcagtatctccctgaaaactacaccggtaacggtcggggcggttcggagtagttatgtctttcgattctttgggtttaagccctgatatcctgcgcgccgttgccgagcagggttaccgtgaacccacccctattcagcagcaggcgatccctgcggtgctggaaggccgcgacctgatggccagcgcccagaccggtaccggcaaaacagcgggctttacgctgccgctgttgcaacacctgatcactcgccagccgcacgccaaagggcgtcgtccggtacgcgcgctcattcttaccccgacccgtgaactggcggcgcagattggcgaaaacgtccgtgattacagcaaatatctgaacattcgttcgctggtggtgtttggcggtgtcagcattaacccacaaatgatgaagttgcgcggcggcgttgatgtgctggtggcaacgccgggacgtctgctggacctggaacatcaaaatgcagtgaagctggatcaggttgaaatcctcgtccttgatgaagctgaccgcatgctcgacatgggctttatccacgatatccgtcgcgtgttaacaaaactgccagcgaagcgccagaacctgttgttctccgcgaccttctctgacgatattaaagccctggcggaaaaactgttgcacaacccgctggaaatcgaagtggcacgccgcaatactgcgtctgatcaggtgacccagcacgttcactttgtcgataagaaacgcaaacgcgaattgctgtcgcatatgattgggaaagggaactggcagcaggtgctggtgtttacccgtaccaaacatggcgctaaccatctggctgaacagcttaataaagacggcatccgtagtgcggcgatccacggtaataaatcgcaaggtgcgcgtactcgtgcgctggccgattttaaatcgggcgatattcgtgtactggtggcaactgacatcgctgcgcgcggtctggatatcgaagagttgccgcacgtcgtcaactatgagttaccaaacgtaccggaagattatgttcaccgtatcgggcgtactggccgtgcggcggcaactggcgaagcattgtcgctggtgtgtgttgatgaacacaaactgctgcgtgatatcgaaaaactgctgaaaaaagagatcccgcgcattgcgattccggggtatgagccggacccgtcaatcaaagccgaaccgatccagaacggtcgccagcaacgtggcggcggtcgtggacagggcggtggtcgcggtcaacagcaaccacgccgtacggaaagtggtgcgaagtctggtaacgcgaagcccgcagaaaaaccgtctcgtcgtctcggcgatgccaaaccggcaggcgaacaacaacgtcgccgccgtccgcgtaaacctgccgctgcgcagtaatcttttatgccgggctatgcccggcatgagactgatgacaaacacaaaactgcctgatgcgctacgcttatcaggcctacgtgaactctgcaatatattgaatgtgcatgtttttgtaggccggataaggcgctcgcgccgcatccggcatttcacaacaagcacttgtcagccatttgcgagcgcggcaaaaagatttctctgttttaacgcccacaagccacccgatgcgttacttctccgcagccaattgtccgcgcaacgccattaaaaggtaccccaggcgattcttgccctgaccattaccgccatctccccagtaagcatcattttgcgtatgctcaaccagttttgcggacgcggttgcccgcaagagtgtacgcagttctgcatgttgttcgaatttagcgcgaagcgctttacgcatcatcctgctggttattgcgagccgctttcccgaaacagaaaaaccattacccctgaaaaccgaaaaatgccacaatattggctgtttatacagtatttcaggttttctcatggcattaaccgccgcgcttaaagcgcaaattgccgcctggtataaggcgcttcaggaacagatccccgactttattccccgtgcgccgcagcggcagatgattgcggacgtcgccaaaacgctggccggagaagaagggcggcatctggcgattgaagcccctaccggcgttgggaaaacgctctcctatttgatccccggcatcgccattgcccgcgaagagcaaaaaacgctggtggtaagtaccgccaacgtggcattgcaggatcagatctacagcaaagatttaccgctgctgaaaaagatcattcccgatcttaaattcactgccgcttttgggcgtgggcgctacgtttgcccgcgtaatctgacagcgctcgccagcactgagcccacgcaacaggatctgctggcgtttcttgacgatgaactgacgccgaacaatcaggaagagcaaaaacgttgtgcgaagctgaagggcgatctcgacacttataaatgggatggtctgcgcgatcatactgatatcgctatagatgatgatctctggcgtcgtttgagtaccgacaaggccagctgcctcaaccgcaactgttattactatcgcgaatgcccgttttttgtcgctcgtcgggaaattcaggaagcggaagtggtggtggcaaaccatgcgctggtgatggcggcgatggaaagcgaagcggtattgcctgacccgaaaaatttactgctggtgctggacgaaggtcatcacctgccggatgtggcgcgggatgcgctggagatgagcgccgaaatcaccgcgccgtggtatcggctacagctggacttgttcacgaaactggtcgctacctgcatggagcagtttcgcccgaagaccatcccgccgctggcgatccctgaacgtttgaatgcgcattgtgaagagttgtatgagcttatcgcctcgttaaacaacattctcaatctctacatgcctgccgggcaggaggcagagcaccgttttgcgatgggcgaactgccagatgaagtgctggagatctgccagcggctggcaaaactcaccgagatgctgcgtggcctggcggagttatttcttaacgatttaagtgagaaaaccggcagccatgacattgtacgtctgcatcggttgattttgcagatgaaccgcgcattggggatgttcgaggcgcaaagcaaactctggcggctggcgtctctggcgcaatcttccggtgcgccggtgaccaaatgggcgacgcgggaagagcgcgaagggcagctacacctttggtttcactgcgtgggaatacgtgtcagcgatcagctggaaaggctgctgtggcgcagtattccgcacattattgttacctccgcaaccttgcgttcgctgaacagtttttcgcgtttgcaggagatgagtgggctgaaagagaaagcgggcgaccgttttgtggcactggattccccttttaaccactgtgaacagggcaaaattgttattccccggatgcgcgttgagccttccatcgacaacgaagagcagcacattgccgaaatggcggcctttttccgtgaacaggtggagagcaaaaaacatctcggtatgttggtgctgtttgccagcgggcgtgcgatgcagcgctttctcgactatgtgacggatttacgcctgatgttgctggtgcagggcgatcagccacgttatcgcttagttgaactgcaccgcaaacgcgttgccaacggtgagcgtagcgtgctggtgggcttacagtcctttgccgaaggtcttgatctgaaaggcgatctgctcagccaggtgcatatccacaagatcgcttttccgcccatcgacagcccggtggtgatcaccgaaggtgaatggctgaaaagcctcaaccgctatccgtttgaggtgcaaagcctgccgagcgcttcgtttaacctgattcagcaggttgggcgactgattcgaagccacggttgctggggggaagtggttatctacgacaaacgcttgctgacaaaaaattatggcaagcgactactggatgcattaccggtatttccgatagagcaaccggaagtccctgaaggtatagttaaaaagaaagaaaaaacgaaatccccacgccgtcggcggcgttaatgatgtgagtcaggtaaggagtcgtaaatggactatcgcaaaatcattaaagagatcgggcgcgggaaaaaccacgcgcgcgatttagaccgggatactgcgcgcggtctgtatgcccatatgctcaatagtgaagtccctgaccttgagttgggcggcgtattgattgcgctacgtatcaaaggggaaggggaagcagagatgctcggcttttacgaagccatgcaaaatcacaccatcaagctgacgccgcctgcaggcaagccgatgccgattgtcatccccagttacaacggcgcgcgtaaacaggccaacctgacgccgttgttggcgattctcctgcacaaactcggttttcccgtggtggttcacggggttagcgaagatccaacccgcgtgctgacagaaaccattttcgaactgatgggtattacgccaacgttgcacggcgggcaggcgcaggcgaagctcgacgaacatcaaccggtgtttatgcctgtcggcgcgttttgcccgccgctggaaaaacaactggcgatgcgctggcggatgggcgtgcgtaacagtgcacataccctggcgaaactggcgacgccatttgccgaaggtgaggcactgcgtctttccagcgtttcgcatccggaatacattggacgcgtcgcgaagttctttagtgatatcggcgggcgggcgctactaatgcatggtactgaaggtgaagtgtatgctaatccgcagcgctgcccgcagatcaatctcattgaccgtgaagggatgcgggtactgtatgaaaaacaggacactgctggtagcgagttactgccacaagcaaaagatccggaaaccacggcgcagtggattgagcgttgccttgctggcagcgaaccgattcccgaatcgctgaaaatccagatggcttgctgcctgatggctacgggtgaagcggcaactatcagcgacggcctggcgcgcgttaatcaggcattttaatttttatctcagccggatgagccatgtcatccggcttttaccccaccgcaatatgaaattcctgcatctttattgaccttcccgcgcccggcgtgcagcataaaaaaacaacaaacacataacataaacaggagttaaccatggtaagtggtcatcgctttgatgctcagacgctgcacagttttattcaggctgtatttcgtcagatgggtagtgaggaacaagaagcgaaattagtcgccgatcatttaatcgcggcaaacctggcagggcatgattcacatggtattggcatgatcccaagctatgtgcgctcctggagtcaggggcatctgcaaattaaccatcatgccaaagtcgttaaagaagcgggggcggcggtcacgctcgatggcgatcgcgcatttggtcaggtcgcggcacacgaagcgatggcgctggggattgagaaagcgcgtcagcacggcattgccgccgtggcgctacataactcgcatcatatcggccgtatcggttactgggcagaacagtgcgcggcggcggggtttgtctctatccactttgttagcgtggtcggtattccaatggtcgcgccgttccacggtcgcgacagccgctttggcaccaatccgttctgtgtggttttccctcgtaaagataatttcccgctgttgctcgattacgccaccagcgccattgcatttggcaaaacccgcgtcgcctggcataaaggcgtccccgtgccgccaggttgcctgattgacgttaacggcgtgccgacgaccaatccggcggtaatgcaggagtcgccgttgggttcgctgttgacctttgccgaacataaaggctacgcccttgcagcgatgtgtgaaattcttggcggggcgctttctggcggtaaaacgacgcatcaggaaacgttacaaaccagtcccgatgccattctcaactgcatgaccactatcattatcaacccggaactgttcggcgcgccggattgtagtgcacagaccgaagcctttgccgagtgggtgaaagcctcgccgcatgatgacgataagccgattttgctaccgggcgagtgggaagtgaacacgcgtcgcgaacggcaggagcaggggattccactggatgcgggaagctggcaggccatttgtgatgcagcgcggcagattggtatgccggaagagacgttgcaggctttctgtcagcagttagccagctaaaaaaagcccgtccagtggcggacgggcaaacaagggtaacataggatcaatgagggttagagcatatgcgtctgtcggcaaacagacagggaaatacttgtgctgaacgtagcgtaaacgcctgatccagccaacggttcggattttgtaggtctgataagacgcggtagcgtcgcatcaggcatctgttgccggatgcggcgtaaacgccttatccgtcctacgaattacttataaattaccgcagtaccgcttaatttattgttgttggtggcagaagtgatgctgtatccactggcaccggccgccgcggctttctcagccagtttcgcttccagggcatcgagggtggatgcgccatcggcagaaaccacgccgattttattcatgttctgtgcctgggatgccgttaccggttccgccgcgaacacgccaaatgacagagttgaaagagccatagcagcaacaacagtattgatagttttcataattaatctctcgcaggtgatttttgtataagtgacgttgtttcgtcgatgtgatgagtatcacgtttttttacgagagataaaatcgaagagaattgaccgccttgttcaaataaattgattgatatctaacatactgataaaccatttatttgttgtatttatgaatccgttttgtaccgcgtggtgctcacggcagcgttaaaggcacggaatgccacgcaaaatacaaattacactcactaaacatcccgtcagttgcagttaacgtaactggctgtctttcgaacctctgcgattatatcctgtataagctggtttttgtaaatctttctcctgttggcaatgaatgcataagcgcacgccaggaatggcttcccgacgggcctgcgggataggggcaccgcactcttcacattcatacaggctttcgccacgcggaatttcaccccgagcgcgggcaatcgcatcttcaattgtactgttgatctgttcgttgacggcgtcatcattagcccaaccggatgccatatcgtcctccccatatcaatacttgtacagttaagtgtagctaatatagggacgaactcgggcagttcaagcgtcagatctccgaccattcccgcagcagattatgataaagattgagcagtgacaggatctcttcactttcgccgtagcggcttttcagcgactgaatattgttgtccagttcaaacagcatggcgcgctttttatcatcacggatcatcgactggatccacataaatgatgccactcgcacgccgcgggttacgggtgtcacgcaatgcaggctgctggagggatacaacaccagatcgcctgccgggagttttacccgatgttgcccgaaggtgtcattaacgaccagttcgccgccgtcgtagctttctggatcgcttaaaaacagcgtggcagaaaggtcagtgcgcatccagccgttttgtggatggctgcgtactgcgccatccacatgaaaaccataggtttcattgttctgatagcgattaaacagcggcgtggaaagggtacgcggcaaggccgcggcaaagaacaaagcatgttggttaaccgcgttcagcacctcattttgcagggcggcgtacagggcgctgcgggtgtctacttgttgattgttcttaacttgcgcaccttgtgcgccggtggtgacgcgcccatccacccattcggcttgttccagttgttcgcgaaaacgggcgacgtcctgtggcgataacacgccgggaatgtggtacatcatacaagttctccaaaaagtggggcctgcgccccacaccgatttttaacagcaggcaatggtgctcaggtgccggatgcggcgtgaacgccttatccggcctaccaaatgatgtgaattcagtgtattgcacaaccttgtaggcctgataagcgcagcgcatcaggcagtcctgctctcgccatcaacattagtgagccttgcgccccacatctgaatcagaaatgcatattggctgtgagcaagaaggttcttggctcgcccgggtgataacggtagccgctcttattgattgaggcgacgtaatcggtatcaaacaggttgtagacgtttagctggaagtcgagattgcgattaacccgataccccagtttggcgtcggcgacccaataaccttcggtaaatgctggcgtccccaccgcgccgtctgaacctttatgcatactgccgatataccgtgcgcccgcaccaacagaaatatcatcggttgcctgatactggctccataaggtgaaggcgtgttccggggtatacggcagcgatgaggaaccatcctgggcaacatctttgccgtttttgatagttgctttttgctgggtatagccgccaatcatctgccacgcgggagtgatattcccggccacggatatctcgtagccttcgacacgtttcttaccatattgcgaataagtcccgtcatcattttgctcaacttcattttcaatatcagtacggaacagcgcggcggtaagtagcaggcgtttatccagaacctgccatttggtgccaatctcgctggtgttggctttttgcggtttaaaatcggtgcggttggcactgttaccgctgccagactgcgcaagggcgaagttgttgccgcccggcggctgctgggaaacggcatagttaatatagatattgccgttttccgtcaggtgatacagcgccccggctttccagttcaccagattgcccgacttggcggtgtcgacggtggtgaccggagaaccttttgccacgccagcagggcaggtgatggcaccgcgcccgctgccgccgcaggcggtggcactgtcatattcagtatgataattatccagacggatcccaccgttcagctcaaaatcacgggtgatttgcagcgtatcgaaggcataaattgcgaaggtatccgtctgaccattggcgtttgcgccgttgcgcgtcaggccaccgggatgaatgctgctgtcaggatgataaatatttaccgccggtaacgtcaccggattaacgccatagttagtctgtgtttcgcgggtaaattccacgccggtactgacatcatgaccgatagcgccggtatagaacgtcgaggtcaggttggtctggttggtgagaattttgttactcacatctttggtattcgccgtacgtgaccacgtccagctattcacatcgctggtgggctgggtaatattcgacgctccacccataatcgccgtcatcaggtaatcctgctttacgcgcgaccaacgcgtagtgttgcgaatggtggtgttatcgttgatgtcgtgctcaaaacgcatggtagcggtgtcggtggtcgaatcgtcgtaatcggaatccgtgccgtaaaagttatgagtatcaacttttccggaatgattcagggccgctgttcccgcagatggggcagaataacccggtaaaccgatggtcggaatgccgccgtctggcgtgttgtgttgggtgacatgcagataattaagatacaaacgattcgctgtaccaaggccaaaagcgacagaaggggcgacgccgtaacgctcatttttgactttgtcgcgtccggcatcgtgcgttttttcgcccattacattcaggcgcaccgcagtggtatcaccaatgacctgattgacgtccagcgtgccgcggcggaaccaggcgctgccaatactggcggaggcgtcaatgccggaatcattgcgcggctgtttgctgatcatattgatcgagcctgtcggcgcgctgcgcccgtagtcggtgccggacggccctttaattacttcgacctgctcggtattgaaggtgtcgcgcgagacgctgccgatatcgcgaatgccatcgatataaatactgttagaggtatcggcaccgcgcatataaatggcgtcgccagtggtggagttaccgttctcacccgcaaaaaacgcacccacgccggggacgtttttgagcgcgtcggtaaggttggttgcaccctgatctttaatcacttgttcagaaatcaccgtcatcgtgcgggtagtatccgctaccggacgcgagaatttcggatcggcagattgttgtggcgcataaagcgaaggcgttgatgcttcgacaaccagcgtgtcatccgcgttagcttgcccttcggcagcgagtgcctgcgccacaggcgtaataccaatacaaagaccggcaaagaacgtgagcgaatgaaattgtctggcagggaaattgcgattgttttccattttgcaggtgactttttcttatatggtgaaattttcactgtcacgagaaagcatctctgcggatgcgatgccactgttaatcccgtgatagcgtccgtgcaagtgataataattttgataagtattatcacttggcgcgattttctatcacccattgcgcgaaaaagaaatacatttatttacattgcgttcatatttgatgttttttgcttacaaatcggacgaaaactgcatccagaggcgaatgcagttacgttggtggggttatttgtagatgattgcagtaccgaacatctggtcatttccgcctgcggaattaatgacataacctttcgcgccttgttcgcgcgctttttctgccagtttatcctccagatcgcttaggtttgatgcgccagttgccgaaacggtaccggcgggccgtagttgaccactgtccaggttactcatcggttgcgcggcataagccgtgagagagattccgctcaggacggtggcaatcagtagtgtgaggcactttttcataatgacatcctcataaatacaacgggtagtgccagataagtgtaggtcgcctgcgcgatgaaaatgacgcaaaaaattgacagagatgtgcttattttttgaacgatatgtttttacaaaataagacaaatcaatgacatgcatgatgatgatttttatggtgaattgccataaaccatagccatgtgaaggtttttagaaatgataaacgcagccagatatttaccctgtcgcgttatgcgggtatcttacgccgctgcttaaaggagaatgctatgtccgcccagaaaccggggttgcatccgcgcaaccgtcatcacagccgctacgatctcgccacgctttgtcaggtcaatcctgaactcaggcaattcctcacgcttacacccgccggggagcaaagcgtagactttgccaatccgctggcggtgaaggcgctcaataaggcgttgctggcccatttttacgccgtagcgaactgggatatcccggacggttttctctgcccaccagtaccgggtcgggcggattatattcatcaccttgccgatttactggcagaagcaagcggaacaattccagctaatgccagcattctggatatcggcgttggtgcgaactgtatttatccgctgattggcgtacatgaatatggctggcgttttactggtagtgaaaccagcagccaggcgttaagcagtgcgcaggcgatcatcagtgctaatccggggcttaaccgcgccattcgtctgcgtcggcaaaaagagagtggggcgatttttaacggcatcatccataaaaacgagcaatacgatgcgaccttgtgtaacccgccattccacgattccgccgctgcggcacgggcaggtagtgaacgtaaacgccgtaacctggggctgaacaaagacgatgcactgaactttggtggtcagcaacaggagttgtggtgtgaaggcggtgaggtcgcttttatcaaaaagatgattgaagagagcaaaggcttcgcgaagcaggtgatgtggtttacctcgctggtatctcgtggtgaaaacttaccgccgttgtatcgtgctctgacggacgtaggtgcggtgaaggtggtaaaaaaagagatggcccaggggcaaaagcagagccgctttatagcctggacctttatgaacgacgagcagcgccgccgttttgtcaatcgccagcgttaaagcgttggttcccccggcggcaacggttcagccggggtcgcgcccggagcaggcagcacctgataagtctgcactggcgcgcgaacgcccgccaggtcgaaatgttttttcacctggctgtcgagggcaaagcgtaccgtccactgtttgagtggcagcgtggtgaacgaaacacgcagtgtaaacgcggtattgcttaagccgacaatcccggcaaaattcggttcaccaataatcagcccgcgaatttcttcgttttccattaattccgctaccgcatctttcagtgcctgattggctttatcagcatcttcatggcgatcaacatcgtagtttgccactaccgaaccaataccgcggacgaagttagcaaaggtggttatcgaagaccacggaatgatgtgatacgccccggtatcctggcgcacgcccacggagcgaatcgacatccgttccacagtgccggtcaacggcccgatagtcaccaaatctccagtgttcatgccgttttcaaactgaataaatactccggtaataatatctttcaccagcgtttgcgaaccaaacgagatagccagacctaatgccccggcacctgccagcaatggcgcgatattgacgccgatttccgacaacacaatcatgatggtgatggtactgataatcaccgccagcgcgttacggaacagcgtcagcagggttcgcgtacgggcgctgggtagcgggcggccatgaatatccgaagccagccggttttctatcaaactggcgagcaccgtccagccaaccgccgagaagaaaagaatgagtgcgatacggatcaggatatctacggttttctgccccgcgccgttttgcagccagttccagaaatcgaacaatccccatgcgctcaacagcagcattaccgccacgcagactgtcagaatacgcgctgttttcagtgccgccgaaagccagccattcagccgtttttgcagctccggataatttcgctgagtatgtggcgagagggtgatggttttcgccaaccagcgggaaaacataccggaaacaaatgctgcgataccaataatcgccaggctgcgcaccgttgcacccatcataaatttcaggctgttgcccggatcgaacaacgaaaagaaaaacagcacgataaaataggcgcttgccagccagtgccacaccagcgcaaaggcgcggataaacaggctgaaaaaggccagcgaatgctccgcaaagttgagcaaatgctgggtgatctcttttttattacgaaaaatcaggtacaacgcccagacggtcatgcacagcataatgatgacgttcgccagcgcacctatctgtacattcacctgattagagataatcggcacagccacaatcagaccatagccaatcaggctgcttaaccagctcaggcgacgactccagtaacgggcggtctcgtcatgaatcgtgaacgggcgcagttcagccacgtttgggcaaaaaatcaggcgtagtacggctttgaaaaattcaatcagggcaaaggcgttgagaaacaaactttgttggaaagcgatggtgcgactgcccgcattcaggttgtcgcttaatacctggccgacaaataatgtcagtgccagtaacagcaggtcgataataaacgccccgatgatcatcgccggaagctgcaaccagttactgcgctcacgatttttttgccgcgcccactggcccattttgcgatacagcggcagtgcgcacagacgaatcagccagtaaaaaccaaacactaataccgctaacattgaaaagtgggtcagcgcattgctgaaggtttgtggattaaacggcttatgcggggagccggtgatattgcgataaagttgcccgaagcgggcggaaagggcttcaccataatggcggctgacttcggtgactttttgcagcacggtttgctcttcaaccaacgtcggcggcacgatcttcggtacgggttccgcaggaggcgtagcggcgacggtgcgcaactggtcgatcaactctttacgcgaggtgtcattatccagcacatccgccagtgcgccataggccgcttttttttgttcgatatccggttccggggccggttcagtcgttgagtccgttgtcgttgtggttgtaacgccgggtatggataccgcgtgggcaggtgcgcccaacaggcagaagaggatgaacaggatccaccgcatgactcctccagtgagaaaatagagcaaaaagataagtatagatgctggaggctgggcgattttaaatgagaggaatctggtgtgcctccctttcgggggaaagggaggctgagaagttaagagacgtgctgcaaaaattcctgcaagcgctggctcggtgggttcttgatcaacacctgcggatcgccatcttccgcaatccggcctttgtcgataaagatcaggcgcgaagctactttctcggcaaaaccgatttcgtgtgtcacgatcaccatcgtcatcccttcttcagccagatcctgcataaccttcagcacttcatggcgcagttccgggtcaagagcggaagtcggttcatcaaacagcatcattttcggcttcaccgccagcgcgcgggcaatcgccacacgctgctgttgaccaccagaaagttcggaagggtagtgatgtgcacgttctgccagaccgactttcgccaggagctcacgcgccagtttttccgcctcttctttattcgcgccacgcacgcgtagcgggccaaacatgacgttttccagcgccgtcagatgcgggaagaggtaaaactgctggaacaccatacccgcttcctggcgaatcaggcgctcatcaactttcggatcgttaaccttcaggccatcgacaatcagatcgccggaggtgatttcttccagtttgttgatgcagcgcagcagggtcgatttaccggaaccggacggcccgataatcaccacgacttcgccctgagcaatgttcaaatcgatattgtgcagcacctgggttggaccaaaatgcttggagacgtttttaaattcaatcacaggattttcatccttctttccagacgacgcagaataaagctcagcaccagggtaataatcagatagaacaccgccacggcgctccagatctcaagggcgcggaagttaccggcaataatttcttgcccctgacgggtcagttccgccacgccgataacaataaacagcgaagtgtctttaatgctgatgatccactggttacccagcggcggcagcatacgacgcagtgccagcggtaaaatgacgtagcgaatggtttcccaacgtgaaagaccgagcgccagtcctgcttcacgaaaacctttgtgaatagatagcaccgcaccacgcgtgatttccgcaatgtacgcgccggagttgatcatgatggtgaccaccgccgcagtaaacgggtcgatgcgtaaatcgttaaacgccatcggcagggcgaaatagataaacatcacctggacgacgataggtgtgccgcggatcacttcaataaagaccagcgcgacgtggttggctatccaaccaccgaaggtgcgtgcaaaacctgccaacaatccgatcaccagaccgccagccagaccgaggaccgaaatccacagggtcattttggcaccttcaatcagaagcggaatggcaggccagatggcactccagtcaaactgcatatgttgttcctgttaccgtggtgtaaataatcaaattcagggtaattaatggccccggagcgggtttgcgcccttcaccctaatcctctccccggcggggagagggaactgccagtgcgctttacaggcgccgcgttattatttcggttcagtaccgaaccattttttgtagatttcgttgtaagttccgttctcgcgcagggttttcaacgcgccgttgactttgtcacgcagctcgtcgctacctttcgggaacgcaataccgtattgctgtgcttccagagagtcacctaccgctttgaactgaccgttaccggcggttttgatgaagtacagaatgtttggcgtatcgtgcagaacggcgtctgcgcggttggtgcccagttccatataggcgttatcgatattcgggaactgacgcagatctttagttttgatgtttgctttcgcgtaatcaacggagccagtgccgctcttcacagcaaccactttcccgtcgagatctttcacgcttttcacatcgttattgttagctttcaccatcactaacaggccgcttttgtagtagccgtcagagaaatcgatcgcttttttacgctcgtcggtgatggtaatgcccgccagcgccagatcgacgtttttggtttgcagtgctggaatgatcccactgaaatccatcggcttcagttcgtaatccagcttcagttctttagcgatggcagcccacagatcaacgtcaaagcccacgtatttatcgccctgtttaaattcaaacggaacgaaggcagtatccgtcgcgacaactaattttttatccgcggcatgagaagaaaccgcaaaagccagggtcagtgcagccagtgaaacttttaatacagacttcatagcatttccttttttctatccacgggacgatcccctgcgtgacattcacatatatgaaaaaatcgtgccagttttgcaactcattgatttttcgagatgcggcaagaacgtgatgcacgatttatagggcaataccctgaagatgcaccattctggggcaccaaactggtgcgctaaaattgtgcactcaacacagtgattatttagcgtaaaacctgatgaaaaaacaatctttatgtaacgattgtgtgatgatgtggatacaaaaaatttacttaaccagctggggatagcagatggatgcactaaataagtgcgttgaggcgggctacaaaacaaaacggcctcctgtcaggaagccgcttttatcgtgtactaaagttctgcaccatcagcgatggatttattcgatgttagactcgataaaccacaggaatttatccaggtcgcgagacgcggcggtcaggatatctgcggtgtcgtcatctttcgcttcgccaatcgctttgcgtacgtcattagcgacgattgcgtaacggtcagccagctctttcaggtgatcctgaacgttgtggatgtccagcgggtaacttttcagcggagttttgctgttgataacttgagtggtccccagagctacaccgcccagctgcactgcacgttctgccatggtatccagatgatcgatcagtgcagtgcggaagccatccagcatttcatgtacggcaatgaagttagcgccgcgcatgttccagtgcgcttgtttcgtaatcaaagaaagatcaataaactggataacctggcgattcagcaactctactgttgcttttttctcgctgtcagagacatcgttgcgggtataaagcagattggtcgcttttgatttaactaatttagcggtactcataatttcatatcctcttgatgttatgtcccagtaattaacgagactaagtatagcaccagctatgtgttccgctattctggctgttcctatcacactaatagtggtaacaagcgtgaaaaacaaaaccaataaaaattcaataagttagatatattgataagaacaattcttatttatttgctcgctaggaattttcggaataaatatgcttttgcataattcgatatataaagacggtgtagaggaaaagtagcgagaaaatctgcatggttatgcataaccatgcagaaatgtaaatttaatttatgtctaattcttttattttgctctctttgcgtactgtcagcgtagaacccattgaagcggcgatgatagcgccgagcgccagcagctgtatgggtgtcagtgtttctccgaggaaaatcatcccggaaacggcagccagcgccggttccatgctcattagcgtaccaaatgtgcgtgttggcaaacgggtgagggcaatcatttccagcgaataaggcagagcggtcgagagaatagcgacagccagacccaatggaataaccgaccagtgccagagtgcttcaccagcctgaagcgctccaattggcacgaaaattaacgctgcaatcaacgaaccaattgccaccgtcgcaggaccatgttccgctccagcgcgttgcccacttaaaatgtaaatagcccaacaagccccggcccccagtgccagtgcacagccggttaaatcgacatgggaaacgtcttgccccagcggtagcaggaaccatagaccaagaaccgccagcacaacccagacgaaatctaccgggcgacgagaagagaacagtgccaccgccagtggtccggtgaactccagcgccaccgctatacccagcggtaccgtctgaatagaaagataaaaaagataattcattccacccagcgaaacgccgtaaaacaacagcggtaatcgttgctctttggcaaagcgcagtcgccatggcttaaagaacgcgatgaggatcagcgtgcctaatgccagacgcagcgcagtgacccccggtgcgcccaccagaggaaaaagtgacttagctaacgaggctccaccctgaatagacgccatggcaacgagcaatatgactattggtaaccagaccggcattttacgtaatgaaccaggcatcctttctcccacaaatatctaaacctaagtaaagcgtggagtgtactggatatacccaatgctggttgagcatttgttgaaaaaattttcccccgttttgactaaaatgcgccaggattgatggaatcattagtctggtgattaggaataatctggatgaatgacagggaaaacatgcgtaatacttacgcagttctctgaaaaagtgatttaaatttagatggatagcggtgtatggaaacgttctgttacatgaaatggtccgttagacatcataaatcgcgaagagtttcccattaatttttgatatatttaaaacttaggacttatttgaatcacatttgaggtggttatgaaaaaaattgcatgtctttcagcactggccgcagttctggctttcaccgcaggtacttccgtagctgcgacttctactgtaactggcggttacgcacagagcgacgctcagggccaaatgaacaaaatgggcggtttcaacctgaaataccgctatgaagaagacaacagcccgctgggtgtgatcggttctttcacttacaccgagaaaagccgtactgcaagctctggtgactacaacaaaaaccagtactacggcatcactgctggtccggcttaccgcattaacgactgggcaagcatctacggtgtagtgggtgtgggttatggtaaattccagaccactgaatacccgacctacaaacacgacaccagcgactacggtttctcctacggtgctggtctgcagttcaacccgatggaaaacgttgctctggacttctcttacgagcagagccgtattcgtagcgttgacgtaggcacctggattgccggtgttggttaccgcttctaatcacttcggtgatataaaaaatccgcctctcggggcggatttttttgttttaaggtttcgggtcgaaaatatcggttccgagatggttgtaatccaccttctgtaactggaagttggtgatgtatatcggcccggctttcttctcagatataaacgggtatttgatatttatttccttcgctttaattcccgtccactgcgagaaaaagcctaagaagtcattggccgagcggcgggctttaatcacccgatgcgctttatcgtcgctggaaatgaccataaaaggcacctggaaattttgctgatacttatcatcatgggcaaggtattgcacgtctttgccgcgctctttaaaggccagaccgtggtcggaaaagtaaaccagcgagaagctgctgccgctgttgcgtaactgatcgtacagcttgcgcagtaaattgtctgtttgcgtcatggtatagagatagcacgacgtttctttcgattgcacaaaggtttcgtattttccttgtgtccggtcgcaggcctgcggatgcgagcccatcagatgtagaacaatcagctgcggttgcgagtgctcttgcgccagcacttgagcggtcatatccagtaacgcttcgtctttcgtgtttttatctgcttcaaaattaccttctttcaggaagtacacttcatctgctcgtttggcgatgctggcgatggcggtatcgtattcgccgatttggccctggttggaaaaccaccaggtctggaagcccgcgcgatttgccagggtgacaaagttatcctgaaactgtggtttgccatcgacaacgcgattgagcgttaagccaagcgatttctgcgtggagccactggcggcaatgtagtcagcaaatatcaaaccgttaacgctgctggcaaacggggtattgtcccagtgaccgccaaaggcaccgagggcatcgcgacgcgcgctttctccgatcaccaccacataggtctgatacttcggcttaacggcagtgaccgtccaggtatctttcattccggaaagttttgccatccgttcttgctcttcaatcacctcgttattattgacgatgacatccttagcaaaacgaaataccggatagccagtatctttcagtttaaatacgccgccccaggccaggttttgcacgggagcaacaaaaaatgtcgccacactgaataccaggcacaggctgtcgaaggtattccagcgcgctttttcactctctttttttcgcctgattgctattacgccgagcgcaaaaataaatatgccgaccaggtagctgtaccacggaaaaatcgtcaggatttcggtcgactcttccatattggtggagtgcaatgccagcaatgtattgaagttaggcgcgccgtaggcctgagcaaaagggaaataacaagccgccaccagcgaactgataccgaccagaactttttgtacgcgaggcaatgttcgccatagcaaaagcaaaatagccgtaaacgcagcggtgtagagcaaactgaaggggtaacctaagccgaggttaattaatagcgactgtaaaaagtagaacgcagtccacgggctaaatacccggctacgggtaacaagcgattctttgagggttaaattcatatgccactatcgtaacaaacgccatgtgcttaccctggcgtcaagggtcaatacctgcaagagtgcgtgaagaggggaaaggggtccgcatccgcgagccgcaatatacgcagggctgcaagaagatagagcgagctgctgttcaggtcaactaccgacgaacaaatcttttgcgaaggggattgcaaatccgacaaaaagtggggtttttcagaccaaaacgcgttgtgcctgcataaaagcaggagtgaagcggcgtaccgcgacgccgctatttatcggaaggtttatcctgctgcggtttgttgttgaccatatcgcacaacatagagagcagcattaaccgtactttaaagggagaatgactaaacacgcgcatacacctcttgaactcattcataagacctcctgacttgctaatcccatcgatccttgagggatgattgcattacatacagatatagcacaggctatattatatagctattgctaaaacgttaattttttgtaccttcgcaactctggtttacaatgtgcgcacgaaatgagaacgctatgtatgcgtcaccataatgaggaagcacaatgagtcgtcgcgcaggtacgccaacagcaaaaaaagtgacgcagttagtgaacgtggaagagcacgttgaagggttccgccaggtcagagaggcgcatcggcgcgagctgattgatgattacgttgagctgatttctgacttgatcagggaagtgggggaagctcgtcaggtggacatggctgctcgtctgggggtttcgcaaccgacggtggctaaaatgcttaagcgactggcaaccatggggctgattgaaatgatcccctggcgtggcgtgtttttaacggcagaaggagagaagctggcgcaggaaagccgcgagcgacatcagatagtcgaaaatttcttgttggtgttgggcgtcagtccggaaatcgcccgtcgcgacgcggaaggtatggagcaccatgttagtgaagagacgctggatgcctttcgtttgtttacccagaaacacggtgccaaatgagcctgccttttttacgcacgctgcaaggcgatcgtttttttcagttattaattcttgttggcatcggattaagttttttcgttccctttgcaccgaaatcctggcctgctgctatcgactggcacaccatcatcaccttaagcggcctgatgctgctgaccaaaggtgtcgagttaagcggttattttgatgtgctggggcgcaaaatggtgcgccgttttgctacggagcgtcggctggcgatgtttatggtactggcggcagcgctgctttctacctttctgaccaacgatgtcgcactgtttatagttgttccgctgactatcacgctaaaaagactgtgtgagattccggttaatcggctgattatttttgaggcgctggcagtcaacgctggttcgctactgacgccaattggcaacccgcaaaatattcttatctggggacgttctggtctttcgtttgccggatttattgcccaaatggcaccgctggctggcgcaatgatgctgacactcctgctgttgtgctggtgttgtttccctggaaaggcgctgcaataccatacgggggtgcaaacgccggagtggaaaccgcggctggtgtggagttgtctggggctgtatatcgtctttctgacggcgctggagttaaaacaagagctgtggggactggtgattgtggcggcgggctttgcgctgctggcgcgtcgtgtggtgctcagtgtggactggacgctgctgctggtgtttatggcgatgtttatcgacgtccatttactaacccaactgccagttttgcagggggtgttaagtaacgtgagtcatttatccgaacccggattatggttaacggcgatcggtttatcgcaggtgatcagtaacgtgccgagtaccattttgctgctcaattatgtgccaccgtctttattactggcatgggcggtaaacgtggggggctttggtttattacccggatcgctggcaaatttgattgcgttacggatggcgaacgatcgccgtatctggtggcgttttcatctttattcgataccgatgctgttgtgggcggcgctggtgggatatgttttgttggttatgatcccggcgggataaggtctgtcaaattaaaaaggcggattatgagtccgcctttgctttacgttttgaagattaattcagacgaaccggcatcccggaacgatttttgatcgcttcatccagaacaacctggtcaacatctggctgaccggtcactgtctgcacgctcttcgtcagggtaattggcacaatttcctgaccttcaaactgggcttcagtggtagacagcgggttatggacttcaatataacggctgccgtctggctcggtggtcgcttttaccggctcatcaataaactgtacgcgggtaccgaccggtactttctcgaacaggaatttgatgtcttcgttacgcagacgcacacaaccatgacttacacgcaggccgataccgaagttggcgttggtgccatggatagcgtacaggcgaccgatgtagagtgcatacagccccatcgggttatccggaccagccggaacgaccgccggaagcggttcgcccgcagcgcggtactctgcgtgcattttagcggtcggcgtccaggtcgggcctgcttttttacgctcaactttggtggtccagttgataggcgtgtctttgcctaactgaccaatgccgatcggcagcacgataacggtgttggtccctttcggatagtaatacagacgcatctctgcactgttaatgacgatgccttcatgaacggtatccggcaggatcagctgctgcggaatattcagtacagtaccgcctttcggcaggaaggtatccacacccgggttcgcttccatcatattggaaagtcccatctggtactcggcggcaaaatactccagcggctgagtgttaccttcaggaatggtgatcacctgattctgaccaaccaggcgactcccgtcggttggcagaggataagttaccgcagaggcggtactgcaaaagccgacaacagcgaaggccgctgcgaataatgttttcaatttcatattcatgttaagcgagattttgtgcctggcaggccattgggttgagaatattagagtattggaagtgcattataagttcattccagctcacagtgaaatcagatgtgtacgaaatcacattttttgcctttggcttgagtgtagaccttaagcgaggagcaggatcttctttcagacttatggcataatgcgcggtttgtcatatctcttttcaggatacgcctgtgttagtttccagtaacgtcaccatgcagttcggcagtaagccgttgtttgaaaacatttccgtcaaatttggcggcggcaaccgttacggcctgattggcgcgaacggtagtggtaaatccacctttatgaagatcctcggcggcgacttagagccgacgttgggtaacgtttccctcgatcccaacgagcgcattggtaagctgcgtcaggatcagtttgcctttgaagagttcactgtgctggatacggtgatcatggggcataaagagttgtgggaagtgaagcaggagcgtgaccgcatctatgctttgccggaaatgagtgaagaagacggctataaagtggccgatctggaagtgaaatacggcgaaatggacggttactctgcggaagctcgcgctggtgaactgttgcttggcgtgggaattccagtggaacagcactacggcccgatgagtgaagttgctcctggctggaagctgcgtgtgctgctggcgcaggcgctgtttgctgatccggacattctcctgctcgacgaaccgaccaacaacctcgacatcgacaccattcgctggctggaacaggtgctgaacgagcgtgacagcaccatgatcatcatctcgcacgaccgtcacttccttaacatggtttgtacccacatggcggatctggattacggcgagctgcgcgtttatccgggcaactacgatgagtacatgacggcggcgactcaggcgcgtgaacgtctgctggctgataacgccaagaagaaagcgcagattgctgagttgcaatctttcgttagccgctttagcgccaacgcctcgaaatctcgccaggcaacttcgcgcgcgcgccagattgataaaatcaaactggaagaggtgaaagcctccagccgtcagaacccgttcatccgttttgaacaggataagaaactgttccgtaacgcgctggaagtggaaggtctgactaaagggtttgataacggtccactgtttaaaaatctcaacctgctgctggaagtgggtgaaaaactggctgtactgggtaccaacggcgtcggtaaatcaacgctgctgaaaacgctggtgggcgatctgcaaccggacagcggcaccgtaaaatggtctgagaacgcgcgcattggttactacgcccaggaccatgaatatgagttcgaaaatgatctgaccgtgttcgaatggatgagccagtggaagcaggaaggcgatgacgagcaggcggtacgcagcattctcggtcgtttactgttcagccaggacgacatcaaaaagccagcgaaagtgctttccggtggggagaaagggcggatgctgtttggtaagttaatgatgcagaagccgaacattctgatcatggacgaaccgaccaaccacctggatatggaatctattgagtcgctgaacatggcgctggaactgtatcagggcacgctgatctttgtttcacacgaccgtgagttcgtaagctccctggcgacccgtattctggaaatcaccccggaacgcgtgatcgactttagcggtaattacgaagattacctgcgtagtaaagggatcgagtaagttattatcagtagccctgatatggtcagggctactgaaactgatgacaaacgcaagattgcctggtgcgctacgcttatcagacctggcagtgtatcgcaatatattgaattttcatgattttgtatgccaaataaggcggtcacgccgtatccggcataatgacatgcactttctcaataaactgaattggcgataatcaaagattaaacggcggtttattttccagcaccgcctgaatcacattcagcgcgccttcatgattattatcatcggtagcgtaacgggcgatttgtttaatgttttccgcagcattgctcatcgcaaaggaataacgcgccattttcagcatctccgcatcgttaccgctgtcgccaatcgctaccacattttgcggtgacagatcccagcgtttcagtaaccgcgaaataccgtttgctttatgtagaccgggaataatcaagtcgataaagccaaaaccactggtgacgggtttcataatgccatccagcgctatgtgcagtttgtcgatcactaacgggatttgttcatccggcaggttgagcgaaaacttgaacagtacgtcgtcaatctcctgataatcttttacaggtttcaggcgatggtagtgttttgccatcagtgcgacgaatgcttcgggggcattttcgctgacatatgcactttgcagaccgcaggcgacaaaattgagttgcttatcttttagcaactcgccaataacaatccgcgattcatgtcgggtcagttcgccgtggaacaactgcttgccatgttcgtaaaccagtgcgccgttttccgcgacaaaagagatctcatcctttagctcaggaaagaacgaaataagctggtaatactgattaccgctggcgacaacgaactcaatgccgcgctttttcagttcctgatattgcgccataaaacgtggttggttgtacgttttggcgtcgttaagaaaagtaccgtccatgtctgtgacgataacttttacgctcataggtgtgctcctggctcgaaaatgaaaccgtaacagtgtaataacaatgtgacgcagagcacaaattatatttcgaatgaaagcgaggctgaaattgatgatgtgaatgatttggcccggcgacgacgacgccgggctgaggggattacagcatgtgttcggtacgggcgatgatatcgtcctgtgcgtctggagagagcgcggtgaagaaggcggaataacccgctacgcgtaccaccagatcgcggtattgatccggatgtttcttcgcctccagcaatgtttcgcgggaaacaatgttgtactgaatatgccagcctttatgcacttcaaagaaggtacgcagcaggatcatcagtttctgcttgtcagattcattctccagcgttgccggattcagtttctggttgagcagcacgccgccgagaattgctgccgtaggcagtttacccaccgagccaatgaccgcagtagggccgagatggtcagtaccggaggccggactagcgccttctgccagcggggtatgtgctttacgtccgtccggcgttgccatagtctgcgcgccaaacggtacgttagcggagatagacgatgtgcccgcataatagttgccgccaatcggaccacgaccgtagcgcgggttatggtactgcttcagttcgtcgatataggtctgataagcgcgagccagcagcgtatcgacagtatcatcgtcgttgccgtacttcggcgcaccgttaatcagccgctgacgcagctgctcgtgagtcaggccgtcgaagtcatccgccagtgcggcagccagctgttgctgaccaatcgcgccctgttcaaataccagtttcttcactgccgccaggctgttgccgaggttagcaatgccgacctgcaggccagaaacccagtcatatttcgcgccgccttgcttgatacttttcgctcgctcaatacagtcatcgaccagcgccgagcagagaatatcgtgtacgttctcttccagcatggtatcgacgacatattcgatttcgattgatttacgcgtgtagtaacggatttgcgtatcccatgcgtccattacttcatcgaagttgttgaagttacccgctgacaacgctttttcttgtggcaggaacactttgccgctggtggcatcacgaccgccttccagcgccgccagcatcacgcgggcgaagttgataaagctcatgccggtacagcgatagccccatttgccaccgacggcggtttcgatacaaccaatcgctgcatagtcgtaagcgtcctgcggttcaataccgagtttaataaattccgggatgacgatttcgtcgttgttgaacgccggcatcccgaaaccacagcggatcacctgaacacaggcatcgaggaaatcgttgctcattcccgcgtggtagcgcacgctgaggttaggctgagtggaacgcaggcgaccgcaagattcgaggatcgcataagagagtggatttaccgcgtccatcggttgaccatcaaccagattttgcccgccaatggtgacgttctgatacagtggacttcccgcagaggcttttgagtgtgagccggagcggattttgttcacttccagcaatttcaaccagcagctatgcagcatctcgatggcgtgttcgcgatccagtgtctggttcagttcaacgtcgcggcgatagtatgggtagagatactggtccatacgaccaaacgataccgagtgaccgttagattcgatctgcaaaatcaactggatgaagtaacacagttgcagcgcctgccagaaagtctgcggcggctggtgggcgataagatcgcagttttctgctatcgtcagcagttcatcgcgacggctttcgcgggtttcggtcgcggccatttcacgcgccagggcagcgaaacgttcaatgtgttcactgactgccaccagcacgatatcaatcgctttcaggaattgctcgccatgtaaatcttccagtaccgtcagattgatgcgcgagcgacgttccgccactttctcacgcagaccatcaagccctttttccagcagtagcgggaaattcaccgccaggtgcgcatcgccggaggtcatattgccctccgctttaatgatgccggtcgccagcagacctttttgctcatcggtaaacatgccgtagcagcgatcctgtacggtctgaccgcgccaccacgggcacacttcatgcagaacacgtttgttctcctcgctcaccgcaaaaccagcacccggacgatctgccagatcatcaatctctttttcgatccaggagacggtatattccgggaagatcggcgcggcgcgaacttcgcttgcctggttgccaatgatcaactcatcgtgcttgatccagatggtgcgattcgccaggtgatgcgccagtgccagcgcgcgacgtaccgggattggcttatcgagatgttgttgatacatctcggtatagtgttgtgctcgttcggtacagaccggcggtttcacaatatgcaccagcgcatttttgtgcgctttaatgcggtcgctgagcgtatccagttttagtgttgtcatgattgttatcctcgtaaggtcgcggttaaccctttctggcaggcatactgctgggcaaagtcgagcagttctggcgcatcaagcggtttttccggggcgtcatagggcagattaagtaagtgatatttgttgatgcccagtgtgtggtagggcagaaaatgaatttcgctaacgtgcagctcgtcggcggcaaaatcggtaatggctttcacagaagtttcgtcggcattaaagccctgaatcagtggcacgcggataatgatttttttgccggctgcggcgagttttttcaggttatccagcaccctggcggcgttaccgtcggtccactgtttaaacggcgcgtcggcaacgtgttttaaatcggcaagaaacagatcgatataggacagagaaggggcgatatatttccacggcacatgcagacaggtttctaccgcagtatgaataccggcttcgtggctggcttgcagtagccccatcgccatttccggctgcataaacggttctccgccagaaagtgttaagccgccgccgctgcgatcgtaaaacggtttatcgcgcaaaacggttgccatgatctcctcaacgcttttcacttcaccacacacggttaacgcctgtgttgggcagcagtcggttagcgccgtaaaatgctccggggttaacttttcccgatgaataagcaaaccattcaacgcgcgctcaatcacttccggtgcggtcttagcgcacagctcacagccttccagacagagtcgtgggtcatacagcagatcctgcgtgcgggcgcggctttccgggttctgacaccagcggcaacccagcgaacagcctttaagaaatacgaccgtgcggataccggggccatcatgggtcgagtagcgttgaatattgaaaatcatagttgcctctctgtttcgttcaaatattaaaatactttcgaatgaaagttagattgatgtgcgtcaactgttcagagagttttcccgtgatagtctacattcagacaaaaagtacattttgaggatggttatggaactgtatctggatacttcagacgttgttgcggtgaaggcgctgtcacgtatttttccgctggcgggtgtaaccactaacccaagcattatcgcagcgggtaaaaaaccgctggaggttgtgcttccgcaacttcacgaggcgatgggcggtcaggggcgtctgtttgcccaggtaatggctaccactgctgaagggatggtgaatgacgcacgtaaattgcgttctattattgcggatatcgtggtgaaagttccggtgaccgctgaggggctggcagctattaagatgttaaaagcggaagggattccgacgctgggaaccgcggtatatggcgcagcacaagggctactgtcggcgctggcaggtgcggaatatgttgcgccttacgttaatcgtattgatgctcagggcggtagcggtattcagactgtgaccgacttacaccagttattgaaaatgcatacgccgcaggcgaaagtgttagccgcgagtttcaaaaccccgcgtcaggcgctggactgcttactggcagggggtgaatcaattactctgccgctggatgtggcacaacagatgattagctatccggcagttgatgccgctgtggcgaagtttgagcaggactggcaaggagcgtttggcagaacgtcgatttaaccggacgttctgcattctcataaattgctgatgacgtggcggagtgccgcgtcttatctggcctggaggtggcagttactgcccgcacacctcacaccccggattacgcatcagtttcatttcgcgaaactgacaggtcatcgcatcgtacatcacgatttttccgctggcaggtttgccataaccggccagcagtttaatcgcttccattgcctgcaatgaaccaattacgccgattaacggtgccatcacgcctgcttctacgcaggttaacgcgttctcgccaaacaaacggctaaggcagtgatagcacggttcgccgtcctgataagtgaagaccgtgatttgcccttccatacgaattgccgcgccggaaaccagcggcaccttcgcggcaaaacagcctgcgttcagttgattacgtaccgcaacgttatccgtacagtcgagcaccagatcgtgttttgcaatcatcgcagcaagttcagcgtcatcaagcagcgcattgactggcgtaatcgcgatatgtgggttgatccgcgtcagggcgtcacgggcggattccacctttggttgcccgaccgtggcatcactgtgcagcgtctggcgttgcagattggagagcgaaaccgtgtcgaagtcgagcagcgtcaggttgccgacaccggcgcttgccagatattgcgatgccgcacagccgaggccaccaagccccaccaccaacacgcgagaatccttcagcgcttcctgaccgtcaaaatcaaaaccacgcaggatgatttgccggttgtagcgcagcatctcctgatcgctgagttctgccattacaggcctccgaacaacgcgttaaacggttcgacttccacccattcgcccacgtcaacattgccgcgctcgcgttccagcacgataaagcagttgccgaggctaaaggagctaaatatatgtgaaccctgatgtccggtggtcgtcacttccagttcgccatcggcgttgcgttgcagcacgccgcgctggaaatcaaggcgtcctggcgtttttttcaggcgggacgctgtgcgtacacgctggcgcgcgggcaggccactggcggtattgccgcttagttttgccagcaaaggctgtaccagttgatagaaggtcagcgtcgctgaaaccgggttgcccggcaggccgcagaaccaactattagaaagtttaccgaacgcgaacggtttacccggtttaatcgccagtttccagaaggcgatctcccccagctcttcaagaatcgttttggtgtaatccgcttcacccactgaaacaccgccggaactgatcactacatccgcctggctgtcggcttcaataaatgcggcgcgcagggcatggggatcgtcgcggataatccctaagttgattacctcgcatcccaactgttctaacatcaggtgtacggcgagacggttggtatcgtagatttggccgtcgcccaacggctgaccgggcaactggagttcatcaccggtagaaaaaagcgctacacgcactttacgaatcaccggaacttcggcaatccctagcgaagcaatcactggcagttcagcggtagtcaggcgagtccccgccgggaaaacaaccgcacctgcagagatatcttcaccgcgacggcgaatattttgcccgctacgcgcttcagcagtaaaacgcacgccattgtccgtttgttcagtctgctcctgcatcaccaccgcttcgcagccttccggcaccggcgcaccggtcataatacgaatgcaggtacccgcaggccattcaccatggtacggctgaccggcaaaggatttaccggcaacgggcagcggttgcccggaggcaatatcggctaaacgcaccgcgtagccgtccatagcggagttatcaaaccccgggacatccagtggcgaaacgacatcactcgccagaatacgaccaaaacactgaaccagtggcagcgtttcctgggcggtcagtggggtaacgcgagaaagcatctcattaagcgcggtgtcgagcgacatcaatccggtggtaaattccatgaaaacactcctgcggaggcaaaatcgaatttgcctattatgtcagaaaaacgccacagactgtatgccacctcgggtgtagcgctggctcctgcctttacatgccatatccatctttctatattcaaaaattgaatgagtcattcataaaaattctgatatttatagcaaaagtggcgagtcacccttaatggacgaatactatgggcaaagcagtcattgcaattcatggtggcgcaggtgcaattagccgcgcgcagatgagtctgcaacaggaattacgctacatcgaggcgttgtctgccattgttgaaaccgggcagaaaatgctggtagcgggcgaaagtgcgctggatgtggtgacggaagcggtgcgtctgctggaagagtgtccactgtttaacgccggaattggcgctgtctttacgcgtgatgaaacccatgaactggacgcctgtgtgatggatggtaacaccctgaaagccggtgcggtggcgggcgttagtcatctgcgtaatccggttcttgccgcccgactggtgatggagcaaagcccgcatgtgatgatgattggcgaaggggcagaaaattttgcgtttgctcatggcatggagtgcgtctcgccggagattttctccacgcctttgcgttatgaacaactactggcagcgcgcgaggaaggggcaacagtcctcgaccatagcggtgcgccactggatgaaaaacaaaaaatgggcaccgtaggggccgtggcgttggatttagacggcaatctggcggcagccacgtccacgggcggaatgaccaataaattacccggacgagttggcgatagtcccttagtgggggccggatgctatgccaataacgccagtgtggcggtttcctgtaccggtacgggcgaagtcttcatccgcgcgctggcggcatatgatatcgccgcgttaatggattacggcggattaagtctcgcggaagcctgcgagcgggtagtaatggaaaaactccctgcgcttggcggtagcggtggcttaatcgctatcgaccatgaagggaatgtcgcgctaccgtttaacaccgaaggaatgtatcgcgcctggggctacgcaggcgatacgccaaccaccggtatctaccgtgaaaaaggggacaccgttgccacacagtgatgaacttgatgccggtgatgtgctggcggttgaaaatctgaatattgcctttatgcaggagcagcacaaaatagctgcggtccgcaatctctcttttagcctgcaacgtggtgagacgctggcaattgttggcgaatccggctccggtaagtcagtgactgcgctggcattgatgcgcctgttggaacaggcgggcggtttagtgcagtgcgataaaatgctgttgcagcggcgcagtcgcgaagtaattgaacttagcgagcagagtgctgcacaaatgcgccatgtgcgcggggcggatatggcgatgatatttcaggagccgatgacatcgctgaacccggtatttactgtgggtgaacagattgctgaatctattcgtctgcatcagaacgccagtcgtgaagaagcgatggtcgaggcgaagcggatgctggatcaggtacgcattccggaggcacaaaccattctttcacgttatccgcatcaactctctggcgggatgcgccagcgagtgatgattgcgatggcgctgtcatgccgcccggcggtgctgattgccgatgagccaaccaccgcgttggatgtcactattcaggcgcagatcctgcaattaatcaaagtattgcaaaaagagatgtcgatgggcgttatctttatcactcacgatatgggcgtggtggcagagattgccgatcgggtactggtgatgtatcagggcgaggcggtggaaacgggtagcgtcgaacagatttttcatgcaccgcaacatccttatacccgtgcgctgttagctgctgttccgcaacttggtgcgatgaaagggttagattatccccgacgtttcccattgatatcgcttgaacatccagcgaaacaggagccacccatcgagcagaaaacggtggtggatggcgaacctgttttacgggtgcgtaatctggtctcccgtttccctttgcgcagcggtttgttgaatcgcgtaacgcgggaagtgcatgccgttgagaaagtcagttttgatctctggcctggtgaaacgctatcgctggtgggcgagtctggcagcggtaaatccaccaccgggcgggcgttgctgcgcctggtcgaatcgcagggcggcgaaattatctttaacggtcagcgaatcgataccttgtcacccggtaaacttcaggcattgcgccgcgatattcagtttatttttcaggacccttacgcttcgctggacccacgtcagaccatcggtgattcgattctcgaaccgctgcgcgtacacggtttattgccaggtaaagaagcggctgcacgcgttgcgtggttgctggagcgcgtgggcctgttaccggaacatgcctggcgttacccacatgagttttccggcggtcagcgccagcgcatctgcattgctcgcgcgttggcattgaatccaaaagtgatcattgccgacgaagccgtttcggcgctggatgtttctattcgcgggcagattatcaacttgttgctcgatctccagcgtgatttcggcattgcgtatctgtttatctcccacgatatggccgtggttgagcggattagtcatcgtgtggcggtgatgtatctcgggcaaattgttgaaattggtccacggcgcgcggtctttgaaaatccgcagcatccttatacgcgtaaattactggcggcagttccggtcgctgaaccgtcccgacaacgaccgcagcgtgtactgctgtcggacgatcttcccagcaatattcatctgcgtggcgaagaggttgcagccgtctcgttgcaatgcgtcgggccggggcattacgttgcacaaccacaatcagaatacgcattcatgcgtagataacattcaggcggagaataaaatggcaagagctgtacaccggagtgggttagtggcgctgggcattgcgacagcgttgatggcatcttgtgcattcgctgccaaagaggtggtggtggcggtaggatcgaacttcaccacgctcgatccgtatgacgcaaatgacacgttatctcaggccgtagcgaaatcgttttaccaggggctgttcggtctggataaagagatgaaactgaaaaacgtgctggcggagagttacaccgtttccgatgacggccttacttacaccgtgaaattgcgggaaggcattaaattccaggatggcaccgatttcaacgcagcggcggtgaaagcgaatctggaccgggccagcgatccggcgaatcatcttaaacgctataacctgtataagaatattgccaaaacggaagcgatcgatccgacaacggtaaagattaccctcaaacagccattctcagcgtttattaatattcttgcccatccggcgaccgcgatgatttcaccggcagcgctggaaaaatatggcaaggagattggttttcatccggtgggaaccgggccgtatgaactggatacctggaatcagaccgattttgtgaaggtgaaaaaattcgcgggttactggcagccaggattgcccaaactggacagcataacctggcgtccggtggcggataacaacacccgcgcggcaatgctgcaaaccggtgaagcgcagtttgctttccccattccctacgagcaggccgcactgctggagaaaaacaaaaatatcgagttgatggccagtccgtcaattatgcagcgttatatcagtatgaacgtgacgcaaaagccgttcgataacccgaaggtccgtgaggcgctgaattacgccattaaccgcccggcgctggtgaaagtggccttcgcgggctatgcaacgccagctactggtgtggtaccgccgagtatcgcctacgcgcaaagttataaaccgtggccttacgatccagtgaaagcgcgcgaattacttaaagaggcgggatatcccaacggtttcagtaccacgctgtggtcgtcacataaccacagcaccgcgcagaaagtgctgcaatttacccagcagcagttagcgcaggttgggattaaagcccaggtgactgcgatggatgccgggcaacgggcggcagaagttgaaggtaaagggcaaaaagagagcggcgtgcggatgttctacactggctggtcggcttcaaccggcgaagccgactgggctctatcgccgctgtttgcctcgcagaactggccaccaacgctgtttaataccgcgttttacagcaataaacaggtggatgacttcctggctcaggcactgaaaactaatgatccggcggaaaagacccgcttgtataaggcggcgcaggatatcatctggcaagagtcgccgtggatcccgctggtggtagaaaaactggtgtcggcacacagtaaaaacctgaccggtttttggatcatgccagacaccggcttcagctttgaagatgcggatttgcaataagcaacgcagggagtggaatgcttaattacgttatcaaacgcttactggggttgattccgacgctgtttatcgtctcggtgctggtgtttttatttgtccacatgctgcccggcgatccggcgcgattgattgccgggcccgaagctgatgcgcaggttatagaactggtgcgtcagcagctggggttggatcagccgctgtatcaccagttctggcactatatcagcaatgctgtgcagggggattttggcctgtcgatggtgtcgcgtcgtccggttgccgatgagattgccagccgctttatgccaacgctgtggctgaccataaccagtatggtctgggcggtgatatttggtatggcggcgggaattatcgccgccgtctggcgtaaccgttggccggatcgattgagtatgactattgcggtgtcggggatttcgtttccggcatttgctctggggatgcttttaattcaggtattctctgttgaactgggctggctgcctaccgtgggagcagacagttggcagcactacattttaccctccctgacgctcggcgcggcagtggccgccgtgatggcgcgctttacccgcgcgtcgtttgtcgacgttttaagcgaagattatatgcgtaccgcgagggcgaaaggggtgagcgaaacctgggttgtcctcaaacacgggctacgtaacgcgatgatcccggtagtgaccatgatgggtttacagtttggctttttgctcggtggttccatcgtggtggagaaagttttcaactggcccggacttggacgcttactcgttgactccgtagaaatgcgcgattacccggtgattcaggcggaaattctgcttttctcgctggaatttattcttatcaacttagtggtggatgtgctttacgccgccattaacccggctatcaggtacaagtaaggatgcgactatttaactggcgacgtcaggcggtgttaaacgccatgccactggtcaaacctgaccaggtacgtacaccgtggcatgaattctggcgacgatttcgccgtcagcatatggcgatgaccgccgcattgttcgttattttattgattgtggtggctatttttgcacgctggatcgctccctatgacgccgaaaattattttgattatgacaatctgaataacggaccttctttgcagcactggtttggcgtcgattcactggggcgtgacattttcagccgtgtcctggttggtgcgcaaatctcgctggcggcgggcgtgtttgccgtgtttatcggtgcggcgatcgggacgttgctgggcttgttggctggatattatgaaggctggtgggatcggctgagcatgcgcatttgcgatgtgctgtttgccttcccgggtattttactggcgatcgctgttgttgcggtgttgggaagcggcattgctaacgtgattatcgcagtcgccattttttccatccccgcgtttgcccgcctggtgcgcggcaacacgctggtgttgaaacagcaaacctttattgagtcagcacgcagtattggtgccagcgatatgaccattttattgcgtcatatcctgcctgggaccgtctcttctatcgtggtgtttttcaccatgcgcattggcacctcgattatctctgccgccagcctgtcatttctcggcctcggtgcgcagccgccgacaccagagtggggggcaatgctcaatgaggcacgagcggatatggttatcgcgccgcatgtcgctgtttttccggccctggctatttttctgaccgtactggcgttcaatttgttgggcgatggtttacgcgatgcgctggatccgaaaattaaaggatagttacgtttgaatattgcttgaaagggtaatcacctcacaggaaattattgccctaagcaagtgttgtaactttctgctgattttgtagaatcgggtaatttggttaaaaagccgcagcaagggactattttgcagcggcacagcgttcagacagttattttgttaaatgtattaacatgctgagtttatacgaaaagataaagataaggctgataattttatttttattggcagcactgtcatttattggtctttttttcatcattaactatcaactggtatcggaacgcgcggtaaaacgtgccgatagccgctttgaacttattcagaaaaacgttggctatttctttaaagatattgaacgttcggccctgacattaaaggactcactgtatttattaaaaaatacagaggagattcaacgtgccgtgattctgaaaatggaaatgatgccatttttagactcggtgggactggtacttgatgataataaatattatctcttttcgcggagggcgaatgataaaatcgttgtttatcatcaggaacaagtaaatggaccgcttgtcgacgagtcagggcgggttatttttgccgattttaacccatcgaaacgaccgtggtcgatggcttcagatgactctaacaacagctggaatccggcatacaattgctttgatcgtccgggtaaaaaatgtatctcttttacgctacacatcaacggcaaagatcatgatttgttagcggtagataaaattcatgtcgatttaaactggcgatatctgaacgagtatcttgatcacatcagcgctaatgatgaagttctatttttaaagcaaggtcatgagatcattgctaagaatcaactcgctcgtgaaaaattgattatttataatagcgaaggtaattataatattattgattctgtcgatacggaatatattgaaaaaacatcagcggtgccaaacaacgcattattcgaaatctatttttattatcctggtggtaatttattgaacgcatcagataaacttttttatctgccgtttgctttcattattatcgtattgctggtggtttatttaatgaccactcgagtgttccgtcggcaattttctgaaatgacagatttggtcaatacgctggcgtttttgcccgactctacggatcaaatcgaggctctgaagattcgtgaaggcgatgcgaaagagattatcagcatcaaaaattcgatcgcggaaatgaaagatgctgaaattgaacgggcaaataaattgctctcgctgatctcttacgatcaggaaagcggttttattaaaaatatggcgattattgagtccaacaataatcagtatctggctgtggggatcatcaaactgtgtggtctggaagctgtggaagcggtgtttggtgttgatgaacgcaataaaatcgtcaggaaattgtgtcagcgaattgccgagaaatatgcgcaatgctgcgatatcgtgacatttaatgccgatctctatttactcctgtgccgggaaaatgtacagacgtttacccgtaagatagcgacggtaaacgattttgacagcagttttggctaccgcaatctgcgcatccataagtctgctatttgtgaacctttgcagggggaaaacgcctggagttacgcagaaaagctgaaactggcgatttccagtatccgcaaccatatgttctcagagtttattttctgtgatgatgcgaaactcaacgaaatagaagagaatatctggattgcgcgtaatattcgccatgcaatggaaattggcgaactattcctggtctatcaaccgattgttgatattaacacccgcaccattttgggcgcggaggcgttgtgccgttgggtgtctgcggagcgggggattatttcaccgctgaagttcattaccattgctgaggatatcgggtttatcaatgagctgggctatcaaattattaaaaccgcgatgggtgaattcagacattttagtcagcgtgcgtcgctgaaggatgatttcttactgcatattaatgtttcgccctggcagttaaacgaaccacactttcatgagcgttttactaccatcatgaaagaaaatggcctgaaggcgaacagcctttgtgttgagatcaccgaaaccgtgatcgagcgaattaatgaacatttctatctcaatattgaacaactgcgtaaacaaggggtacgggtatcgattgatgactttggcaccggtttgtcaaacctgaaacgtttttatgaaattaatccagacagtataaaggtggattcgcaatttaccggcgatattttcggtactgcaggaaaaattgtgcgcattattttcgatctggcacgctataaccggatcccggtgattgcggaaggcgtagagagcgaagacgttgcgcgtgaattaatcaaattaggatgtgttcaggctcaggggtatctgtaccagaaacccatgccattctccgcctgggataaaagtggaaaattagtaaaagagtagtttacgtatgtccagaatcaataaattcgtacttacagtcagtctgctgatttttatcatgatttcagcagttgcctgcgggatctacactcaaatggtaaaggaacgggtgtatggcctgaaacagtccgttattgatactgcttttgcggtggcaaatattgctgaatatcggcgtagtgtggcaattgatctcatcaacacgctaaatcctacggaggaacagctgttggttggcttacgcacagcttacgccgactcggtttcaccctcttatttgtacgatgtcggtccttatctgatttccagtgacgaatgtattcaggtaaaggagttcgagaaaaattattgtgcagatattatgcaggttgttaagtatcgacatgtcaaaaatacagggtttatctcttttgatggtaaaaccttcgtctattacctctatccggtaactcacaatcgtagtctgatatttttgcttggtctggaacgtttttctttactgtcaaaatcgctggcgatggatagcgagaacctgatgttctccctgttcaagaacggtaaatcggtgaccggtgatgaatataacgctaaaaacgccatcttcaccgtttcggaagcaatggagcacttctcctatttgccgaccgggttgtacgtatttgcttataaaaaagacgtttattttcaggtatgtacattgattattttctttgccgcattggtggcagtgatatcgggtgccagttgcctctatctggtacgcagagtgattaatcgtggtattgtggagaaagaagccattattaataaccattttgaacgcgtactggatggcgggcttttcttttcggctgccgatgtcaaaaaactctacagtatgtataactcggcattcctggacgatctgaccaaagcgatgggcagaaaatcctttgacgaagatttaaaagcgctgccggaaaaaggcggttatttgtgcctgtttgacgtcgataaattcaaaaacattaacgacaccttcggtcatttgctgggcgatgaagtgttgatgaaagtggtgaaaatccttaaatcacagatcccggtagataaaggtaaagtttaccgcttcggaggtgacgaatttgcggtgatttatactggcggcacgctggaagagttgctatcgattctaaaagaaatcgttcatttccaggtgggaagcattaatttaagcaccagtatcggtgtagcgcattcaaatgaatgtactaccgttgaacgtttgaaaatgctggcggatgagcggctgtataagagtaagaaaaacggcagggcgcagattagctggcagtaatcattattcgcaggccggacaaatgattttgcccggcctgaattaattaaacccggctaccccacaaatcgtactcatcggcgtgctcgactttcactcgcaggatatcacccggcttaacgttggtttcaccattgagataaaccgcgccgtcgatttccggtgcatctgccatgctgcgaccaatcgcgccttcttcgtccacttcgtcgataatcaccagaatttcacggcccactttctcttgcaggcgctcggcggaaatttgctgctgcaactgcatgaaacggttccagcgttcttctttcacttcttccggaacctggtcaggcagggcattggcgtctgcaccttcaaccgggctgtatttaaagcagccaacgcgatccagacgtgcttctttcaggaagtcgagtagcatctggaaatcttcttccgtctcgccagggaagccaacaataaaggttgagcgtagggtcagttccgggcagattttgcgccactgtttgatgcgcgccagttggcgatctacagaacccggacgtttcatcagtttgagaatgcgcgggctggcgtgctgcaacggaatgtccagatacggcaggattttgccctctgccatcagtgggatgacgtcgtccacatgcggataagggtaaacgtagtgcagacgtgtccagatccccagtttcgataactgttcgcacaggctgaccatgctggtttttaccggctcgccgttgtggaagccagtacgatgtttaacatcgacgccatacgcggaagtatcctgcgagatcaccagaatttctttaacgcccgcatcaaccagacgtttcgcttcacttaacacttcgccaatcggacggctcaccagatcgccgcgcatagacggaataatgcagaaggtgcagcggtgattacagccttcagaaattttcagataggcataatgacgcggcgtcagtttcacaccttgttctggcaccaggctcaggaatgggttgtgtttcggttttggcacgtagtgatgaacgtgctccagaacctgctcatagctatgaggcccggtgatttccagcactttcgggtggacttcgcggatctgatcttcttttgcccccagacaaccggtcacaattaccttgccgttttcattcaacgcttcaccaatggcttccagtgattcttgtaccgcgctgtcaataaagccgcaggtgttgacgatcaccatgtccgcatcatcatagctcggtaccacgtcataaccttcagtgcgtagttcggtgagaatacgctctgaatcgacaaggtttttcggacagccaagggaaacaaagccgattttcggctggggagttactttgctcatagcttaaaaaatattcagttacaggaaaggtcagggcagggattctacagagttctggataaaatttgtatcgcaatctcattcgctggcggagttgaaggaaatgtaaattttgttaattcggcgtgaagaattgatcctggacagcattttgctcaaaaaacagccatactatttaattgcaacaaggctggaaagaggaggatcgaagtatgttcgttgacagacagcgaatcgatctgctgaaccggttgatcgacgcacgcgttgacctcgccgcatacgtgcaactgaggaaggcaaaaggatacatgtccgtcagcgaaagcaatcatctacgagataacttttttaaactgaatcgcgaactgcacgataaatcgctgcggttgaatcttcatctggatcaggaagaatggagtgctcttcatcatgctgaagaagcattagcgacagccgcagtatgtttgatgagtgggcaccatgattgcccgactgttattaccgtcaacgccgataagcttgaaaattgtctgatgagcttaacgctgagtatccagagcctgcagaagcacgccatgcttgagaaggcctgaaaactaagggggagaaagcgtctcccccttcatgtttaagtttttgtaaaaatgaatttgttatctcctccactgactacgctttaagccagagtcaatccggaggcgttatgcatcgacaatcctttttccttgtgccccttatttgtctttcttccgctctctgggcagctcctgcaacggtaaatgtcgaagtactgcaagacaaactcgaccatccctgggcgctggcctttttacccgataatcacggtatgttaatcactctgcgcggcggcgagttgcgtcactggcaagcaggaaaaggattatctgcgccgctttccggagtgccggacgtttgggcgcacgggcagggcggcctgctggacgtggttttagcgcccgattttgctcagtcgcgccgcatctggttaagttattccgaagttggcgatgatggcaaagccggaactgctgtgggttatggccgcttaagtgatgatctctcaaaagtgaccgacttccgcaccgtctttcgtcagatgccaaaactgtctaccggcaaccattttggcgggcggatggtatttgacggtaaaggttatctttttattgctctgggcgaaaacaatcagcgcccgacggcgcaggatctggataaattacagggcaaactggtgcgactgaccgacctgggagaaatcccggatgataatccttttataaaggaatctggtgtgcgcgccgagatctggtcttatggcattcgtaatccgcaaggaatggcgatgaatccgtggagtaatgcactatggctgaatgaacatggcccgcgcggtggcgatgaaattaatatcccgcaaaaaggcaaaaactacggctggccgctggcaacctggggaatcaactattcaggctttaagataccggaggcgaaaggggagatcgtcgccgggaccgagcaacctgttttttactggaaagattcgcccgccgtgagcggcatggccttctataacagcgataaattcccccagtggcagcaaaaattatttattggcgcgctgaaagataaagatgtcatcgtgatgagcgtcaacggcgacaaagtgacagaagatggccgtattttaacggacaaagggcagcgaattcgtgatgttcgcactggacccgacggttatttatacgttctcaccgacgagtccagtggggaattacttaaagttagcccacgcaattagctaacgggaatcatcaccactttgcgcactgcggggcgttcagtgagttgctgataccagcgttgcagatttggacgcggtgtccaggtcaggccaacgttaaacaaattgtagatgaacggtgcgatagcgatatcgcccacaccaaactcgtcgcctgagaaccattttacttttgccagttccgcatctagcagggcaaacagggcgtcgcactctttgcaactggcatcaatggcggcctgatcgcgctcttccggtggtgttctgactaatcccatcaggatcccgcgatgagcattactgagcgtctggtttgcccagtccatccatttttctgcttccgcacgacgtgccggtgagtcgatccacaggcgtttttgcccgtactgtgccgccagatagcggacaatggcgtttgattcccaaagaatgagatcactttcgtcgtcacgcaacaacggcaccagcccgttagggttcatcgccagaaaatcagcatcgtgatttatcccaaactcacggcccgcgagaatttgctcataaggtagttccagttcttcgagcgtcagcaatactttttttacgttggttgaattattccgaccccacagcgtaatcatactcaccccttttccgacaggcagccacaggctgaacaggactccgatggtgaagtaaagttaacttttaagcaacagctggcaaaaaaatgacaccagaagcagcgaagcggcaggatattgcataaactttaaaaactttaccaacttacggtttctttaagtttgtgtgtgcgttattaatcaccgaacttatcatacggcgatataacgtattttttttgaatggatactcgggtggcatttatgacgcaatactcctctctccttcgtggtcttgcagcgggttctgcatttttattcctttttgccccaacggcattcgcggcggaacaaaccgttgaagcgccgagcgtggatgcgcgtgcatggattttaatggattacgccagcggtaaagtgctggcagaaggcaatgcggatgagaaactggatcccgcgagcctgactaaaatcatgaccagctatgtggttgggcaggcgcttaaggccgataagattaaactcaccgatatggtgacggtcggtaaagatgcctgggcgacgggaaatccggcactgcgtggttcatcggtaatgttcctcaaaccgggcgatcaggtttcggtggcagacttgaacaaaggtgtgattatccagtccggtaatgacgcctgtattgcgctggctgattacgttgccgggagccaggagtcatttattggtttgatgaatggttatgccaaaaaactgggtctgaccaacactaccttccagacggtgcacggcctggatgcgccggggcagttcagtaccgcgcgcgatatggcattgctgggtaaagcattgatccacgatgtgccggaagagtacgccattcataaagagaaagagttcaccttcaacaaaattcgtcagcctaaccgtaatcgtctgctgtggagcagcaatctgaatgttgatggcatgaagacaggaaccacggcaggcgcgggatataatctggttgcttcggctacccagggcgatatgcgtttaatctccgtagtgctgggggcgaaaactgaccgtatccgttttaatgagtctgagaaattattgacctggggtttccgcttctttgaaaccgtgacgccaattaaacctgatgccacatttgtgactcagcgcgtctggtttggtgataagagcgaagtgaatctcggggcaggcgaagcgggctcagtgaccataccgcgtgggcagctgaaaaacctgaaggcgagttatacgttaatggaaccgcagcttaccgcaccgctgaaaaaaggtcaggttgtcggcaccattgatttccagcttaacggtaaatccattgagcagcgtccgctgatcgtgatggaaaatgtggaagagggcggattctttggtcggatgtgggatttcgtgatgatgaaattccatcagtggttcggcagctggttctcttaatcttctgataaccggatggcgcgaaacgtcatccggttatacgtcattaatacatcaacttaatacgctgcgtctgcgcgtacttcacatactcatcttccgggcaacaatcgctcacaacaatatcaaagcgtttcaggtcacccatgcgcgccggacgcaccttgccaaatttactgtggtcgacaaccagcacatgcttttgcgccatcgacatggcccagtgttttaccggcaactcttcaagattaaagcaggtagcgcctttactgacatgcacgcccgcagcggaataaaaagcgatatccgggcaaaaattattcagcgtttgctgaaaatcgatgggtttgaaaatggcgttgctggcgtgaaattcaccaccgcaaagaaacgcgcggcaatggggtttctctttcagcgccagaaaggtatttagcgaataacaaacggcggtaaaagggatttcattatcaattgcttcaataatccacggcgtggtggtgccacagtcaaaaaagagggtctgatcgggttctaccagcgtcgcagccagttttgccgcccggcgtttttcttccaccaggcgggatttttgatcgcttaacaggtaatggctggcgctgcgtggttccagaacaatatagccgccgagcaaaacgacgggcgcactgtggttgttcagatcgcgacgaatcgtcatctccgaaaccccaagcagggcggcggcgtctttaagatgtaacttatcactgcgttttaattcttgcagcagctgcccgatacgctcttcgcgacgtgtttccataatccctctgaatagttattgaagcgagccgctcaatactacactttttagcagagatcagtcacgcacccagcctttgcggatcggtaatgcaaaacagaagcgataccacgattgcagacgttgatagagtttatgccccatcgcttgccagataatctgggcgctaaggcagccaatcatacctgccagcaatccaccgagcatatccagcggccagtggacgccaagataaacgcgcgaccaggcaatgacgacggccagcaccattaaaagtgagccggaccacaggcgatgccagcataaaaatgccagtgcaaaggtgaaaatcaccgtaccgtgatcgctcgggaatgagtcatccgccgcatgatgcaggaagttatagccgatattttcgacaaagggtcggtcgtgcggaaaaagatgtcccatcgtccaggacacaaacaggctgaccgccagcgcgatagcgatttttatcaccagttgccgttgtgctgtaagcccccacaaccaaagtactgcggccagcaacggcaccacggtaatcaaatctttagcaataaaaatcgccaacgagatcatccacggcgcagagtctggcgttgcgttaataagagagaatagagagagattcaaattttccagcataacttcccgacgcaaagtgattaaaagggagccaatacaggcaagtcgttgagaataaagtgcaggttaaactgggtaaagcggcatcgtcttatttccctcaagcggcctgtttacggtaggtgattgtaacgggcaaaggttaaataaaacttaaagaaagcgtagctatactcgcaataatgtaagaatgtgcttaaccgtggtttcagctacaaaattcgctttctcgttagctgcgcttttattaaactttgcgcgattattattggcgaagaaattgcatgcaaaataaattagcttccggtgccaggcttggacgtcaggcgttacttttccctctctgtctggtgctttacgaattttcaacctatatcggcaacgatatgattcaacccggtatgttggccgtggtggaacaatatcaggcgggcattgattgggttcctacttcgatgactgcgtatctggcgggcgggatgtttttacaatggctcctggggccgttgtcggatcgtattggccgccgtccggtgatgttggcgggagtggtgtggtttatcgtcacctgtctggcaatattactggcgcaaaacattgaacaattcaccctgttgcgcttcttgcagggcataagcctctgtttcattggcgctgtgggatacgccgcaattcaggaatccttcgaagaggccgtttgtatcaagatcaccgcgctaatggcgaacgtggcgctgattgctccactacttggtccgctggtgggcgcggcgtggatccatgtgctgccctgggaagggatgtttgtcttgtttgccgcattggcagcgatctcctttttcggtctgcaacgagctatgcctgaaaccgccacgcgtataggcgagaaactgtcgctgaaagaactcggtcgtgactataagttggtgctgaagaacggccgctttgtggcgggggcgctggcgctgggattcgttagcctgccgttgttggcgtggatcgcccagtcgccgattatcattattaccggtgagcagttgagcagctatgaatatggcttgctgcaagtgcctattttcggggcgttaattgcgggtaacttgctgttagcgcgtctgacctcgcgccgcaccgtacgttcgctgattattatgggcggctggccgattatgattggtctgttggtcgctgctgcggcaacggttatctcatcgcacgcgtatttatggatgaccgccgggttaagtatttatgctttcggtattggtctggcgaatgcgggactggtgcgattaaccctgtttgccagcgatatgagtaaaggtacggtttctgcggcgatggggatgctgcaaatgctgatctttaccgtcggtattgaaatcagcaaacatgcctggctgaacgggggcaacggactgtttaatctcttcaaccttgtcaacggcattttgtggctgtcgctgatggttatctttttaaaagataaacagatgggaaattcgcacgaagggtaaaaaaatgcctgattgctttgtgcgatcaggcattctcgaattaatggtgatggtcgtcaatctggtgttcgataaccatcccttcacctacgctggcaagatggcgaacataaggatgcgggcggtaagccggagctggcgcaggagccacatagacggtttgcggcacagtcgcgacgctgactgaatcaggaaccacaaccactttgtatccactcggcacatcgacggtgacactttgcgccatcgccacaccagtaaagcccattaaaagcgcgcccaacagtagacaatttttcataatcatttcgcctgaaataatgcagcgggttaatttccgcgaattatgcaatcttcattcaggcattgtgttgccgggcgtgctgccgttttattggttaaatggcgcttcgtgtttaagcactttatcgatcacatccagtacgccttcacggttattggagcctgcccggtattttgccgctgcgacgaccgcgctgccggcattttccattgcaaaactaaagcctgcctgacgcagcatctcaatatcgttaccgccatcgccaaagaccaccacttcgctgtcgtctattccccataatttctgcagttggcgaaggccattggctttatgtacaccggggataatcagatcgatgctgccgttgccggtatggaccggtaccatgatatcgccgatggcctcatgtaatgctttttgcacttgtgggatcagttcgtcagagagattaaggccaaatttaaagaagatatcttctaagttgtcaaagttatcgacgtattccagacggtgataatacatttccgccaccgttttcatggcatcgtcatattttttgagggtataggcgctattttttccgcaggcaataatttccacttccgggcgcgtcagcaaatgttctacgacagtagtaaacgcatccttcgacagctcgccattaaaaacatctttgccttcgctcactacccagccgccgttttcagccacaaaggcaatttcattagcaatttcaggaaagaaagagatcaactgataatattgattcccgctggcgaccacaaagcgaatgccttgtgctttcatttgctgatactgagccataaaccgctcacggttataggttttttgatcgcttaagaaagtaccatccatgtctaccgcaattaatttaatgctcatcaactattctccatcgccgtctgcgttttggtatcgggtttggcgacggctttcgcgacaatagccgcgagaataaccagcgccagtacaaccagcattgcactacgtaatccataatgttcgccgagatagcccagcagcggcggcccgacgaggaaagccagataaccggtcgtagctaccacgctgacgcgggttggtgcatcggggccggtatcgctggcggcagaaatagtcagcgggaagcccaacgaggcacccagtccccaaagtacaacagacaccccagcgacccaggcgctatcgacaaaaataatcagcccaatacccaacgcccccattagtgcactggcccgaaccacggcaacgcgactgtaacggtcaatgaaccaaccgccggtaaagcgtccaacggtcatccccagggtaaaaccggcataaatcagcgagccggaagtagggctaaaaccgtgaccatcaaccattaataagggtaaccagtcgttggcagaaccttcggcaaaggccatcgccagcaccacaacaccaatcaacagcaactggatatcccgataaaaaggtacgcctttttcaccatgctgggtgccatcggcagcatttttgcccgtaccgtcagggattgcctgaatggcgatataaataggtgcgatgcctaccagcgccgccaataaaatatgcaccgttgccggaacgccaaaggccgtcagtgccatcccgacacctgcgcctgccagcgtgcccaggctataaaaaccgtgcatcatcggtaaaaccgtcttattcatttctctctcaacggcggcaccttcaacgtttatcgccacttccgcagaaccaaaactagccccaaagacgccgagaccaacggcaaagagcaagggcgatgtcagccagagtgccagacttaatatcatcatcccaatcaatgcgcaggacatcgtcacaaggatgacattacgcgtcccaaagcgtttcactaaccacgccgagcagagaataccgctcatcgaaccgatcgacagaccaaagagaacaccgcccatttcagcgatcgagacagagagaatatcgcggatagcaggcgtacgggttgcccaggacgccattaacaggcctggcaaaaagaagaacataaacagcgcccaggttcggcgtttcaatgcattacgtgaagaatttacggtcatagaccacgtcaaaataagaagagggaagacaacattagcaagactgtgtacatttgtacacaattgcagagagaggaaatgacatgcgtcgcgctaacgatccgcaacggcgagaaaaaattatccaggccacgctggaggcggtgaaactttacggaatacatgctgttacacaccgcaaaattgctacccttgccggggtgccgttgggatcgatgacctactatttttcaggaattgatgagttgttgctggaggcgttcagccgttttactgagatcatgtcccggcaatatcaggcattttttagcgatgttagtgatgctccaggcgcatgccaggctatcaccgatatgatctacagctcacaggtcgcaacgccggataatatggagctgatgtaccagctctacgcgctggctagccgaaaaccgctcttaaaaacggtaatgcaaaactggatgcagcgcagtcaacaaacgctcgaacaatggtttgaacccggaaccgcccgcgcgcttgatgcgtttattgagggaatgacgctgcattttgtcaccgaccgtaagccgctatcacgcgaggagattttgaggatggttgagaggattgctgggtagtagataaatttcaggcaacaaaaaacccatcaaccttgaaccgaaatggcggggttgatgggctccacaaaatggggacatcaaagaaaagcagtggcactaattaagactgatgccctgcggaaaagttctgcggttgtgcaaaaaaatttcattttcagggcaacttcagttttatcctaatcctggccataccatgacgatgattgtccctgccagcgtcagcaggacgttggcgattgcataggtgcccgcatagcccagcgccgggatgttactgcgagctgtatcactgatgatctccattgccggcgcgcaggtgcgtgcgcccatcattgcgccgaacaacagtgcgcggttcattcgcaatacataagcaccgaacaagaaacagataaccactggcacaagactgacaatcaatccggcaatcaacatctgaccgccaatcgcgcccaggccgttattaataccgctaccggcgctcagaccaacgcctgccataaacaccattaagccgaactctttcaccatgcttaatgcaccctgcggaatgtaaccgaaggtcgggtggttagcgcgcataaatcccagcataattccggcgaataacaacccggcagcgttccccatgccgaaactgaatgtgctgaactggaaggtgatcatcccgatcatcagcccaataacaaagaaggcgcagaatgccagcaagtcagtgacctggctgtgaatcgagataaagccgatgcgatcggcgatggtttttacgcgacgggcatcgccgctgacttgtaaaacgtcacctttgttaagcacgacgttgtcatctatcggcatctcaatctggctacgaatgacgcggttaaggaagcaaccgtgatcggtcaacttcagttgtgcgagacgtttgcccacggcgttatggtttttaacgaccacttcttcagtgacgatacgcatgtcgagaaggtcacgatcgaaaacttctttgccgttacggaagctgggatcgagtcgtgcgtgggcgtcgggatagcctaccaacgctatttcatcgcccatttgtagcacagcatcaccgtctggattcgccagaatcccgttacgtcgaatacgttcaatgtagcagccagtttgtcgataaatacccagttcacgcagatttttgccgtcggtccaggccaccagctccgggccgacgcggtaggcgcggatcaccggtaaataaaccttacggttggcatcagtgtccaggccacgttcgcgggcgatttgctgggcgctggtctgtaagtcctgatgctgcaatttcggcaagtaacgcgcaccaacaatcaaactcaccagaccgattaaataggttaaggcatacccgaggctcagattatccagtgccagtgagagctgcctgctttccatgccggaatgacgcagtgtatcgccagcaccgaccagaaccggtgtcgacgtcatagagccagctaacataccggccgtcaggccaatatcccagccaaacagcttacctaaccctaaggcgatcaccagcgcactgccaaccatcaccagtgctaacattaggtaatttttcccatcgcgaaaaaaaatggaaaaaaagttcggtccggcttcgaccccgacgcagaaaataaacagcataaagccaagattaagcgcgtcggtgttaatgctgaaatgttgttggcctaataacagcgatacgactaaaacgccaatggaattacccagttggatcgaaccaagtcgtaatttcccgagacatagcccaagcgcgaggaccacaaataataacagaatgtaattcccatttaacaattcggcgacgtttatattcacggaggctaacttcttgtttactagtaagctgttgaaagaaatggtaatttacgataatgttttttaccagaattcagggcgcagattcattcagcgcacctaaaagatagtaaagtaacaatatattttactagtgtaatcacattaggtatcaacggctatatgaattgcgttggcctatattagcatggaatgcgaagcggctttatcttactgaacgccacactggcgaaaaatgtgttcgatagacgcagtgtcaggaggaacgagtgaaacataaacaacgttgggcgggggcaatctgctgttttgtcctcttcattgtggtgtgtctttttctggcgacgcacatgaaaggcgcttttcgggctgccgggcatcctgaaatcggtttgctatttttcattcttcctggtgcagttgccagcttcttttcacatcgtagagaagtcctgaaacctctgtttggcgcaatgctggcggcaccctgttcgatgctcattatgcggctgtttttttcaccgacgcgctcattctggcaagagctggcatggttattaagtgcggtgttctggtgtgcgctgggggcattgtgtttcttatttatcagtagtttgtttaaaccacagcacagaaaaaatcaataaagccctcaacgcgagggcttgtcagacgatcaggcgtccagattctctttcgcccatgcagcaaaatcggtatagccgccgatatgttgctgatcgacaaaaatctgcggcacggtttctacgggtttacctgccttttgttgtagatcttctttagtgatcccttccgcacgaatatctacatactgatactggaaatcatcgcgttcattgctcaatttctcagccagatcttttgcacgcacacagtaagggcaacccggacgaccaaaaataacggtttgcattatttctctcctcatagatttatgcctgtaatgatcacgctaaaatgtattcgctgaaagtaggtttaacctgttgcattaattgataaaagctataactgttaaacacaatacagtgaaaagttttagactgaaggctcactttgcagagggaagcgtatgcgcgcgatcggtaaattgcctaaaagcgtgttgatactggaatttatcggaatgatgttgctggcggtggcgctgctgtcggtaagcgactccctgtcgctacctgagccattttctcggccagaagtgcagattctgatgatttttctcggtgttttgctcatgcttcccgctgcggtggtggttattcttcaggtggcaaaacgtcttgccccacagctgatgaaccatccaccgcaatattcacgttcagaaagagaaaaagataatgacgccaaccattgaacttatttgtggccatcgctccattcgccatttcactgatgaacccatttccgaagcgcagcgtgaggcgattattaacagcgcccgtgcgacgtccagttccagttttttgcagtgcagtagcattattcgcattaccgacaaagcgttacgtgaagaactggtgacgctgaccggcgggcaaaaacacgtagcgcaagcggcggagttttgggtgttctgtgccgactttaaccgccatttacagatctgtccggatgctcagctcggcctggcggaacaactgttgctcggtgtcgttgatacggcaatgatggcacagaatgcattaaccgcagcggaatcgctgggattgggcggggtatatatcggcggcctgcgcaataatattgaagcggtgacggaactgctgaaattaccgcagcatgttctgccgctgtttgggctgtgccttggctggcctgcggataatccggatcttaagccgcgtttaccggcctccattttggtgcatgaaaacagctatcaaccgctggataaagacgcactggcgcagtatgacgagcaactggcggaatattacctcacccgtggcagcaataatcgccgggatacctggagcgatcatatccgccgaacaatcattaaagaaagccgcccatttattctggattatttgcacaaacagggttgggcgacgcgctaaaactgccacgtcgatgtatgatacgcgggcttttgaccaggtctgacagagaggtgcagagtgaaaattgccatattgtcccgggatggaacgctctattcgtgtaagcggctgcgtgaagccgctatacagcgcggtcacctggttgaaattcttgatccgctttcttgctacatgaacataaatcctgcggcgtcttctattcactacaaaggccgcaagttaccccattttgacgcagtgatcccgcgtattggcaccgccattaccttttatgggacggcggcactgcgccagttcgagatgctggggagctatccgctcaatgagtcggtcgccattgcccgggcgcgtgacaaattgcgttccatgcaactgctggcgcgtcagggcatcgacctgcctgtcacgggcattgcgcattcgccggatgataccagcgatttaatcgacatggtcggtggtgcgccgctggtggtcaagctggttgaaggcacgcagggaattggtgtcgtgctggcggagacgcgtcaggcggccgaaagcgtgattgacgctttccgcggtctgaacgcgcatattctggtgcaggaatatatcaaagaggcgcaagggtgcgatatccgctgtctggttgttggcgatgaagtagtcgctgcgattgaacggcgagcgaaagagggcgattttcgttccaatttgcatcgtggcggcgcggcaagcgtcgccagtatcacaccacaggagcgtgaaatcgcgataaaagccgcgcgaacgatggcgctggacgttgctggtgtggatattctgcgtgctaatcgcgggccgttggtgatggaagtgaatgcgtcgccagggctggaaggaatagaaaaaaccaccggtatcgacatcgcgggtaaaatgatccgctggatcgaacgccacgctacgacagaatattgcctgaaaacgggtggttagtcgcaatcacattactgatcatggttttgcctgcgctttttgcgtaagctgtgccggtctttttatcggaagaggttgtacaaaattatgacatcgctggtcgttcctggtctggatacgttgcgtcaatggctcgatgacctggggatgagtttttttgaatgtgataactgtcaggctctgcatctgccccatatgcagaatttcgacggtgtctttgatgctaaaatcgatctgatcgataacacgatcctgttttctgccatggcggaagtccgaccttcagccgtattgccgctggcggcggatttatcagccatcaatgccagttcgctgaccgtgaaagcatttcttgatatgcaggatgataatctgccaaagctggtggtttgccagtctttatccgttatgcagggcgtaacctatgagcagtttgcatggttcgtgcgtcagagcgaagagcagatttcgatggtcattcttgaagctaatgcccatcaactgctgttaccgactgacgatgaagggcaaaataacgttaccgaaaactatttcctccactgataactcctttcgagcacgcagtcgctgccgcagtgactgcgtgccgcaaaattatccgctgtttttaaccttttattaaagattaattcacttctcttgtgccgatttggctttatcacatagagcaaatacgcataaaaatttgttaaataccgttttttaatccgagctatagtctcaaaccctggctaaagttattcttgcgatgcttttatatagtgagcagtgcaggccgggagagagttctcttttcttacaccgcgccgataaaaatatgcacgtttattgcatatctttcagtgtgacaacttttgttcgtttgttaacgaattttcagaaggaaagagatatgaccgccttaaataaaaaatggctatcgggtctggttgcgggggctctgatggccgtctctgtcagcacgctcgcggctgaacaaaaaacactccacatttataactggtctgattatatcgccccggacacggtggccaactttgaaaaagaaaccggtattaaagtcgtctacgatgttttcgattctaacgaagtactggaaggcaaattaatggcggggagcaccggctttgatctggtggtgccgtcagcaagctttcttgagcgccagctgacagcgggagttttccagccgctggataaaagcaaattgccggagtggaagaatctcgatccggagctgctgaagttggtcgccaaacacgatcccgacaataaatttgctatgccctatatgtgggcgacgaccgggattggctataacgtcgataaagttaaagcggtgctgggcgaaaacgcgcccgtcgatagctgggacttgatcctcaaacctgaaaatctggaaaaactgaaaagctgcggtgtctctttcctcgatgcgccagaagaagtgtttgctaccgtgctgaattatctcggcaaagatcctaacagcactaaagcggatgattacaccggaccggctaccgatctgctgttaaagctgcgcccgaacattcgttatttccattcatcccaatacatcaatgatctggcgaatggtgacatctgtgtcgctattggctgggcgggcgatgtctggcaggcgtcaaaccgcgcgaaggaagcgaagaatggcgtgaatgtctcgttctcgattccaaaagaaggggcgatggcgttctttgatgtattcgccatgcctgcggatgccaaaaacaaagacgaagcctatcagttcctgaattacctgctgcgtcctgatgtggtggcacatatctctgaccatgtgttctatgctaacgccaataaagcagccacgccgctggtgagtgcggaagtccgtgataacccgggtatttatccgcctgcggatgttcgtgcgaagctgttcactctgaaagtgcaggacccgaaaatcgaccgtgtgcgcacccgcgcgtggaccaaagtgaagagcggaaaataatccgcagccgtagatgccggacgggcgcaccacacccgccggcaattcgcaccatcatggtgcgcttgcacacattcaatgccggagagcagccgtgaatgacgctatccctcgcccgcaggcgaaaacccgtaaggcgctgacgccgctattagaaatccgtaacctgaccaaatcctacgatggtcaacatgcggtggatgatgtcagcctgaccatctacaaaggtgaaatcttcgcgctgctgggcgcatccggctgtggcaagtccacgctgctgcgtatgctggcaggttttgaacaaccttctgccgggcagattatgctcgatggcgtcgatttgtcacaggtgccgccttacctgcgccccatcaatatgatgtttcagtcttacgcgctgtttccgcatatgaccgtggaacagaacatcgcttttggcctgaaacaggacaaactaccgaaagcggaaattgccagccgggtcaatgagatgcttgggctggtgcatatgcaggagttcgccaaacgcaaaccgcatcagctttccggtggtcagcgtcagcgtgtggccctggccagaagccttgccaagcgcccgaaactattactgctcgatgagccgatgggcgcgctggataaaaagctgcgtgaccggatgcagcttgaagtggtggatattctggagcgtgtcggtgtgacttgtgtgatggtcacccacgatcaggaagaggcgatgaccatggcggggcgtatcgccattatgaatcgtgggaaatttgtccagattggcgaaccggaagagatctacgagcatccgaccacccgctatagcgctgaatttatcggttcggttaatgtctttgaaggtgtactcaaagagcgtcaggaagatggtctggtgctttattcgccgggactggtgcacccactgaaagtcgatgcagatgcttcagtggttgataacgtgccggtacacgtagcgctgcgtccggaaaaaatcatgctttgcgaagagccgcccgccaatggttgtaacttcgcggtgggggaggtgatacacattgcctatctcggcgatctttcggtgtatcacgttcgtctgaaaagtgggcagatgatcagcgcccagctacaaaacgcccatcgtcatcgtaaagggttaccgacctggggcgacgaagtacgtttgtgctgggaagtggacagctgtgtggtgctgacggtttaaggagcaaagatgagtacacttgaacctgctgcccagtcgaaaccgccgggcggatttaagctgtggttgtcgcagctgcaaatgaagcatgggcgcaaactggtcattgcgttgccatatatctggttgatcttgctgtttctgctgccatttctgatcgtctttaaaataagcctggcggagatggcgcgcgctattccaccttataccgaattgatggagtgggctgacgggcaactttctatcactcttaatctcggtaattttctgcaactgaccgacgatccgctctattttgatgcttatctccagtcgttacaggtggcggcgatttcgactatttgctgtttactgatcggctatccgctggcgtgggcggtggcgcacagtaagccttcgacccgtaatatcttattactactggtgatcctgccgtcgtggacctcgtttctgattcgtgtctacgcctggatgggaatattaaaaaacaacggtgtgctgaataattttctgctgtggctgggggttatcgatcaaccgctgaccattctgcataccaactttgcggtttatattggcattgtttacgcctacgtgccgtttatggtgctgccgatttacaccgcgttgattcgtattgattattcgctggtagaagcggcactggatctcggtgcacgaccgctgaaaacgttctttaccgtgatcatgccactcaccaaaggggggattattgccggatcgatgctggtgtttatccctgctgtgggcgagtttgtgatcccggaactgctcggtggcccggacagcatcatgatcgggcgcgtgctgtggcaggagttctttaacaaccgcgactggccggtagcctcggcggtagcgatcatcatgttgctgctgctaattgtgccgataatgtggtttcacaaacaccagcaaaaaagcgtgggagaacacggatgaataatttaccggttgttcgttcgccctggcggattgtgattttgctgctgggcttcacctttctctacgcgccaatgctgatgctggttatctattcattcaacagctcgaaactggtgacggtgtgggccggctggtcaacgcgctggtatggcgaattattgcgcgatgacgcgatgatgagtgcggttggtttaagtctgacaattgcagcctgtgcggcaacggcagcggcgatcctcgggacgattgcggcggtggtgttggtgcgttttggcaggtttcgcggatcaaatggttttgcctttatgatcaccgcgccgctggtgatgccagatgtcatcacgggtttgtcgctgttgttgttattcgtcgcgcttgctcatgctattggctggcctgcggaccgcggtatgctcaccatctggctggcgcatgtcactttctgtacggcttatgtggcagtcgttatttcgtcgcgtctgcgggaactggatcgctcgatagaagaagccgcgatggatctcggtgcgacgccgctgaaagtgttttttgtcattacgctaccgatgatcatgcccgcgatcatttctggctggttactggcttttactttgtcgcttgatgatctggtgatcgccagctttgtttccgggccgggagccaccactttaccgatgctggtcttttccagcgtgcggatgggggtgaatccggaaatcaacgccctggcaacattgatcctcggcgcggtcggaattgtcggatttatcgcctggtatctgatggcgcgcgcagaaaaacagcggatacgcgacatccagcgtgcaagacgtggctgaagacactaaaatttgccaacctggctacataatgccgcgcatgtcgcggcattgttttcatggaagacgaaacgttgggattttttaagaaaacatcttcatctcatgctcgcctgaatgtgcctgcgctggtgcaggtggcggcgctcgccattattatgatccgtggcctcgacgtgctgatgattttcaatacgctgggcgtgcgcggtattggcgagttcattcatcgcagcgtacaaacctggagtttaacgctggtctttttgagcagtctggtgctggttttcattgagatctggtgtgcgttttcactggtgaaagggcgtcgctgggcgcgctggctgtatctgttgacacaaatcacagccgcaagttacttgtgggcggcctcgctggggtatggttatccggagctgttcagcattcccggtgaatcaaaacgtgaaatcttccatagcctgatgctgcagaagctgccggatatgctcatcctgatgctgctgttcgttccctcgaccagtcggcggttcttccagttgcaataatgtgtataatcgtcgcccctgatgatgtgaaggtcaatgtatgcagtgcgcactttacgacgcgggtcgctgtcgttcctgtcagtggataacgcagccgattccagagcaactctccgctaaaaccgtcgatcttaaaaatctgctcgccgattttccggttgaggaatggtgtgcgccggtgtcaggcccggaacaagggtttcgtaataaagccaaaatggtggtgagtggtagcgttgaaaaaccactgctcggtatgctgcatcgggatggtacaccggaagacctttgtgactgcccgctttatccagcctcatttgcgcccgtttttgcggcgctaaaaccgtttatcgcccgtgcgggtttaacgccttacaacgtggcgcgtaaacgtggtgaactgaaatacattctgctgactgaaagccagagcgatggcggcatgatgctgcgttttgtactgcgttctgataccaaactggcgcaactgcgtaaggcgctgccgtggttacaggaacaattaccgcagctgaaagttattaccgtcaatattcagccggtacatatggcgattatggaaggggagacggagatctacctgaccgaacaacaggcactggcagagcgttttaatgacgtaccgctgtggatccgtccgcaaagtttcttccagactaatccggcggtcgccagccagctgtacgccaccgcgcgcgactgggtacgacagctgccggttaaacatatgtgggatctgttctgcggtgtgggtggctttggtttacactgcgcgacgcctgacatgcagttaaccgggatcgaaattgcaccagaggccattgcctgtgcgaagcagtcagccgctgaactgggcttaacgcgtttgcaatttcaggcgctggactctacgcagtttgccaccgctcagggggaagtgccggagctggtgctggttaacccgccgcgccgcggcatcggtaaaccgctgtgtgattatctctcaacgatggcaccgcgttttattatctactccagctgtaacgcccaaactatggcgaaagatatccgcgaactgcctggttatcgcatcgaacgggtacagctttttgatatgttcccgcacaccgcgcactatgaagtgctgacgctgctggtgaagcaataaaaaagccgcaggtgcggctttctgaatcttactgtgggaaccactggtcattgattttctgatatgtaccgtcagctttaattgctgccagcgcgttattcagtttttccagcagagctttgttatccggacgtacagcgatacccaggccggtgccgaagtattgcggatcggtcactttttcagtagcaacgcccagttgcggattggttttcagccattcgtttaccactgcggtgtcaccaaatacgccatcaatacggccatttttcagatcgataaaggcattctgataactgtcataggagacagtttttacttccgggtgctgatcctgaatatatttctggtgcgtggtgccgttttccatcccaatacgtttgcctttcagatcggcaaacgttttgtaggtatcttttttggcaatcacgacggctgagttttcgtagtagggcgtggtaaacgatacctgtttgctacgctccggcgtgatatccattccggagattacggcgtcatattttctgaatttcagtgacgggatcaggctgtcgaacgcgtgattagtaaaagtacattctgcctgcatttgtttgcacaaggcttttgccaggtcgatatcaaagccgacaatctcattattagcacctatagattcaaagggtggataggtggctgaaacgccaaaattgattttctctgcggcagaagcaccgaaagtaaaagaagcaagtaaagcggcaagaactaactttttcatgatggaactcccgtctgtcaatcttatgatttttggccgtgtctgcggcatgggataacaatgccatcaagtgaatttatatgcaataaatatgagtaaataatttatatgaaataaaaaaagacggacagcttagtgggttgtccgtcttcataataagaatttatgcactatgtaggccggataaggcgtccacgccgcatccggcatcagcatgcagctacattaattccgccgttcgaatgccagtgctttacgctcgatcagacgcatcatcagcgtcagcaggccgttgacgaccaggtaaataatccccgccgcgccaaataccattacatcgtaggtgcgtccgtacaacaactggctgtatcccatcacttccatcagcgtaatggtgtaagccagagaggtacttttgaacaccagcaccacttcgttggaataagaagagagcgagcgtttaaacgcgtacggcagcaggatcgccagcgtatcttttttgctcattcccagggcgctacaggactgccattgaccttccgggatcgcgcgaatcgcaccgtaaaacagctgcgtggtgtacgccgcactgttcagcgacaacgcaatcagcgcacataaccacggttctgacaacaaatgccacagtgccggatactcctgcaacgttgggaactggcccggtccgtaataaatcaggaagatctgcaccagcagcggcgtaccggtaaacagcgtgatatagccccgcaccagccacaccagcaccggcgttttcagcgtcaggatgatggtaaaaatcaatgccagaatcagtgccacaatcagcgaggcaacggttagcgtcaggctggtgtgcagccctttcatcagttcgggtaaatactcaaacattagctgggcctccgctcaaaacgtgtcgcgcgcaggtcaatgcgtttgagaatgtactgactgagcagggtgatcaccaggtaaatcaccgccgccacaatgtaccaggtaaacggttcctgtgtacgggtagcgatgcttttggtttgtagcattaaatcattcacactaatcaaactgaccagcgcggtatctttcagcagcaccagccactggttaccgagacctggcagcgcatgacgccacatctgcggcatcaccagacggaaaaagatagccgatttcgacagccccagcgcctgaccggattcccactgacccaccggcaccgcttttaatgcaccacgcagcgtttgcgaggcataggcggcatacagcagtgacagtgcgatgacaccacaaaggaacgggctaacgtcgaagttctcaatgtccatctgcaccgggatctgcacgaacccaagattgatagtgaagccatccgaaagcgtcagcagcagctgcgaggagccaaaatagataaacagcaccaccagaatttctggcaggccacgcagaatggttaccagcgctgaacctgcccacgcgacaggacgccatttcgcagactcccataccgcaaagaacatcgccagcgccagcccgacaatcaatgcacaaacggcaaggccgacggtcatcccggcggcgcttgctaaaggaaaaaattcattcatcaggaattacttctggaaccatttgttgtagatggtttcgtaagtgccatctttcttcactttttccagcgcagtgttgagtttctgctgcagttcagtgttgccctggcgtactgcgatgccgaggccagtaccgaagtaatctttatcggtcactttatcgcccactgccgccagtttcgggttatctttcagccattcggttaccactgcggtgtcaccaaatacgctgtcgatacgaccgttttgcagatccagttttgcgttctggtaactgtcatatggcacggtagtgatttccggatgcttatccataatgaacttctggtgtgtcgtcccgttctgaacgccgacttttttgcctttcagctgatcaacactggtgtatttgccttgctgacccacaaacagggcagagttgtcatagtacggggtggtaaacagcacctgcttttcacgctccggagtgatatccatgcccgccatcactgcttctacgcgacggaatttcaggcttgggatcaggctgtcaaacgcctggttagagaaagtgcaggttgcatcaatctctttacacaatgcctgcgccaggtcgacatcaaaaccaacgatctggttgtttgcatcaatcgattcaaacggaggataggaggcttcggtggcaaaacgaatggtttcggctgctgtggcggaaagactaaaacctgcaattaacgcggcaatcagaacttttttcattgttgttatcccgaatcttagtgagagagatagtttttaaatgcttcggtttgcggctcggtaaagcagctcgcgtcgccttgttctacgatatgaccgttttccatatacaccactcggctggcggttttacgcgccacttcaacttcgtgggtgacgatcacctgggtaatattcgtttctgccagctcacgaatgatgctgacgatttgtgccgtaatttcggggtccagtgcggcggtcggttcatcgaacagcagtacctgcggttccatcatcaacgcacgggcaatagcaacacgctgctgctgacctccagaaagatgcagcgggtaacgatcgctataaggtttgagacgcagacgttccagcagtttttctgcacgggccagcgcctgatctttactcaaccccagtacacgacagggcgcttcaatcaggttttgctgcacggtcagatgcggccacaggttgtattgctgaaacaccatgccaacgttacgacgcaaatcgcgaatcgctttgtcagagggggttttggtgaaatcgaaatggttgcctgcaatgttgagcgtaccggagcgcggcatctcaagcagattgagtacacgcagcagcgagcttttacccgcgccgctggggccaagtaacaccagcgtttcgccctgtgggcaatccagcgtgatatcgaacagcgcctgatgcgcgccgtagaagcaattaatgccgtttaattgaatactcattgacactcgtatactggcagtctgatagctattgaggtcgaagataatacctttgacagaataattatgcaatatttctgctttaaaagttaaaagcaaagcgcattattcaataaacatagcacaaaataacgggggcggtggtcggcgagcataaatgtcggcattcctcacgaaatgccgtacaatttacggggtttattggttgatcaagacgttagcgattctcgatggactgacggagcgtacccgctgtggcatgaacgctaccgcctaagtagcgcacatcgtcgatgacccaacactggccttcctgaatcattaacacttcatcctgccagccctggtcaccctgcttgagatccacgcgcaatggaatgttacgggcatcacgattagggatagtagatgcactggcaacgtgggcgctgtctggcaaggtggttcgactggagaacggatcgctgcttaacaattcacgatgactattatcgcggctggcatcgctaagtagggttgccagtttgtcactcaaataggggcgtagagcggtaatgtcattgccgcgatgttgaatgcggtagtcatagaactgttgagccacgctatcaggccccccctggacacaggaaccggtgcgggggccgttatctttataagctggcgtgacggtggtacaggcactgagtagcagtgcgcaagggataagcatggtcaatttgctatagcgcatgatgatttccttataagcgaacaccttgaaagcgttctacgataataatgatatcctttcaataatagcgtatcagtccgataatgctttgaagatcgaaggcttagcaaacaaggagatcgatcatgcaattttctacaaccccaactctggaaggccagaccatcgttgaatattgcggtgtggtgactggcgaagcgattttaggcgcgaatattttccgtgatttctttgccggtatccgcgatatcgttggcggacgctccggtgcctacgaaaaagaactgcgtaaagcgcgggagattgcctttgaggagctcggctcccaggcgcgagcgctgggggctgatgccgtcgtcggtattgatatcgactacgaaacggtcgggcaaaacggcagtatgctgatggttagcgtcagcggtacggcggtgaaaacgcgtcgatgagaagagtcttctggctggtcgctgccgctctgttactggcagggtgcacaggcgaaaaaggcattgtcgagaaagagggatatcagcttgatacccgacgccaggcgcaggcggcgtatccgcgcattaaagtgctggtgatccactacaccgcagatgattttgatagctcgctggcgacactgaccgataagcaggtcagctcgcattatctggtccctgcggtgccaccgcgatacaacggtaaaccgcgcatctggcaactggtgccggaacaagaactggcctggcatgcggggattagcgcctggcgcggggcaacgcgccttaacgacacctctattggcattgagctggaaaaccgtggctggcaaaaatcggcgggagtgaaatattttgccccgtttgaaccggcacagattcaggcgcttattccgctggcgaaagatattattgcccgttattacatcaagccggaaaacgtagtagcacatgcggatattgcgccgcagcgcaaagacgatccggggccattatttccctggaagcaactggcgcagcaggggattggtgcctggccggatgcgcagcgggtgaacttttaccttgccgggcgcgcgccgcacacaccggtagagaccgcgtcattgctggagcttttggcgcgttatggttatgacgtaaagcctgatatgactccgcgcgagcagcggcgcgtgattatggcgttccagatgcatttccgcccgacgttatacaacggcgaagcggatgcagaaactcaggcgattgccgaagcgttgctggagaaatacgggcaggattagcgcggcagttttccgtggtcgcgtagccaggcggcagttttctcgataccttcatccagggtgaggactggttgataacctaactcttcctgcgcacgcgtaatatccagcgtaaagtcaaaattcaacttggagacgccgtagtgggtcagcggcggctcttttgctgacttgcggcctaaacgctccatgctgcgggcgatcatatccagcatcgggtaagggacggaacgaatacgacagtcaatattcaactcgtcgatcagcttctgcacgatgctgcgcagtgtgcgatgctcgccgttggtgatgttgtacacacgcccggaaggtagcttatcgcaggcttcctggcttgccagccacatggcgtgcacggcattttcatagtaggtcatatcgaccagcgcactgccgccgtgcggtaacagaatgctgccgtagtggtgcatcatatgcgccagacgggggataaagactttatcgtgcggtccgaacagactttgtgggcgcagaatagtaaagcgcgtttgtggattcgcctgcgaaagcatattgatcacctcttcgctggctgctttgctgcgggcaaactcgttggcgaagcggtgagggcgaaaatcttctttaatatcgcgatggtggtgataatcgaagtacagggagggggaagagatatgaataaagttacgcacaccccaggcgacagcccattcacccaggcggcgagtggcgcgaacgttagccagatcgaaagcctgttgtgtcccccagggcgaggtaaagctggagcagtgccacagcgtatcaatgcccgcgagcatcactttagcttgtgatgaaaccagctcggtcagatccgccggaacaaactctgcgcccattttttccagcaatttacccattgcctcgttgcgaccggtcgctcgcacgctgatgcctttctggcataaaaactctaccgcgtttcgacctaagccgctggtggcgccggtaaccagtaccttcatatcaatccactgttgttgagaaaataacgtgcgcattcttccgtgatttcccccatgatgcaatgggaaacatgaaagaataacgcaggttttgtcgattaatctgtgctttgttctgccagtctggcgattcgttttgccattccgcgaaaaataaacagatgcgcggggatcatcaataaccagtaaaacaaccctggcataccgtgcggatgccagaatgcgcgaacatcgatagtacgatagtcacctttatcttccagggtaaaacacagtcgtcccagccccggcgctttcatgccaaataacagcgtaagttgtttttccggttcaacgacaatgactttccagctatccaccgcatcgccagtttgcaaatattcgcgctccgggcggccttttgccagtttatgaccgatcgcaaggtccatcagcgctcgagtctgccacaaaatattgccaaagaaataacgctctttaccgccgatttgattgaccacccgccatagcgcctgaagtctggcagacgttttaacggtaaaccccgcctgtttggcaaaataaccgtattctggtcgccagcgagcaaaagcctgcgcgtcatatccccagtcgctggagttgaccagtttttcttcctctttcaacgtgctacgtaccgcgtcatcgaaagcaatcagcggttgtggaatgagtgcacgtaacgcggtgtcatctgccagcagatcgtgtttcagcccctgaatcaacgccctggcggtggtgggtggtacggaagtaatcacattaagaaaccacaccgaaatccagcgggtgggaaaggggatggggagcaaccagcggcgcttaccgctcaccgccataaaatgttcaaactgttgctgataactgagcacttctggtccggcggcttcgaagatgcgatgttcgctggctggatgatctaacagcgccaccagatagtgcagcaagttttccagcgcgatgggcgtggtgcgtgaacggacccagcgtggcggcgttaacactggcaggttgtagaccatatcgcgcatgacctcgaacgccgctgaacctgcaccaacgattattccggcacgcaattcggtcaccgggacacccgcttcacgaagaatgtccgccgtagcctgacgggcgcgcagatggtccgactgctcatgtggcggggcctgcaacgaactgagaaagattaattgcttaactgggacttcacgtagcgcatcgcggacgttgagagccacctggcgctcctgagcgataaaatcgccgccttcgcccatgctgtgcaccagaaaatagaccgtatcaatatcctgcaacagggccggaaggttatccggccagctgagatcgactttatggcaactgacatttgccagttgcagctttgcaagcctgtcgacatgacgtgccgccgccaggagctgatgcccttgctggctgagtgtgcgcaccagatgctgaccaatgtagccactggcaccgagaactaaaatgcgttgcggcacgtctccctccttaacgcgccaggaatgcgcgccagtgggcggcgacttccgccagttgtgcacgcgagacgtcaagatgggtcaccaggcggacaatcggcgaggcgttaatcagcacgtttctcgctttcatgtattcgcctaacgcggcagcattttcttccccgacgcgaacaaacagcatattggtgtcctgacgcatcacatccgtgcctgcttcacgcaactgctccgccatccaggtggcattgtcgtggtcttcctgcaaacgtgcgacgttatttttcagcgcatacatcccggcggcagccagaatgccggactggcgcatcccgccacctgtcattttccgccagcgaatggcacgtttaatgtaatcacgattaccgacgagtaatgaaccgactggcgtcccaagacctttcgacaggcaaatggtgaacgagtcacaatattgcgtgatctctttcagttcgcagccgtaagccaccacggcattaaagatgcgcgcaccgtcaacatgcagcgccagattgcgcttgcgggtaaattcccatgcctcttttaagtattcacgcggcagcactttgccgttgtgggtgttttccagactgagtaatttggtgcgggcgaaatggatatcgtcgggtttgattttcatcgccactttatccagcggtagcgtgccgtcggcagctgcgtcgatgggttgcggctgaatactgcccagcactgctgcgccaccggcttcaaacagatagttatgcgcggcctgaccgacgatatactcttcgccgcgttcgcagtgactgagcagagcgaccaggttggcctgagtgccggtcggcagaaaaatggcggcttctttaccggaaagctctgctgcatagtcctgcagagcattaacggtagggtcgtctccgtaaacgtcgtccccaaccggggcggccatcatcgcttcgagcatggcgcggctcggtcgggtaacggtatcactgcgtaaatcaatcatggcatgtccttattatgacgggaaatgccaccctttttaccttagccagttcgttttcgccagttcgatcacttcatcaccgcgtccgctgatgattgcgcgcagcatatacaggctgaaacctttggcctgttcgagtttgatctgcggtggaatggctaattcttctttggcgacaaccacatccaccaacaccggaccgtcgatggagaaggcgcgttgcagagcttcatcgatttcagacgctttttctacacgaatacccgtaatgccgcaggcttcggcaattcgggcaaagttggtgtcgtgtagttcggtgccatcagtcaaatagccaccagctttcatctccatcgccacaaagcccagcacgctgttattaaagacgataattttcactggcagtttcatctgcactaccgagaggaaatcgcccatcaacatgctaaaaccgccatcgccgcacatggcgaccacctggcgttccggctcggttgcctgcgcgcccagcgcctgcggcatggcgttagccatcgaaccatggttaaacgaacctaacaggcgacgcttgccgttcatttttagataacgtgccgcccacaccgttggcgtaccaacgtcacaggtgaaaatagcgtcatcggcggcaaaatgactaatttgctgcgccagatattgcgggtgaatggctttctcactcggtttagctaaatcgtccagccctttgcgggcgtcgcggtaatcttccagcgccttatccagaaacttgcgttcggttttttcttccaccagtggcagcaatgcgcgcagggttgatttgatatcgccgaccagcgccatatctaccttgctatgcgcgccgatgctggctgggttgatatcaatctgaataattttggcatcggtcgggtagaacacacggtagggaaactgagtaccgagcagcactaacgtatcggcgttcatcatggtatggaaacctgacgaaaagccgattaatcccgtcattccaacatcatatggattatcgtattcgacatgttctttaccgcgcagggcatggactataggcgctttaattttcccggcaaactcaactaactctttatgcgcccccgcacagccgctgccacacatcagggcgatattgctggaataacgcagcagttgcgccagtttgcgtaactcttcttcttccggtgttactaccggctgtggcgcatgataccagtgggtagttgccccttctggcgcaggttttaacgccacgtcgcccggtaacacaacaacggaaacgccacggttaagcaccgctttgcgcatagcaattgccagcacttgtgggatctgctctgggctggaaaccagctcgcaatagtgactacattcgcggaataactcttgtgggtgggtttcctggaaatagccgctgccaatttcgctggagggaatatgagcggcaatcgccagtaccggaacgtgattgcggtggcaatcgaacaggccgttgattaagtgcaggttgccgggaccgcacgatccggcacagaccgccagttctccgctaagttgtgcttcagcgccagcggcaaacgccgccacttcttcatgccgggtggacatccactcgatggtgcccatgcgattaagactgtcactaagaccgttcagagagtcgcccgtgactccccagatgcgtttcacgcctgccgattcgagtgttttggcgatataagctgcaaccgtttgtttcatggttctccatctcctgaatgtgataacggtaacaagtttagttcatctgacggagggggaagggatgggagaaaaaggaggcactaacggttaaatagcccgatgaaaggaatatcatcgggcatcaggcgattatgcgagaaccaaatccccctgcggatggcaggagcaggccagtacgtaaccttcagcgatttcggcgtcggtcagcgtcattgtgctgctcaccgtatattcaccggaaatcactttcgtcttacagcagccgcaaacacccgcacggcaggcggcgacaaccggaacgttattgctttccagcgcctccagtagcgtggtgccaaccggagcgtaaaattctcgtgccggttgcagtttggtgaatttcagaccactggtcgccgcttccgctactggggtgaagaatttctctttaaagaaacgcgtcacgccgagcgctttcacttcctgctctacccaatccatatatggagcagggccacaggtcatcacggtacgtgaggctaaatcaggaacgcgagtcagcagttcgcgagtgagacgaccagcgataaagccttcggtaacgttattttccgccaccagcgttaccggatagttacgccactcatcggcgaaaatcacatcctgcggcgtacgcacgttgtagatcacctgcacatcggcctgtggacggttcttcgccagccagcgacgcatcgacataatcggcgtgacgccgcagcctgccgccagcaacaggaatttatcttctgctttatcgtcgcaggtaaattcccccatcgcgtccgaaagccagagataatcaccgcgttttacatcgcgcgtcagccaccgggagccgacaccgtcatcaatccgccgcacggtcagggtgatgtattcactcacgcctggcgtggaggaaatggtgtaagcacgcagcgtttctgctgagtttcgcacgctgaccagcgcatattgcccggcgcgatatgggtagtaatcgtggcaaatcagggaaatcgtccacacatccggcgtttcttgcgtaatgtgatgaacctgcatccgccacgggcattgattcgttggcatcgtcatcgacaaactccttacgcgctcaacagttgcttcatgtcttcttcaacagtggtgatagaacgcaggccgaatttctcgttcagcaccgccagcaggtctggtgtcaggaaaccaggtgcagtcgggccggtgacgatatttttcacacccagagaaagcagcgtcagcagaatgacaatcgctttctgttcaaaccaggagagcaccagcgacagcggcagatcgttcaccccacagcccagtttctctgccagcgttaccgccagaataattgctgagtaagcatcgttacactgaccagcatctaccagacgcggcagaccttcgatatcgccaaactcaagtttattaaagcgatatttaccgcaagcgagggtcaggatcaggcagtcatccggcacgctggtggcgaaatcggtgaagtagtgacgctcgccgcgtgcgccgtcacagccgccaagcaggaagatatgacgcagtttttcacggctcaccagatcaatcagcgtatcggctgcgccaagcagtgtctggcgaccaaagcccacggtgatcaggtgcggaatttcgctgtacgggaagcccgccatctgttgcgcctgggcaatgactgcagagaaatcttcgccatccagatgacgcacacccggccagccaacgatgctgcgggtccagatacgatcgtcataagcgcctacggttgggtcgatgatgcagttcgaggtcatcacgatggggcctgggaaacgagcgaactccacttgctgattctgccagccgctgccgtagttaccgaccagatgcttgaatttacgcaactccgggtaaccatgcgcaggcagcatttcgccgtgggtgtagacattaacgcccgtgccttcggtctgttccagcaggttgtagagatctttgagatcgtgaccggaaatcagaatgcatttacccgccgtcgctttgacattgacctgggttggggtcgggtgaccgtatttaccggtttcgcctgcatccagaatgctcatcactttgaaattcatctggccgatttccattgaacactcaagaagcgcgttcatatcggcaggccaggtccccagccacgccatgattttatggtactgggcataaatatcgttgtcgtattgaccgagaacatgcgcgtgttccatataggccgccgcacctttcaggccatacaggcacagcagacgcaggccgagaatgttttcgccaatcgccgctttatctttgttaggggtaaattctgctgcctgacgttgcagctcgccgagatcgtcgctcaccagttgcaggtcagccatcgggttatcgacgcgggcgttggcatctacagccaggcattgtgctttcagcgcctcgcgcagggcaatcgcttcacgagcgtagccgacaatacgcggagaatcgaagttaacgttggtcagggttgagaaaaaggcacgtggcgcaaagctgtctacatcgtggttgatgatgccgtattcacgtgctttcactgcccaggccgaaagcccttgcagcgccgcgatgagtaaatcctgaaggtcagaggtttccgccgttttaccacacatcccctgcgcgtatgagcagccgtttcctgccggagtacggatagtttgttcacattgcacacaaaacatgatcacaccttttaaagttatatttaatatacatgtttaaggttaagacgcttaacgcggggataaaagagatttttaatgcaactttaagggagattgatttagcgcaattttggcggcagagatctaccgccagagaggtattatgcagagaaaaaggcgatgagaatcggcactaacagactaagaataaaaccgtgaacaatcgccgccgggaccatatccagcccgcctgtacgttgaagaacgggcagggtgaaatccatcgacgtcgcaccgcataagcccagtgcagtagagcggctacggcgaatcagcccagggattaacataatagcaatcagctcacgggccagatcattaaaaaacgccgcgctcccgattaccggaccaaaagattcggtcaataaaataccggaaagagaataccagccgaaaccggaggccattgccagcgcggtattgatgggaagatcaagaataaaggcgttaattaaaccaccaattaatgaactggcaaccaccaccacggcgacaatcattccccggcgattaaggacaatctgctttaaggtcatgccattattgcgcaactgaataccgacgaggaaaagtagcagaattaaggtgtattcactggcttcggtcgcgtgttgtaagaaagccagtccactcagaccaatggcaaaaccaatcactactacgccgcacagttttagcgactccagcgccatcgcaatacgcgacgggagtttttcttgatgatggtggttgcgccatggcaggccgcgctccagccacatcagggcggcaatattacacagtaaaataacggtaatactgacggcagaataatgcagaattgccaacaagttactggcgaggttatcgagaaacgccagactgatacccataaaaaagagaataaggtaaaccatccaacttaatagctgattaataactcttaatgcagctttttggcgaagcggaatgaggtaacccacaatcaggggaaccagaatgattaacagcccagaaaacatgaaaacccagtccttgcaaagaagattcgaaatgcgcgatgacacactactgaaagcagaaggacgagtaaagttgcaattaaaaggaaatgttatgcatcagagggggatttttaattctatatgagtgtttagcgttgttgcgctcctttcatgtgcaatgccatataaagccactggcgcagggagcggccagtcgccgccgccccctgcacccccggccttcggggaacgcctcggcgattttaacgccaccaacacccgtgcggtttgtaacgtcgaagataaaaccaccagggcagacaacatgccaatgctaattaatcgcgtttttccagtagagtccggtaaatcagaccaccgataataccgccgacaattggcaccacccagaagaaccacagttgttctaatgcccagccgccctggaagatagcaaccgcagtactgcgcgccgggttaacggaagtgttagtcaccggaatactgattaagtgaatcagggttaaggccagaccaatggcaattggcgcaaaaccagcaggagcgaatttgtcagttgcgccgtggatcaccagcaggaaacctgcactcaataccagttcaactaccagcgcggaaagcatggaataaccgcctggtgaatgctcgccataaccgttagaagcaaaaccgctggctgccgcgtcaaaacccgttttaccactggcaattaaatacagcagcgccgccgcaacaataccgccgacaacctgggcaattacgtagccaacgacttcttttgccgggaaacgtccgccagcccataaaccaatagtgaccgccgggttaaaatgaccaccagaaatatgaccaacagcaaaggccattgtcagaacggtcagaccgaacgccaacgccacgccggcaaaaccaatgcctaattccgggaagcctgcggccagtacggcactaccacagccgccaaaaacaagccagaaagtaccaaaacattcagctgctaattttctgaacatatccacctcaattaaaaattgaccctgtgaaaaatatggtcgttttatagggtcgtcgtaaaaaagtgacgacggaaataatgcgcggctattttaaaaacgaaggcaagtcattcaccagataaataaatccagtaaatttgatttaaggcaacagcgggttgccccatatagtcatttgtctgattgacagtgtagtgcaagcgaaagatttaatcctttaggcgtaataaaaaataatttatcatgctaattatttgattttgttgtttttgcaggcttatcagcaagagggagtataacgcgattattcgctcatttttcagacatttgccatgcttaaatgtgatgtcatcacgtattagcatggcctttcccgttatactgccagcgtaaaggataagtcacatatttctggaggggatatgattcttgagcgcgttgaaattgtgggttttcgcggtatcaaccgtttgtcgttgatgctggaacaaaacaacgtcctgattggggagaacgcgtggggtaaatccagcttgctggacgccttaaccctgctgctatcgccagaatcagatctctaccattttgagcgcgatgatttctggttcccgccgggagatatcaacgggcgagaacatcatctgcatattattttgaccttccgcgaatcgctgccaggccgacatcgggttcgccgctatcggccgctggaagcgtgctggacgccatgcaccgatggttatcaccgtattttttatcgtctggaaggggagagtgcggaagacggcagcgtgatgacactgcgcagttttctcgataaagacggacatccgattgatgttgaggatattaacgatcaggctcgtcatctggtgcgtttaatgccggtgctgcgcttgcgtgatgcccgttttatgcgccgtattcgtaacggcacggtgccaaatgtccccaatgtggaagtcaccgcgcgccagctcgatttcctcgcccgtgaattatcctcacatccgcaaaatctctctgatgggcagattcgtcagggactttccgcaatggtgcaacttcttgagcattatttttctgagcagggagctggacaggcgcgatatcgtttaatgcggcggcgagccagcaatgagcaacgaagctggcgctatctggatatcatcaaccggatgattgaccgacctggagggcgctcgtatcgggttattttgctcggcctgtttgctactttattgcaggcaaaaggcacattgcgactggataaagacgcccgtccattgttgctgatcgaagatccagaaacccgtttacaccccattatgctttcagttgcctggcatctgttgaatcttctgccattgcagcgcattgccaccaccaactctggcgagctgctttcgttaacgccggtagagcatgtttgccgactggtacgtgagtcctcgcgcgttgccgcctggcgtctgggaccgagtggcttgagtaccgaagatagccgacgcatctcctttcacattcgttttaaccgtccgtcatcgctgtttgcccgctgttggctgctggtggaaggggaaacggaaacctgggttatcaatgaactggcgcgtcagtgcggacatcattttgatgccgaagggatcaaggtcattgagtttgcccagtccggactaaagccactggttaaatttgcccggcgaatggggattgaatggcatgtactggtcgatggcgatgaagcagggaagaaatatgccgctacggtacgcagcctgttgaataacgatcgggaagccgaacgagaacatttaacggcgttaccggcgctggatatggaacattttatgtatcgccagggattttccgatgtgttccaccgcgtggcgcaaatcccggaaaatataccgatgaatctgcgcaaagttatctcgaaagcgatccatcgctcttccaaacccgatcttgccattgaagtggcaatggaggccggacgtcgtggtgtggactccgtaccgacgctgctgaaaaaaatgttctcacgcgtgctgtggctggcgcgcggtcgggccgactaactacaaaacatcgtggccatttgtggctgaatagcgtcgagcatctcatagcgccgacggtattcagcccgttttttactggcgatttcggcaatctcttttcgtgctatctgtgctggaaggcggtaatggcgttcagcatcacatacgccgccaaccgattcccagaaagcgttgtaatcggcatggatcttgccctctttatcgcgataacgcaggctgcggtaaatatgcgtttcattgctgacggcaataatctgctctacctgcaaacgttgggcaaacagacaggccgcttccatcacgaggcgtttgggaaatagcccgtggcaggctttcgtcgcattctggatttcctggtgtggaatttcccattttgcgccttgcagtccgccaataaacatcgtccttttcccctgatattcacacagggtaaaagtgagctctgccagaggaataccttcgctgttgcggaacaggatggtgctgtcaccttctttatccattgagatcatcatggtcagctcaagcgtgaactgctcgccgtttttgccttccagcttcgccagttgcagcccgggggtattcaaatataagctgaattcttccgccgacatacacccgcggagtaacgcataatggtaacgtaacgcctccagcaattgcttacggctaagattcgccgcaaggtaagggcgatgtagacgtacaggcagtcgcggctggcgcgttaacaacacattgagattaggccagtgggaaagttcgttcatccactcaacgcttaaacgcggcataatcaacgagcgcagcaaannnnncattccattcattaattaattaatgaatgaatgnnnnncatatggagtattcagaatatttatgaaaaagcggaaaaccgtgaagaagcgttacgttattgcgatggtgatagtcatcgccgggctgattacgttatggagaattcttaacgcacccgtgccgacttatcagacgctgattgtgcgccccggtgatttacagcaaagcgtgctggcgaccggaaagctggacgcgctgcgtaaggttgacgtgggcgcgcaggtcagcggtcagttgaaaacgctgtcggtggcgattggcgataaagtaaaaaaagaccagcttttaggggttattgatcctgaacaggctgaaaaccagatcaaggaggtggaagcaatgctgatggagctacgcgcgcagcggcagcaggcggaagcggagctgaaactggcgcgggtgacgtattcccgtcagcaacgtcttgcacaaacgcaagcggtttcacagcaggatctcgataacgccgcgacggagatggctgtgaaacaggcgcaaattggcaccattgacgcgcaaatcaagcgcaatcaggcctctctcgatacggctaaaaccaatctcgattacacccgcatcgttgccccgatggccggggaagtcacgcaaatcaccactctgcaaggccagacggtgattgccgcacaacaagcaccgaacattctgacgctggcagatatgagcaccatgctggtaaaagcgcaggtttctgaagcggatgtaatccacctgaagccggggcaaaaagcctggtttacggtgcttggcgatccactgacgcgctacgaggggcaaatcaaggatgtgctaccgacgccggaaaagattaacgacgctattttctattacgcccgttttgaagtacccaaccccaatggtttactgcggctggatatgaccgcgcaagtgcatattcagctcaccgatgtgaaaaatgtgctgacgatccctctgtcggcgttaggcgatccggttggcgataatcgttataaagtcaaattgttgcgtaatggtgaaacacgcgagcgtgaagtgacgattggcgcacgtaacgataccgatgttgagattgtcaaagggctggaagcgggcgatgaagtggtgattggtgaggccaaaccaggagctgcgcaatgacacccttgctcgaattaaaggatattcgtcgcagctatcctgccggtgatgagcaggttgaggtgctgaagggcatcagcctcgatatttatgctggtgagatggtggcgattgtcggcgcttcgggttccggtaaatcgaccctgatgaatattctcggctgcctggataaggccaccagcggcacctatcgcgtagccggtcaggatgttgccacgctggacgccgatgcgctggcgcaactgcgccgcgagcatttcggctttattttccagcgttaccatttgctttcgcatttaaccgccgagcagaacgttgaagtacccgccgtctatgccggtcttgagcggaaacagcggctgcttcgcgcccaggagttactgcaacgactggggctggaagaccgtacagagtattacccggcacagctttcgggtggccagcaacagcgcgtcagcatcgcgcgggcattgatgaacggcggtcaggtaattcttgccgatgaaccgaccggcgcactggacagccattctggcgaagaggtgatggcgatcctgcatcagctgcgcgatcgcgggcatacggtgattatcgtcacccacgatccgcaggttgctgctcaggccgagcgggtgatcgaaattcgcgacggcgaaattgtgcgcaatcctcccgccgttgaaaaagtgaatgctactggcggaacggaacctgttgtcaacacggcgtctggctggcggcagtttgtcagcggttttaacgaggcgctgacgatggcatggcgggcgctggcagcgaataaaatgcgtactttactgaccatgctggggattattatcggtattgcgtcggtggtttccattgtcgtggtgggcgacgccgctaaacaaatggtgctggcggatattcgttctattggtacgaatactattgatgtctatcccgggaaagattttggcgatgacgatccgcaatatcagcaggcgctgaagtacgacgacttaatcgccatccaaaaacaaccgtgggttgcctctgccacgcccgccgtctcgcaaaacctgcgcctgcgttataacaatgttgatgtggctgccagtgccaatggcgtgagcggcgattattttaatgtctatggcatgaccttcagtgaagggaacacctttaatcaggagcagctgaacggtcgtgcgcaggtcgtggttctcgacagtaatactcgccgccagcttttcccccataaagcagatgtggttggcgaggtgattctggtcggcaatatgcccgccagagtcattggtgtggcggaagaaaaacagtcgatgtttggtagcagtaaagtgctgcgtgtctggctgccatacagcacgatgtccgggcgagttatggggcagtcgtggctgaactccattactgtcagggtgaaagaaggctttgacagcgctgaggcggaacagcaactcacgcgtttactttcactgcgccacggtaagaaggatttctttacctggaacatggatggcgtcttgaaaaccgttgaaaagaccacacgtactttacaactgtttctgacgctggtggcggtgatttcgctggtggtgggcggtattggtgtaatgaatattatgctggtgtcagtgaccgagcggacgcgggaaattggcattcgcatggctgtaggtgcgcgagcaagcgatgttttgcaacagtttttgatcgaagccgtactggtttgcctggttggtggcgcgttgggaataacactgtcactgttaattgctttcaccttgcagcttttcttacccggctgggagattggtttttcaccgttagcgctgctgctggcgtttctctgctcgacggtcaccgggattttatttggctggttacccgcacgaaatgcggcacgactggatccagtagatgctctggcacgagagtaatttttgagataaaaatgccagccgatcgggctggcattttgcctttaggatgtacacaatgagacagaagagctatgcgactgccgcttctacttcgacgggcacaataacactggcgtgattgccttttggcccctggtggacatcaaactgaacggattgtccagcttttagcgttctgtaaccatccatctgaatggtggaataatgagcgaaaatatcttcgccgccgccttcagggcagatgaaaccaaaccctttggcattgttgaaccacttaacagtacccttttccatgcttcgacatccttcgcaaatcttatacaagtaagatggaataaaccggggtcagagagggggctgttcaaaacctcgccaactctagaaatacaatttagagaattagggcgagccgtcaagcatttgacaggggccagggggcaggtatgaatcaaaaatttgaagcagttaacgctattgacaggaatgtgacagatgtcgctgatgctaacgatagatgatagttatttatcatctagtgttcgcgggtgttcgtggtagtgttttgtgtgcattcattgctatgattataaaggaaaattttgttttccttgttcgctcttgttcgtcacggtttgcccttgtacgatgcacggtgtagtcaatggtgtagttaattttgatgaccggaaacgcgaaacatgagcagcgcaattcatagacttagcgacactcttttacgaaaattaagcggatcaccaaccacaaaaaacgccttttttaatgacggtggcaatcttagcgtaagacattccaccagcggcctgttaacctggtatttcacttacagggccggaactggtaggcaggtatcaccggaacgtctgagactgggcaattatcccgatctgagcctgaaagcagccagggaaaaagcagcacagtgtcgcgcctggctggctgaggggaaaaatccgcgctatgagcttaatcgtgctgtacaggatgcgttagcccccgtgacagttaaggaagcgctcacttactggcttgaatcgtatgcaaaggaaaagcgcactgactacgaatcactgaaaagccggatcaataaacacataatcagccagattggcgctttgccgttggaaaaatgcgagctacggcactggttggcatgttttgaccagatggcaaagcgaagcccagtatctgccggatttttgctacaggtatgcaaacaggcgcttaagtactgccgaaaacgacgatacgcaatcagcaacgttcttgatgatatggttgtcggtgatgtgggaaaaaaagcagaagtgagcgagcgcgtactaacaaataaggagcttggggaattactccgcgccctggatgacaaaatattcccgccatactacagcgccctaattcgcctcctgattgtttttggatgccgtaccactgagctaaggcgctctgaggtgcaggagtgggattttaaagaaatgctctggacagtaccgaaggagcacagcaaaacgaaggtcgccatattcaggccaataccggaaagcattttgccgttcgtcacgcaactggtggagcagaacagacacacaggcttattgcttggtgaactgaaaggacaatcttcggtagcagagtacggaagaacagcgcacagacgaattaatcaagccccctggacgttacacgatatccggcacacatttacaaccatactgaacgatttaggcgtggatccgcatattgtcgagcagcttacagcccaccagatgccagggatgcaacgagtctataaccactcccgctaccttgatgcaaaacgtgatgctcttaatctatgggtagaccgtctcgagcttctccagaacaatgatgaaaaaatcgttgttatgaccccgcgaatttacccccaaaattcttgacaaattacggctgttttttctttaagagattacagccgtgaatagatcttagaatatcggggaatatctgcaaatatcttctctttatatgtgtcaactatcgaaaaaaattgaaatgtcttcttctgagttcttattctctgtttcttgattgttccaacacctgatgttttatctatttgtttttaatgaggtaattcaggtgtcatgccaaatgacgacattttttgttgcgtcgcttaaaaactcgtgacacgattttaaacactaacgagcttctacgaaccttagcgaacaaagcctttagcatggttgtgtttttaatttaataggtgaaaaagaatctaagtaatatccgatctcatatatctacagctaagagaaaagtttatatacgtaatttttatgtaggtttttgtatgcgtgaaataaatgaagatcgcgtaatccgtgaggatgaatgtcgtaagttaactggagtgtgtcgcactacacgctacgaactggagaaaaaagggagctttccgtctcgccgtaatcttggtgggcgttctgtaggttggctgctgtccgaggttatggaatgggttaaaagccgggatcgcattaattcaggtaaggcagcgtaaaggggagcatatgacatataaaacaaaggcgaccgggggcggtcgccaatggatacacactaaacttgaacgcatcaccaacaatgccacatttgcggctggtgggcaatgcaatcagtctggttcagttcgttgccatacctgcaatgagcgcttttccctgtactctttaaggaattgctcaagggcaaaagcacatggcgcgaatctttctgattcatgctctatctttctgcgccgtcttttccgtgccggtgataatgttttggtcaattctttatcggtcattgtgttgtcctgcatagcaatgcgccgtaataccttacaccacggcgctgatggtgattactctggttctttggccttgcgccgctggcgatattcaacttctcgttttaatgccgcagtaacaaattgccccgtactttcgccaggcatttttaccgcctcaacattgttcataacttcatgcggaacccttgccgcaacggtttgtgattttgcgtttactgcttttgtcgccatgtggtgtacccctcataaaaaacaaatgcagtatgcaggaaaaaaaataagtgttcaacacttgacgtgtttaacacctgggtttaaattggtgttcaacaccttgttggcgcaaggtgcagaaacgacgaaacccggcagtgcgctaacactaaccgggcttctaaccaccaacgatagcgaaagtatcgaggtagctatgagaaatcataccacacacccgcaagggcgggactcgcacaacctgaataaatacatctggcgttttatcaccctgagcactgcacaaccgcgcgtgattaccattgaggccaccagcgaacaggaagcgcgtcagcaatctcctgatggctgcgtgatggtattcgctgcccgtattcgccagggggtgagtcatgcataaaataccctttgatgttcttgttcattctgaaaacgcattaatccgcgcaaaggaaatggacgcattactacttaagttaattgatgtgccggaaagtggcgatgaatctgattcaatgatgttttctgccgtgcgtacgctattaacgcctgttattaatgaattaaatacagtgatggcaattcacgagaataataaagcgcagcacaccggagaataaaaaacatgaaaaataaaaattctggcgttactgccagcggccccgctcgtcctgaatttatgaacggcgatatttaccgcgataaatatggcggcatggtaacgattaaaggcgtggcagaacggcgcatcacctaccgtcgtgaaggctacgaatatgattgcgtgatgcctgtttatcagtttcggcgtgatttttctctggtacaggcagcgccccgcagtaaaccaaccagcagggagaaagcacgcgccaatattcaggaaataaaaaagatgcttaacgtattcaggggtaaaaaatgaaactggcaccgaacgtaaaaaaacagccacgcggaataaaacacaaagacacagaggtaattattttcgcgggtagtgatgcctggtcgcacgcgaaacaatggcaggagcaggatggccccgcatccggcgataatgtgccgcctgtgtggcttgggccaaatcagcttgccgaacttgatgcactgaaaattgttccggatgggaaaaagcgcgtaaggctgtaccaggccggagaactggatttggtggagaccaaaaagattggtcagaagctggcggcggcagatattcaggacgcaaatttttaccccgaaggaatgcacgtccagaagtgtgaaaactggcggcgctatctgaatgctgagcgtgaaaatattgccgcagggcttaccatgccggagcagaaaaatacgcaactggcacaaatggcagacagtgagcgtgcgcagctgcttgccgagcgctttgatggcgtttgtgtgcatcctgaaagtgaaatcgttcacgtatggcgcggcggggtatggtgtccggtcagcacaatggagctgagccgcgaaatggtggcgatctattcagagcacagggccactttcagcaagcgcgtaatcaataacgccgtggaagcgttaaaagttattgccgaaccaatgggcgagccgtccggcgatttgctgccgttcgccaatggtgcgcttgacctgaaaacgggggaattttccccgcacacgccggagaactggatcaccacgcacaacggcattgagtacacgccaccagcacccggggagaacatccgcgataacgcgccaaactttcataaatggcttgagcacgcagccggaaaagacccgcgcaagatgatgcgtatatgtgccgcgctgtacatgattatggcgaaccggtacgactggcagatgtttattgaggccaccggagacggcgggagcggtaaaagtacattcacacacatagccagccttctggcagggaaacaaaacacggtaagcgctgaaatgacatcgcttgatgatgctggtgggcgtgcgcaggttgtcgggagtcgtcttatcgtcctggcagaccagccgaaatatacaggcgaaggaacgggcatcaagaaaatcacgggcggcgaccccgtggaaattaacccgaaatatgaaaagcgttttacggcggtaatcagggcggtggtgctggcaaccaataacaatccgatgatattcaccgaacgggccggaggtgtggcacgtcgtcgggtgatattccggttcgataacatcgtaagcgaggcagaaaaagacagggagctaccggaaaagatcgcggctgaaatccctgtcattatccgccgcttgctggcgaactttgccgaccctgaaaaggcacgggctttactcattgaacagcgtgacggtgatgaagcactggcaataaagcaacagacggatccggttattgagttttgccagttcctgaattttctggaggaagcacgcggcctgatgatgggcggcggtggcgattcagtgaagtacacgaccagaaacagcctttaccgcgtctatctggcgtttatggcgtacgcaggcaggagcaaaccgctaaacgtaaatgactttggcaaggctatgaagccagccgcgaaagtttacggacatgaatatattacgcggaaagttaaaggagtaacgcagactaacgcaataacaacagacgattgcgacgcgtttttataatttgttgcaatggctgtctaccctgtctaccagagtaaagaaaaatacatttaattcagtacattaacttgggtagacagcctttttttactgtctacctactatctaccctctctacctgattttacctgaatcagacagggaggtagatacggggtagatagtggataaaagcactctaccccactgaaagccgcgccattactggcatggtggccagtaaggttgataaggtagacaaggggaggcacaactcaaaactttttaaacgagggggtaaaaataaaaatgcgcacatcaggaaaacttaataatcagaagaagcagcataaccgcgccattgaccttacagagcactggctgagagtggcgataaaaatcatcgaccgcaacacgggggaaggatacgcgaaagcacatcccgacctgataagcgcattcatgaccacagcggcggcaaactttgccacgctgacagaatgggagattgccgaagcggaacaggtaacaaccatcaacgttaaaaccggagaggtggaatcatgacagcacagatagccgcttacgggcggctggtggacgacccgcaggtaaaacagaccagcaagggcacaccgatgacgctggcgcgtatggcggtcccccttccgtgcagccaggcagatgacggaacggcgacgatgtggttatccgtcctggcatttggcagacaggccgaagcactggaaaggcaccgcaagggtgaactcctgagcgtggcgggtaacatgcagatcagccagtggactgggcagaacggagaaacgcggcagggctggcaggttatcgcagacagtgtaatcagtgcgcgaacggcgcgactgggcggcaaaaaaggtcaacagggccaggctactgacgcgctgaacagggcaaaacaacaggcggggaatgatgatccgtacggggataacataccgttttaagcgacgagtgacagaagccggagcaatccggcttttttacgggtcctcctggcggggtgggcctgaacacggggcgggaggcgcggaaaaaagcgcatttttgtgattttatcgtcatcatcatcatgagcgtaatttattgtttttaattgttttgatgcaaaaaagatgatggttgtggttaatttttgttcgacatctttgcaggcagataaaaaagcccgataaggtcagaggtggcttatcgggcttttgcatatgaggctttttggtgcactgacacacatgatcgggatcatcatttcataatttgcaacacaactcaatatcattgcacaaaatgcaatcctgattataatcagagctggatgaacatccagttatgattttttaagtcgaagaggaatttcttactatggctgaagagaaaaaaggtggtgtttcggtgtacataagccccgaaatcgtggaggtgctcaagcagcgccacaaaaaaaactatgaggctggcgtagcggctggactggatccgctgatgacgccggagccgtcgataggttcacttgtacgctcttatttacttgcggcgcttgggatgcataaaaattatgggggtgaataatggcaggcaaagcaacggcacttaacactaaccagcttttcatgtacctgaatcgcggggatattgcggattttaaattcagccctctgtttactacgctgtttttcccgaacgtggcgacattcaacacgcaaaacatcatgctggataccctggacattgaagaagtcaccatgtcggcgttttgttcgcctatggtgggtagccaggttcagcgcgataaagggtacgaaaccagcacaatcaaacctggctacatgaagccaaagcacgaaatcgatccaacaaaaaccatcatgcgcatggctggagaagatccagcacagcttaacgaccctacctaccgccgtatgcgcctgattactggcaacatgcgccgccagataaacgccattaaagcgcgcgtggaatggctggcggtgaatgcgataacgaccggaaaaaacatcattgagggcgaaggcatagaacgctatgaaatagactggaagatcccaagtaaaaacatcgccagacagggaccgggtaaaaagtggtcagaggcagataaggaaacacacgatccaatctatgacatcgagctttatgctgatcaggctggttgccccgcaaacgtcatgattatgggcgctgaggtatggcgcacgttacgcagctttaaaaaattccgtgagctgtacgatctttcccgtggttcagagtccgccgtagagctggcctgtaaaaacctgggcgaagtggtgagctttaaaggctatctgggcgatattgcccttatcgtctattccggcaaatacgccgacagcgacggcacagaaaaatatttccttgagcctgatttgcttgtcctgggcaacaccaacaataaagggctggtggcctatggtgcgattatggatcaggacgcagtaagaacgggcgcaacgcaaaacatgttttacccgaaaaactggattgaggacggcgatccggcgattgagtacgtgcagacgcacagcgcaccgcagccggttccggcagatattcgcaaatttgttaccgtcaaaattgcttaacgggggattctatggacactccatacattgagttatttgcaggcagtcagcaggtcgccacgacgctggtacattttgccgctgatgctggcgttattcaggaatttaccccgctgatgctggcggacaatggcgagtttaagccgtgggatggtcaggaatctggcaaggctgtttatctgacttcgtatcctgtggacacgtcaaagcagaaatcagcacagtgttacaagacggggatattcaatattgccgccgttaactggcctgagagcgtcgacaccgatgcgaaaaaatgcgccgcctttgcgggttctggcgtatccgttcagccgctggcccgataagcagggggaacgatggcaacgaatgaaagcatcatgacgctaccgctggcgagtaaatttaaagccgaagcgcgggcaatggctgacagagggttatcaacctacgaggccatatatcaacttaacaaactggaagagcaggacaagccgcgcgctgatgcgattatggcgcttgatgaatctggcgactatcagccgctgttacgtgcaatggcaaacgtgccttgtatcgatgttggtacggctaaaagcatccttagcatgaccatagagcaggaacgtccgaaggttgcgccggaacttaccgcagcctttgaaaactttatggacatgcacagcccgcaagccgtatcagctggcatggcatacgatggcagaaaccagggcgatgacggcgacatcgatcgcatactgaaaaccatctgagacaaggccggagaaatccggcttttttttatgggtcctttccggcatatggacccgttacggggcggcgacctcgcggtttttcgctatttatgagccttttcaggggggtggtggtggttttgttgtttgctctatctttatgaatgaaaagggaaagatgcaaacaatacaccaacctgaagcagtaattaagttggtgtattaatgaaatcgcacctgatgaacaaaaaaaacatggcgaaaagctgccgtgtaagtgcgacagcgttcgacaagtggggagtgactcccgttgaacgtaaaggccgtgaggcgttttacgatgttgccagcgtgatagacaatagggttaacaatgcaattagccagcttacaaacgacaaaggcgatattgatgatgatgaactcttacgagtcaggatcagattactgacagcacaggcggaggcgcaggaacttaaaaacgagcgcgatcgcggtgacgtgattgatactgagttttgcctgtacgcgctttcaaagctggcgagtcagatttcatcaatcatggacagcctcccgcttactatgcaaaggagcttcccacagattacccccgccatgctggataggcttaaaagggaagtggttaaagcctgtaatgccagtgccagagttgccgacaacctcccacagatactggctgattacttgaaagaaacaaccggaaacgtaccggaaaagttgctacagaagaaaggcgagtaacagacgcgcaattattgaacaaaactgagaaacgacatgaaagcgtcataaatcgccattttagatgattaccgtgtcgtttctttttattgtgtatctatttaaaaacaaatagttatgttcgagaagtaccgacatgctttttccagaaaaattttcataaacagataaaaaccgcgaggtcgccgccccgtaacgggtccataattccaggaaggacccgacgacaccagacaatcagaacgatgggtgcacaatgacagaagccgaaatactgggattaatccgccgtgctggtggaatcagccagcagactgacgaacaggccacgcagccggacagcgtgacagccgaaaattatgcgcgtgttgttgctgaggtgatgcgccgtgatggtatccagcttaatgatgtggatatgcgcaacatacggatccgcgttcttgaaatgctggcctacaatcgccgcgtggcactgtatcgggaaacggagaaaattacgtaccactggaagaagccggagcggttgcggcggtaactggttgatattttcgaaattcgccagcggcgaacatcggggaaaccagcctaacccgttgatattttcgggaacctcaaattgaggaggtcggaaacataacccgtcatattctggatgctgataattaccacgcagcccattaaggcctaacccgttgattctttcggaaacagccattggcgtaatccggcgcggtaacttgctgaacttaaagaaaagcgcaaaattgcgctggctggtgggcatgatgccgatatggtgatccccataacggaaatatccaccagcacggcaacggcagaatagccacaacacagaaaaaccacgaatatggggtttttgttatggcatgggcatgatgaccgcccctgctctgaatggtggaaatcaccacgcagatcatccactagcttcatgacggatagccggaaaatgataatgattaaagcgtgttgatctttgttcgcggttgttcgatattgttcgtgaagcggtgtagttaatggtgtagttaatatcactgtttttgacaggcttgttatttgcaacataatgaaaaataaagactaattaactaaatgatataaatgatagttatctatcatgtggagtaaattggtcaggcaaataagctcttgtcagcggcagggcgttctgccgataaccgtaaccgaagatgataactgacaatgggtaaaacgaacgactggctggactttgatcaactggcggaagaaaaagttcgcgacgcgctaaaaccgccatctatgtataaagtgatattagtcaatgatgattatactccgatggagtttgttattgacgtgttacaaaaattcttttcttatgatgtagaacgtgcaacgcaattgatgctcgctgttcactaccaggggaaggccatttgcggagtctttaccgctgaggttgcagaaaccaaagtggcgatggtgaacaagtacgcgagggagaatgagcatccattgctgtgtacgctagaaaaagcctgaatgcaggcataaaaattgggggaggtgcctatgctcaatcaagaactggaactcagtttaaatatggctttcgccagagcgcgcgagcaccgtcatgagtttatgaccgtcgagcacttgttactggcgctgctcagtaacccatctgcccgggaggcgctggaagcgtgttctgtggatttggttgcgctccgtcaggaactggaagcctttattgaacaaaccacacccgttctgcctgccagtgaagaggagcgcgacacacagccgacgctgagttttcagcgtgtactgcaacgtgcggtcttccatgtccagtcctccggtcgcaatgaggttaccggtgcaaacgttctggtcgctatctttagcgaacaggagtcgcaggcggcatatctgttgcgcaaacatgaagtcagccgtcttgatgtggtgaactttatctctcatggcacgcgtaaagagtaaagacgagccgacacagtcttctgatcctggcagccagccaaacagcgaagaacaagctggtggggaggaacgtatggagaatttcacgacgaacctgaatcagcttgcgcgagtgggcggaatcgacccactgattggtcgtgagaaggagctggagcgtgctattcaggttctctgccgtcgccgtaaaaacaacccgctgctggtgggggagtctggtgtcggtaaaaccgcgattgcggaggggcttgcatggcgaattgttcagggcgatgtgccggaagtgatggctgactgtacgatttactctctcgatatcggttctctgttagcgggcacaaaatatcgcggcgactttgaaaaacgttttaaagcgttgctcaagcagctggagcaagacactaatagcatcctgtttattgatgagatccacaccattatcggtgcgggtgcagcgtctggtggccaggtcgatgcggctaacctgatcaaaccgttgctctccagcggtaaaatccgcgtaattggttcgacaacctatcaggagttcagcaacatttttgagaaagaccgtgctctggcgcgtcgcttccagaaaattgatattactgaaccgtcaatcgaagaaactgttcaaatcatcaatggcctgaaaccgaagtatgaagcgcaccacgacgtgcgttataccgcaaaagcggtgcgtgcggcggtagagctggcggtgaaatacattaacgatcgtcatctgccggataaagcgattgatgttatcgacgaagcgggcgctcgcgcacgtctgatgccggtaagcaaacgcaagaaaaccgttaatgtggcggatattgaatccgtggtggcccgtattgcacgcattccagagaagagtgtttctcagagtgaccgcgataccctgaaaaacctcggcgatcgcctgaaaatgctggtcttcggtcaggataaagccattgaggcgctgactgaagccattaagatggcgcgtgcaggtttaggtcacgaacataaaccggtcggttcgttcctgtttgccggccctactggggtcgggaaaacagaggtgacggtacagctttcgaaagcgttgggcattgagcttctgcgctttgatatgtccgagtatatggaacgccataccgtcagccgtctgattggtgcgcctccgggatacgttggttttgatcagggcggtttgctgactgatgcggtcatcaagcatccacatgcggtgctgctgctggacgaaatcgagaaagcgcacccggacgtgttcaacatcctcttgcaggtgatggacaacggtacactgaccgataacaacggacgcaaagcggacttccgtaacgtggtgctggtgatgaccactaacgcgggggtacgtgaaaccgagcgcaaatccattggtcttatccaccaggataacagcaccgatgcgatggaagagatcaagaagatctttacaccggaattccgtaaccgtctcgacaacattatctggttcgatcatctgtcaaccgacgtgatccatcaggtggtggataaattcatcgtcgagttgcaggttcagttggatcagaaaggtgtttctctggaagtgagccaggaagcgcgtaactggctggccgagaaaggttacgaccgggcaatgggcgcacgtccgatggcgcgtgtcatccaggacaacctgaaaaaaccgctcgccaacgaactgctgtttggttcgctggtggacggcggtcaggtcaccgtcgcgctggataaagagaaaaatgagctgacttacggattccagagtgcacaaaagcacaaggcggaagcagcgcattaatctgattgtcaggtaggttggttaagtccgtgatctcgtcaggggttacggactttttatttatggggggaggaggttcagaccctttttttaatgatgatgctaagttattgataattagtgctgcgggtaggtaaggataaaaaagggtggcagcaggagattgagatggttttgctttattaacaacgggctaaacgtgtagtatttgagttcactgccgtacaggcagcttagaaatgacgccatatgcagatcattgaggcgaaaccgttcactgccgtacaggcagcttagaaaacgttcgcaccggtcagggtactgcgcagcgtgttcactgccgtacaggcagcttagaaagaaaccagagcgcccgcataaaacaggcacaagttcactgccgtacaggcagcttagaaagccagcataaaaccgcctttgatattttattggttcactgccgtacaggcagcttagaaatcagccggaggctctcaatttcagccgcgcgggttcactgccgtacaggcagcttagaaaagcacggctgcggggaatggctcaatctctgcgttcactgccgtacaggcagcttagaaatgatggcgcagcagtcctccctcctgccgccagttcactgccgtacaggcagcttagaaactgaacgttgaagagtgcgaccgtctctccttgttcactgccgtacaggcagtattcacactacgatagtgttagacgtttggtcgtgcaatgacactctcaacttcaaaccattagcgttagcacgcaataacaatcgtaataattgcgatggaaatcaattttcagcacataaatcaatgctgtactaagcccaataccttcaaatataaaataatcacaggatgtgtttatgtcttcgaattaccttacgccttccgatctcaaaaccattctccactccaaacgcgccaatatttattatctggaaaaatgccgggtacaggtgaatggtgggcgggtggagtatgttaccagcgaaggtaaagagtcgtactactggaatatccccattgcgaataccacggcgttgatgctgggaatgggaacttccgttacccaggcggcgatgcgtgaatttgctcatgccggggtgatggtaggcttttgtggtacggatggcacgccgctgtattcagcaaatgaagtggatgttgatgtctcctggctcagcccacaaagtgaatatcgccctacagagtatctccagcagtgggtttctttctggtttgttgaagacaaacgacttgctgccgcgaaacgttttcagttaatccgcctgacacatatcgataagcactggtccagctcgaaaatgctgcgtgaacacgcatttcaacctgatgttaatgcgctgcataccctcctgaatcgtacttgtgaagaaatagacgcggcagaaaaccatacgcagcttatgctcgttgaggccaaattgactaaagcgttatacaaaatggtcagtcaaaccgtggggtatggcgatttcactcgcgcaaaacggggcggtggtatcgatatggccaaccgcttcctcgatcaagggaattatctggcttatggactggcagcagtggcggcgtgggtaacaggtatcccgcacggtttagctgtaatgcatggtaagacacgtcgcggcgggcttgtttttgaccttgccgatctgattaaagatgctcttgttatgccgcaagcatttattgccgcaatggcgggagaagatgctcaggagtttcgtcaacgctgtgttaatatctttcaacaagcggatgcgctggatgtcatgatcacctctctgcaggaaacggcccaggcactggctaaggctgaccaatgaatgtcctaattatctcacgctgtacgaaaaatgctcgcgtggaaagctgccgtattattgatcagtttgccgaacgcactggtgacgcagcatggcaaacggtgattactctggaaggcgttaatacactccgccgtttactgcgcaaaaccgccaggcgaaataccgcagtggcttgtcactggctgaagaagaatgggcaaacggagctgatgtggattgtcggcaatattcgtcgctttaatgctcaaggccgcgttcccacaaatcgaacaacgcaaatcagcctggtgaacaaagaagaaaatcgctggcagtgcgcggaaagtattgcactgctggcggctatcgctgggctatttcatgattttggtaaatcaggacgcagctttcagcaaagcctgactcaaaagaatacccgcagttatcaaccttaccgacatgaatggatttcactgcggctctttcagacgtttgtcggtgagcggcccgacgatgtgtggctggcgaagcttggcgaactcacggcagatgatgaatctgcgattcttgagcgcctgcaaaaagacactcctcaattttcaaatagcccgttcagttcgctgcaaccattagccaaaacggtaggctggctgatcctttcccatcatcgaatgccggagaatctttctccacagtcggaacaatcatgtaaagggtgtgaaagttggctggagaagcaacttaatgctgactggaatgccgttaaccaccgcagagatgactggtcacaacaggattttgcgcacgtctggcagtttccatcaggaacgccgcttcaaagcgcgagctggcgggaaaaagcgcgtcagatagcccgccgggcaagcaacgcgctcggtttaaagacatatgggcagatggaacagttgttccccttacatatggcgcgtttttgtctgatgcttgccgatcattactattcctcaagcgatgcgcagcaaaaatggcaggacccggattatatcgtctgggcaaatagcgatcgccaaagcggcacgctcaaacaacgggtagacgaacaccttgtgggcgtcgcgcatcatgcgtatctgcttgggcggcaactgatgcacacacgggcatcgcttccggcaattgcccgacataaaggttttagccagcgggctacagatgtgaattatcgctggcaagataaagcctgggatgtggcgcgagcgttacgtgaacgaagtcgtgaagagggatttttcggcgtcaatatggcctcgacggggtgtggtaaaacctttgcgaacgcccgcattatgtatgcacttgccgacgagcgagaagggtgccgctttaccgttgcgctgggattgcgcacgctgactttacaaaccggcgatgctctgcgcagtcggcttgggctgggtgaggatgagctggcggtactgattggttcggcggcagttaatcaactgtggcaacaggaaaaaatagacaatgattgcggaagtgcttcgcaagagtcgccggcagaggagcaacagttcgttaagtacgaaggcagcctgcataccggggcgctggaaaaatggttgaaggatgacagcaaacttaaggagttagtaagcgcgccgattctggtctcgacgattgatcatcttatttccgcgaccgagggcgtgcgaggcgggaaacagcttccggcgatgttgcgcctgttaaccagcgatttagtgctcgacgaacctgatgactttgatattgctgatcttcatgcggtatgtcgattgatgaactgggccgggatgctgggaacgcgggtattactttcttccgcgacgttaccgccaggtttgattcaggcgctgttcgcggcttatcttgctgggcgaaaaatgtggcaggcgtcttgtggtatcaacggcaggcctgtcaatatatgctgcgcctggtttgatgaaaaagatgctgatgccacgcaaatttacgacggacctgggtttcgtgatgctcatgccaaatttgttgcacgacgagcggtaatgctggctgaaaaagaacgactgcatttcgggcgtgtagcttcggtttcatcagcatcaggcgcgatacaagatgttaccgaaagtgtggcccagacggtgcatacgcaaatgctgaagttgcatcaggcgcatcgccagcgacacgaaagcggtaaaaccgtttcgctgggcctggtgcgcttcgcgaatatcaatccactggttgcggtgaccaaagccctgattgccattccttcaccagaagatgtctgcattcattactgtgtttaccactcccgacatccgctggcggtgcgttcagatattgagaagcgactggatcgcgcttttactcgtcataacgaactcgatttctggaacaacgaagatatcgcagatgccttacataaccgtccggaatcgcaccatctgtttgtggtgttggggacatcggttatagaagtggggcgtgactgggatgcggactggggaattatcgaaccaagctccatgcgttcgataattcaatttgccggacgtattcagcgccaccgtagaaatgtgccgaccagtgagaatctggttattttgcgtagcaatatcaaatcattgcagaaaaaagcccccgcattttgtaagcctggtttcgaaacaaaagaacacttgctgaatagccacgatatttgcgaactgattccgatcgcggactaccggacgattaacgccttgccgcggatcctgtctgccaataatgccaacaaactggcggagctagaacatagtcgtttatccgccgaattgatgagcagtaaaagcaaacatgtggtggcggcgcaatggtggcgtgcaccgctaagctggaacggctggatgcagcgccagacgccatttcgttattcccctttgccggaggcggtgttttttctgcatatggatgatgaagaaagcgaagcgcgtttctattcccgcacgggcgacaacgagcgtaaagcgcaagggaatttcaggcgagaagaggtgagatgcgccagcggcgtcgcttgctggggcgtgatggattaccaacacgttttgttgaatttagctgataagcaaagttgtgagatagcaaacgttggggaaaagtttgcggaggtgagagtacccgtcagtgaagaagatgcggtcgatgactggcgttatcacccctggttaggtgtgtttcgcaacatgtgatggggcgcgagctgcctgtacggcagtttacaagtccgtatccggagatacctctatttctaagctgctcaaggcagtttgggtatgttagtgcttcaactattgcgtggcaaatattaagttgctttaatatcacatatggtgattacatgagatttaataatatcttttagaagatatctctaggagagtttgtttgtgtgatcaccactggtgttgtcccttttgctgtgtatgtcagttgtactgaagccatgttgggctacggagatttttcagtgaaatcagggagcaacttcgacttgatggattaacgaaaaggagccgatatggaaaaaacggcgctaatacaatttattactgaatacatcgcttcgcgaaggcaacccaaaatcgatgcctttgaaaaagaagccgcaaagcgagtggaacagggcgaggacgccagcgttatcgctcaggagcggcaggaactcgaagcacgctacttgccacgtaactggttaacggatgcggcaaagcgtgccgggcaaatcaaattagtcactcatggcgctaaattcagtcatggtgattctaaagccagtagcttttatctggaaacctccgctaacgaaagctatttaaacacagcatcgttggcgaatgtcgctactgacgcgattggtaacgccgctgcacttgacgtagcaaagttgctacaaaccgatgtgaacggagattcactgcttgccagcctgaagcgtggtgattatcaggcattaagtacgtttgcagaggataaagtgcaactggagctgtgggtagctgggtttagccaggcatggactactggacggccttccagccataaactggcgaaacaaatctatttccctgttgcggatggttatcacctgttatgcccactgttttccagttcactggcgcaggcgatgtatgaaaagctaaccgccgtgcgctttagtgaggagtcgaaagccattcgcgatgcccgcaaagcaggaaaatggcactcccagccagatatctggtttcctaatcttgccgaaatgcattttggcggcacaaaaccgcagaatatttctttgctcaatagtgtgcggggtggccgtgtctggctgttgccgtcaatgccgcccacctgggcgacgctggatcgcgcgccacaaaacatgcgcagtattttttccctacgcggcgatttcaatcgggcggcttcaggcattgtcgcccagatgacctacttactgaaggttgacataaataatgtccatatccgaactgtgcgggcgaaatatattgatgagttgatcgatttgctgttcatgcaggcatccgcttttcagcaagaaaaatggcagggatggtccgcacaatcaccagacttacctcgccaccaacaactttggctggacccgtggcgaagcctctcagatgagactttcaaacaggagcgtgagaaaaacgactggcaagtaactgtcgccgatgatttcgcacgctggctgaactatcgcctgaaaaaatccagttttgacgtaggcgctgtcgaacaaaaagagtggcgcagccagtctctgttcgctcaacggatgcgtgaaatggaagctgttttgcaggaggcgctgaaatgagttatctgctcttgttaccccatatacgcatcgaaaacgctaacgctgtctccgggttgacctggggattcccgtcgatgacccattttctcggttatgtccatgcgctttctcgcaaagtcgtggatgaatttggcgtaagttttgatggttgtgcggtagtaagccatgaacagcatattcaggcgtacagctctgggcgcgatttttagttcgctctcacccgtaacccattaaccagagaaggtaaaaccgcctcgttcaatgaagagggccgcatgcacttgacggtttctctactgattgaatgtaatggcgaaatcaccaatggtgaatatggcagaaaagttctttgtgactatctgaaaatgctttgccagagccacaaactggcgggcggcagcattgtcagtatgcgcgatccgcagctttttcatgcgcctgaagatgaaaagcaactgcgtaaaatcgtctggcggttaatgccgggttatgcgctttacgatcgcagtgaatggctggctgaacatcaccaacaacatcccgacatctcgttgctggatgcctggcttgatttcgccgcgattaaatatcaggccgaatctccggctgaagacaacagcgcaaaatgggtataccagccgaagccaatacctggtttcctggtaccgttaatgtgtggctaccaacgcatttctcctgtttacgcacccggtgaagttgaaaatgcgcgcgacaccgtgacgccatttgcctttgccgaagcggtatatggcattggcgaatggcgcggattacatcgcactacagacttgcaagcgctgatgtggcgttaccgcacaacggacactggctactattgttcggcaacgccagttgttgatgattttacctttaatgaatatgacgatttagaataaggacataattatggcaaaggctcctgtagcaataaaaacggcgtcggtactggcatttgagcgcaaactggcaacctctgacgcggtaatgtacgcaggtaactggcaaggaaatgaatggcaacccattgagattcaggagaaagcggtccgcggaaccatctctaatcgcctgaaaaatgccattgtcagcgatcccacaaaactggatgctgaaatccaaaaagccaacctgcaacgggtggatgtggcttcgcttccggtagatacggatacgttaaaggtggtgtttacgctgcgtgtgctgggtaatttatccacaccgtcagtatgtaatgatatggcttaccaggaggcgctttccggggtcattgaaggttacatcagcgaacatggctttaaagagctggcgcttcgctatgcgctgaatctggcaaatggtcgttttctgtggcgcaaccgcattggtgccgaacagatccaggtgaaagtgactgctaacgagacgtcatggacttttaacagccatgacttctctttacgtcaatttgaccagggacaggcagcggtcacgcagctggcggccattatagagcaaggattaagcgcaaaagagtgggtgatgcttaccgttgaagcgcaggttcgtcttggtgccgggcaagaagtttttccgtcgcaggagctggtactcgacagcaacagtagtaaaagtcgcgtgttataccaggtggctggcattgccggtattcactctcagaagattggcaatgctttacgtaccattgatacctggcatccaaaggttgatgaattgggggctatagccgtggaaccttacggttctgtaaccagtcgcggtgtggcctgccgtcaaccgaaagaaaaactcgacttttataccttactggacaattgggtgactaaagggatgaaaccagacgttgagcagcagcactacgtgatggctgtgctgatccgtggcggtgtctttggtgagaaatcggaataaggagctgccaatggatcactaccttgagatccgcgttctgccagatcctgaattttcgagcgaaatgttgatggcggcgttatttgcaaaactgcatcgggtattaggtgcaagagggcaaggcgatatcggcgtgagtttccctgacgtaaatgttatgcctggagcgcgtttacgcttgcatggtagcgcccaggcattgcaggcgcttgaagcctcaacgtggcgtaaaggactaacggactattgccaatgttcacctgtcactcccgttccagaaataaaaggctggcgagtagtaagccgcgtgcaggttaaaagtaaccctcagcgtctgttaaggcgttcagtgaaaaaaggctggctaactgaagaacaggcaattgaacgactggcgacgcaggctgaacagcggactgatttaccttttctcaatatgaagagtttgtcgagtcagcaactgttcaagttgtttatccgtcatggtgatttgctcaaagaaccggttaaaggggaatttagtagttatggattaagcgcaaccgccactattccctggttttgatgctttgcaatttttaacaggcctggccatgtggttgggcctttttatgcgcgccatgcccaccgcatacaaaaaaagcccgtactttcgtacgagctcttctttaaagatggcggtgaggcggggattcgaaccccggatacgttgccgtatacacactttccaggcgtgctccttcagccactcggacacctcaccaaattgttttgctgccagacctcataggtggcaacggggcgctactatagggagttggagtgaaacggtcaagaagaatttatatagattgatttgtttggttacgcaatgaacacgctgttcgcgggacggagattatgaccgtatgtgttctggtcaattgtttatcaaaagctatgcagaaaatatgagattgaagaaataccaaaccgaccctttttctaggttgtaatgtaactcattgattttcttattgctattttgaagtctggaaaaagggtttgaatctgcgattttgtaagttttaacagtaaatcaatcggatagtctgctattattccagttcactgccgtacaggcagcttagaaatggattccaaaccgcccaccaacaaaaacaggtgttcactgccgtacaggcagcttagaaagatacgatcgaatttagtcactgaatacccccgttcactgccgtacaggcagcttagaaagggttgcgcaatgggctggccgacgaacgcgggttcactgccgtacaggcagcttagaaatgtggcgctgatgcgtctgggcgtctttgtacgttcactgccgtacaggcagcttagaaagcgcgcagtgcctgataatcaattttgctcatgttcactgccgtacaggcagcttagaaagaatattttggaaaaatagctatcaatccggggttcactgccgtacaggcagtcttcaaactcaacactccatcctctaatatttattccccataactcatagacgcaaaaaaggccggttaaaccgaccttttactcattctttctcttcgcccatcaggcggtaaaacaatcagcgactacggaagacaatgcggcctttgctcaggtcgtacggggtcagttcaacagtcactttgtcgcccgtcaggatgcggatgtagtttttgcgcattttaccggagatgtgtgcagtaaccacgtgaccgttttctaactctacgcggaacatggtattaggcaacgtttcaagaacggtaccttgcatttcaatattgtcttctttggccatctaatcctctggggtatcactaccgtaatttgaaccggcaagataatgccgaagttctgtaaataagtaaagatttgcgcgctaaatcgcaacaaacaggttcggcacattactccgaaaacacacggctaagccgcaccaaaagcgcaacgtataagggagcggtgagataaacgatgggcgttacctgacgcgaaaaattccttatcggcagcggggtaatgagcgtaaccaactctgcgaccgcaattataacactctggggagaaatgtgccgaaaacattcattcttgtggtgaaaacaagcatcgaggtacccagaaattattcggcaatcgtccgaggcgcatttgattgagataattaaggtaatcccggcggggaatttcgcaggcaccaagcgatgctgtgtgatcgttaaggacctggcagtcgataagtttaccgccatgacggataaattcatcacagaagaccagaagcgccgttttggacgcattttccatccggctgaacatggactcgccacaaaatagtgttccctgggccacgccgtacataccgccgacaagctcatcttcacgccagacttcaatggagtgggcatgaccgagttcgtgaaggcgatggtaggcttcgaccacgccacgcgtgatccaggttccttcttcgcgatcgctggcacagccttcgatgacctgaccaaaagcgtaattcatcgtgacacgatagggtgagcgtttatgaaatcgcttcatactacggctgatatgcagtgattctggccataacaccgcgcggggatcgggcgaccaccagaggatggggtcgccaggagaaaaccacgggaaaataccacgctgataagccattaataggcgcgcagggctaagatcgccccccagtgccagcaggccgttaggctcacgtaatgcgccttccggggaagggaaggctattgaatggcgagaaagctgaaccaggcgcatgaccgcaaaactccacgcaagtcggatcgttcaataatagcttacaaaccctgcttaaactggtaataacgcccctgtctggcaagcagttctgcgtgagtaccttgctcaataatttgcccgttgtccatcactattatttgttggaaacgagagagtccgcgaagtcgatgggtgaccattaacaccgttttctcgcacatcatttctgcaagcaattcaaggatctgactttcggttgtggcatctaagccttctgtaggttcatccagcaataccagcggcgcatcatgtaacagcgcacgggcgatagccagacggcgcagttcaccaccggagagctggcgtccgccttcacctaaccaactgttgagacctgcatcctcgagcagcttctccagaccaacgcgacgcaagatctccgccagagcctcatcactactaccaggcgaggcgagtaacagattatcacgcagcgtggcgctaaacagatgcactcgctggggaacaacgctgatggtctgtcgtagagccgcttcattcaggctggctatgggactatcgttaagcaaaatctcgccctgttgcgggtcccatgcgcgggtcagcagttgtaacagtgttgatttgccgcatccggttcgcccgagaatcgcaatatgttccccggcgtttacctgaagataaatccctttaagtgcctgttgggattgctccggataagtgaactgaacatcccgtaatgtcagcgaaacgcgatcggcaacacgagtttgggtatcagggaaggtgacttccggtttttgatccgttaaatcagtgatccgtacggcagaggcaatgacttgccccagatgctgaaatgcacccgttactggtgccagcgcttcaaacgcggctaacgcgcagaagacaaacagggcaattaacgcgccgggttgagcattgccgccaacgccaccggacgccatccacagcatcaggatcaccgctaacgcgccaatgagcagcattatcgcttgcgacaatgcggtcagttcagattgacggcgttgcgcttccagccactgaatttctgtattctctaattgcgtgcgataacgatcgctggcaccaaaaatggtcagctcagcttgcccttgcagccaggccgtcagttgttggcgatactgcccgcgaagatgagtcagattttgcccggtgctttttcccgcacgataaaacagtggtggcatcaggaaaagcgtcagtaacataatgccgcccagcgtaaaggcgagggtgaaatcaaggaaacttaacccgattgtcaccaccataatcaccacaaaagcacctaccagcggcgagataacgcgcaggtaaagatgatcgagcgtatcaacatccgccaccacgcggttgagtaattcaccctgacgatagcgcgccagtccggcaggggagaggggcagcaatttgctgaaggtgtatatgcgcagatgctgcaacacgcggaaagtcgcgtcgtgacttaccagacgttcaaaataacgcccggcagtacgggtgattgctgcgccacgcacgcccgcagcgggtagcatatagttgaagctgtacagtccggcaacccccgctaccgctgaggcggagaggaaccagccggaaagggtcaacagaccgatactggcgagcagcgtgacaattgccagcacgataccaagacttaacatccatttatgacgtttatacagtgccagatagggtagcaaagcgcgcatttaaatctcctcctgacgatgggccagtaatgtggcgaatgggccgccagccacacttaattccgcgtaacgtccttgctcaataatctgaccatcctgcattacccaaatgacatcccagtcagcaagatcttctaactggtgggtgaccattaacgttgtctggcgcagagaggcggtattcagcgcctccattacgcgctgttcactgtgagcatcaaggctggcagcgggttcatccaacagtaatagcgaacagggatttagtaacgcacgggccaccgccacgcgctgcgcctgccccacggaaaggcgggcagcctggtcaccaacaggcgaatcaatgccttgcggcaggagcggtagaaactcactgacccaggcgttatccagcgctgtttgtaactcttgttcgctggcatcaggtcgcgccagtagtacgttatcccgtaatgttgctgccggtaattgtgggttttgcccaacccaggagagatgtttacgccatgattccggtgataaatcgcgtaattctatcccgttgattcgtagcgatccctgatatgagagaaaaccagaaagcgcgttcaacagtgaacttttacctgaaccgctgcgaccaaccaacactgctcgttggcctgctggcaaagtaaaattcagcggtccggccagcgttttaccttccggcgacgtgataaacagatcctcggcttcaatggtcaccggatcggtcgatgcnnnnncattccattcattaattaattaatgaatgaatgnnnnnttcatacatgaaaacattgtctcagaacaccacctcttcggcctgtgcaccggagactggcctgcaacaactggttgccaccatagtccctgatgaacagcgcatcagcttctggccgcagcattttggcctcattccacagtgggtgaccctggagccccgtgtcttcggctggatggaccgtctgtgcgaaaactactgcggtggtatctggaatctgtacaccctgaacaacggcggggcatttatggcccctgaaccggatgactatgatgacgaaacatgggtactgttcaatgccatgaacggtaaccgcgctgaaatgagcccggaagccgccggcattgccgcctgtctgatgatgtacagtcatcacgcctgccgtacggagtgttatgccatgacggttcattattaccgtctgcgggattacgccctgcagcatccggaatgcagcgccattatgcgcattattgactgaaagggggcaggaacaatgcaacagctttcctttctgcccggagagatgacgcccggcgagcgcagtctcattctgcgggccctgaaaaccctggaccgccatcttcatgaacccggcgtggccttcacctccacccgtgcggcacgggaatggctgattctgaacatggcgggactggagcgtgaagagttccgggtgctgtatctgaataaccagaatcagctgattgccggtgaaaccctcttcaccggcaccatcaaccgcacggaagtccatccccgggaagtgattaaacgcgccctgtatcacaatgccgcagccgtggtgctggcacacaatcacccgtccggtgaagtcacccccagtaaggcagaccgccttatcacggaacgtctggtacaggcactgggcctggtggatatccgggtgccggaccatctgatagtcggtggcagccaggttnnnnncattccattcattaattaattaatgaatgaatgnnnnnagcagaatgagcgccgcggcccagttagaggggaagatagccaccacaatcagcagcggcaccgacactgccagcgccatttgcggcaggtagcgtgcatagtaatcatgcatatcgtcaatttgctcgagtaccagcgtcgcccagctccccgctggtttaccctgaatccacgctggccctgcttgttgcagacggtcgagaacctgacggcggatggcaaagcggatatgctgcccggcgtgataacccacccgttcgcgtaaccagaccacccatgcgcgcagtacaaaggtcagaaacagtaacgtaaagggaagcagcagggcttcacggggaatattctccataatcatatgttgcagaattcgcgccatgaaccaggcctgggaaatgatcaatatgccgctcacaaagcccagcagacgagaaatattcagccaacgttgggagatgacgctttgctgttttaaccagcgggttaattctttttgacgggatttattcattgcacgcttagcaggtgagttatcagaattatttgcagagcaatgttacaacggggaaaaaataaaggcgacccatagtcgcatggtgtcgccttctttacttttgttactgatttgtaaaattattttgcgtcagctaaaccgtcgaggtagcgttccgcatcaagagctgccatgcagcctgtaccagcagatgtaatggcctggcgataaatgtgatccatcacgtcgcctgcggcaaagacgccagggatgctggtctgggtggcattaccatgaatacccgactgtactttgatgtagccgttttccagttccagctgcccttcgaaaatggcagtattcgggctgtgaccgatagcaacaaacagaccggcaacgtcgagtgactcgatgttatcgctgttttgcgtatcgcgcagacgaacgccagtgacacccatctgatcgccggtcacttcttccagcgtacggttggtgtgcagaataatgttgccgttctccactttatccatcagacgcttaatgaggattttttccgcacggaaaccatcacggcggtgaatcagatgaacttccgaagcgatgttagacagatacagcgcctcttcaaccgcggtattgccgccgccgatgaccgcaactttctggttgcgatagaagaaaccgtcgcaggttgcacaagcagaaactccacggcctttaaaggcttcttcagagggcaggccgagatagcgtgcagaagctccggtggcaataatcagcgcgtcgcaagtgtattcgccgctatcgccagtcagacggaacggacgattctgcaaatcaactttgttgatgtgatcaaagatgatttcagtttcaaatttggtggcatgttcgtgcatgcgctccattaataacggaccggtcagatcgtttggatcgccaggccagttttccacttccgtggtggtggtcagttggccgcctttttccatgccggtaatcagcacaggttgcaggttggcgcgcgccgcgtagacagcagcggtgtatcccgccgggcctgaacccaggataagcagtttactgtgtttggtcgtgcccatgagatccccatagttgttggcagacaatggcaggattgtagggaatttacagacgtaaaaaaagagtatgacgattttgttaacaatttgtgcaatcggcagcatcgataagcaggtcaaattctcccgtcattatcacctctgctacttaaatttcccgctttataagccgattaaatgatgaataaacgcccctgttaatgaatatctggcatgttgtactaaaaatcgatgttttgctttgacaatcccctggtgttttgcgaaaacattcgaggaagaaaaaaaacagtattcttatatgcgcataaccatgcatgtaaannnnncattccattcattaattaattaatgaatgaatgnnnnnacgtgtgggactttccccaacgccgtgccttgagcgtgtgcgtcggctggaaagacaagggtttattcagggctatacggcgctgctgaacccccattatctggatgcatcacttctggtattcgttgagattactctgaatcgtggcgcaccggatgtgtttgaacaattcaataccgctgtacaaaaacttgaagaaattcaggagtgtcatttagtatccggtgatttcgactacctgttgaaaacacgcgtgccggatatgtctgcttaccgtaagttactgggggaaaccctgctgcgtctgcctggtgtcaatgacacacggacatacgttgttatggaagaagtcaagcagagtaatcgtctggttattaagacgcgctaacacggaacaggtgcaaaatcggcgtattttgattacactcctgttaatccatacagcaacagtactggggtaacctggtactgttgtccgttttagcatcgggcaggaaaagcctgtaacctggagagcctttcttgagccaggaatacactgaagacaaagaagtcacattgacaaagttaagtagcggccgccgtcttctggaggcgttgctgatccttattgtcctgtttgccgtctggttgatggctgccttactaagctttaacccttcggaccccagctggtcgcaaacggcctggcatgaacctatccataatttaggtgggatgcccggtgcgtggttggcagatacgctgttctttatttttggcgtgatggcttacaccattcccgtcattattgtcggcggttgttggtttgcctggcgtcatcagtccagcgacgaatacattgattattttgccgtttcgctacgcatcattggcgttttggcgctcatccttacctcctgtggtctggcggcaatcaacgctgacgatatctggtattttgcctccggtggcgtcattggcagcttactaagcactacgctacaaccactgctacacagtagcgggggaactattgcgctgctctgcgtttgggcagcgggcctgacgctgttcaccggttggtcatgggtgaccattgctgaaaaactcggcggctggattttaaatattcttaccttcgccagtaatcgtacccgtcgcgatgatacctgggtcgatgaagatgagtatgaagacgacgaagagtatgaagatgaaaatcacggcaaacagcatgaatcacgccgtgcccgtattcttcgcggcgcgctagcgcgtcgtaaacggttggcggaaaaattcattaatccgatggggcggcaaacagatgctgcgctgttctccggtaagcggatggatgatgaagaagagattacctacactgcacgcggtgtggctgccgaccctgacgacgtcctgttttcgggcaatcgtgcaacgcagccagaatatgacgaatacgatccattattaaacggtgcgccaattaccgaacctgttgctgtagcagctgctgctaccacggcgacacaaagctgggctgcaccggttgaacctgtgactcagacgccgccagttgcctctgttgatgttccacctacgcaacctacagtagcctggcagcctgtaccggggccgcaaacgggagaaccggttattgcacctgcaccggaaggttacccacagcagtcacaatatgcgcagcctgcagtgcaatataatgagccgctgcaacaacctgtacagccacagcagccgtattatgcgcctgcggctgaacagcctgtgcaacaaccttactacgctcctgcgccggaacagtctgcgcaacagccgtattacgcccctgcgccagaacaaccggtggcaggtaacgcctggcaagccgaagagcagcaatccacttttgctccacagtctacataccagacggagcaaacttatcagcagccagccgctcaggagccgttgtaccaacagccgcaacccgttgaacagcagcctgttgtggagcctgaacccgttgtagaagagacaaaacccacgcgtccgccgctttactattttgaagaagtggaagagaagcgagcccgtgaacgtgaacaacttgcggcctggtatcaaccgattccagaaccggttaaagaaccggaaccgatcaaatcttcgctgaaagcaccttctgttgcagcagtacctccagtagaagccgctgccgctgtttctccgctggcatctggtgtgaaaaaagcgacactggcgacgggggctgccgcaaccgttgccgcgccagtcttcagtctggcaaatggcggtggaccgcgtccgcaggtcaaagaggggattggcccgcagttgccacgaccgaaacgcatccgcgtgccaactcgtcgtgaactggcgtcttacggtattaagctgccctcacagcgtgcggcagaagaaaaagcccgtgaagcccagcgtaatcagtacgattctggcgatcagtacaacgatgatgaaatcgatgcgatgcagcaggatgaactggcacgtcagttcgcccagacgcagcagcaacgctatggcgaacagtatcaacatgatgtgcccgtgaacacagaagatgcagatgctgcggcagaggcagaactggctcgtcagtttgctcaaactcaacaacaacgttattccggcgaacaaccggctggggcgaatccgttctcgctggatgattttgaattttcgccaatgaaagcgttgctggatgatggtccacacgaaccgctgtttacgccaattgttgaacctgtacagcagccgcaacaaccggtagcaccgcagcagcaatatcagcagccgcaacaaccggtagcaccgcagcagcaatatcagcagccgcaacaaccggttgcaccgcagccgcagtatcagcagccgcaatatcagcagccacaacagccggttgcacagcagccgcaatatcagcagccacaacaaccggttgcacagcagccgcagtatcagcagccacaacagccggttgtatcacagccgcaggataccctgcttcatccgctgttgatgcgtaatggcgacagccgtccgttgcataaaccgacgacgccactgccttctctggatttgctgacaccgccgccgagcgaagtggagccggtagatacctttgcgcttgaacaaatggcgcgcctggtagaagcgcgtctggctgatttccgtattaaagccgatgttgtcaattactctccggggccagttatcactcgctttgaattgaacctggcaccgggcgtaaaagcagcgcgcatttctaacttgtcacgtgaccttgcccgttcactttcgacggtggcggtgcgtgtcgttgaagttattcctggcaaaccctatgtaggtctggagttaccgaataaaaaacgacaaaccgtttatctgcgcgaagttttggataacgccaaattccgcgataatccgtcgccattaaccgtggtgctgggtaaagatatcgccggtgagccggtggttgccgatctggcgaaaatgccgcacttgttggttgcggggactaccggttccggtaagtctgtcggggtgaacgcgatgatcctgagcatgctttataaagcacagccagaagatgtgcgtttcatcatgatcgacccgaaaatgctggagctttcggtttatgaaggcattccgcacctgttaacggaagttgttactgatatgaaagatgccgccaacgcgctgcgctggtgtgttaacgagatggagcgtcgttataaactgatgtctgcgctgggtgtgcgtaatctggcgggttataacgaaaaaattgctgaagccgatcgcatgatgcgtccgattccagacccgtactggaagccgggtgatagtatggatgcgcagcatccggtgctgaaaaaagaaccatacattgtggtgttggtggacgaatttgccgacctgatgatgacggtaggtaaaaaagtggaagagctgatagcacgtctggcgcaaaaagcccgtgccgcgggtatccacctcgtactggcaacgcagcgtccatcggttgatgttattactggtctgattaaagcgaatattccgacccgtatcgcctttaccgtatccagtaagattgactcacgtaccattcttgatcaggctggtgcggaatcactgctgggtatgggggatatgctctactctgggccgaactccacgttgccggtacgtgtccatggtgcttttgttcgcgatcaggaagttcatgccgtggtgcaggactggaaagcgcgtggtcgcccacagtatgttgatggcatcacctccgacagtgaaagcgaaggtggcgtgggcggtttcgatggcgctgaagaactggatccgttgttcgatcaggcggtgcagtttgtcactgaaaaacgcaaagcgtcaatttctggcgtacagcgtcagttccgcattggttataaccgtgcagcgcgtattatcgaacagatggaagcgcaggggattgtcagcgaacaggggcacaacggaaatcgtgaagtgctggccccaccgccatttgactaattaatgcaacgtaggccggataagacgcgatagcgtcgcatccggtattctatcaactgaaaattcagtattttcttctttcctcaagctgattattagcctggaatagagagtagagggaactcccgattgggagtgacgtaatttgaggaataatgatgaaaaaaattgccatcacctgtgcattactctcaagtttagtagcaagcagcgtttgggctgatgccgcaagcgatctgaaaagccgcctggataaagtcagcagctttcacgccagcttcacacaaaaagtgactgacggtagcggcgcggcggtgcaggaaggccagggcgatctgtgggtgaaacgtccaaacttattcaactggcatatgactcaacctgatgaaagcattttggtttctgacggtaaaacactgtggttctataacccgttcgttgagcaagctacggcaacctggctgaaagatgccaccggtaatacgccgtttatgctgattgcccgcaaccagtccagcgactggcagcagtacaatatcaaacagaatggcgatgactttgttctgacgccgaaagccagcaatggcaatctgaagcagttcaccattaacgtgggacgtgatggcacaatccatcagtttagcgcggtggagcaggacgatcagcgcagcagttatcagctgaaatcccagcaaaatggggctgtggatgcagcgaaatttaccttcaccccgccgcaaggcgtcacggtagatgatcaacgtaagtagaggcacttgagtgagcaatctgtcgctcgatttttcggataatacttttcaacccctggccgcgcgtatgcggccagaaaatttagcacagtatatcggccagcaacatttgctggctgtggggaagccgttgccgcgcgctatcgaagccgggcatctgcattctatgatcctctgggggccgccgggtaccggcaaaacaaccctcgctgaagtgattgcccgctatgcgaacgctgatgtggaacgtatttctgccgtcacctctggcgtgaaagagattcgcgaggcgatcgaacgcgctcggcaaaaccgcaatgcaggtcgccgcactattctttttgttgacgaagttcaccgtttcaacaaaagccagcaggatgcatttctgccacatattgaagacggcaccattacttttattggcgcaaccactgaaaacccgtcgtttgagcttaattcggcactgctttcccgtgcccgtgtctatctgttgaaatccctgagtacagaggatattgagcaagtactaactcaggcgatggaagacaaaacccgtggctatggtggtcaggatattgttctgccagatgaaacacgacgcgccattgctgaactggtgaatggcgacgcgcgccgggcgttaaatacgctggaaatgatggcggatatggccgaagtcgatgatagcggtaagcgggtcctgaagcctgaattactgaccgaaatcgccggtgaacgtagcgcccgctttgataacaaaggcgatcgcttttacgatctgatttccgcattgcataagtcggtacgtggtagcgcacccgatgcggcgctctactggtatgcgcgaattattaccgccggtggcgatccgttatatgttgcgcgtcgttgcctggcaattgcttccgaagatgtcggcaatgccgacccacgggcgatgcaggtggcaattgcggcctgggattgctttactcgcgttggcccggcggaaggtgaacgcgccattgctcaggcgattgtttacctggcctgcgcgccaaaaagcaacgctgtctacactgcgtttaaagccgcgctggccgatgctcgcgaacgtccggattatgacgtgccggttcatttgcgtaatgcgccgacgaaattaatgaaggaaatgggctacgggcaggaatatcgttacgctcatgatgaagcaaacgcttatgctgccggtgaggtttacttcccgccggaaatagcacaaacacgctattatttcccgacaaacaggggccttgaaggcaagattggcgaaaagctcgcctggctggctgaacaggatcaaaatagccccataaaacgctaccgttaatgttatcgttgcggtaatgttgttaatgtatccctgtggtcgcaggctgtggccacatctcccatttaattcgataagcacaggataagcatgctcgatcccaatctgctgcgtaatgagccagacgcagtcgctgaaaaactggcacgccggggctttaagctggatgtagataagctgggcgctcttgaggagcgtcgtaaagtattgcaggtcaaaacggaaaacctgcaagcggagcgtaactcccgatcgaaatccattggccaggcgaaagcgcgcggggaagatatcgagcctttacgtctggaagtgaacaaactgggcgaagagctggatgcagcaaaagccgagctggatgctttacaggctgaaattcgcgatatcgcgctaaccatccctaacctgcctgcagatgaagtgccggtaggtaaagacgaaaatgacaacgttgaagtcagtcgctggggcaccccgcgtgagtttgactttgaagttcgtgaccatgtgacgctgggtgaaatgcactctggcctcgactttgcagccgcagttaagttgactggttcccgctttgtcgtcatgaaagggcagattgctcgcatgcaccgcgcactgtcgcagtttatgctggatctgcataccgaacagcatggctacagtgagaactatgttccgtacctggttaaccaggacacgctgtacggtacgggtcagctgccgaaatttgctggcgatctgttccatactcgtccgctggaagaagaagcagacaccagtaactatgcgctgatcccaacggcagaagttccgctgaccaacctggtacgcggtgaaatcatcgatgaagatgatctgccaattaagatgaccgcccacaccccatgtttccgttctgaagctggttcatatggtcgtgacactcgtggtctgatccgtatgcaccagttcgacaaagttgaaatggtgcagatcgtgcgcccggaagactcaatggcggcgctggaagagatgaccggtcatgcggaaaaagtcctgcagctgctgggcctgccgtaccgtaaaatcatcctttgtaccggcgacatgggctttggcgcttgcaaaacttacgacctggaagtatggatcccggcacagaacacctaccgcgagatctcttcctgctccaacgtttgggatttccaggcacgtcgtatgcaggcacgttgccgcagcaagtcggacaagaaaacccgtctggttcataccctgaacggttctggtcttgctgttggtcgtacgctggttgcagtaatggaaaactatcagcaggctgatggtcgtattgaagtaccagaagttctgcgtccgtatatgaacggactggaatatattggctaatacccaatttttctgaatctaaaaagcgcctgcgggcgctttttttgtctccctttgataccgaacaataattactcctcacttacaagtaatactactttcgagtgaaaatctacctatctctttgattttcaaattattcgatgtatacaagcctatatagcgatctgctatagaaataattacacaatacggtttgttactggaatcaatcgtgagcaagcttgagtgagccattatgaaaacgaaaatccctgatgcggtattggctgctgaggtgagtcgccgtggtttggtaaaaacgacagcgatcggcggcctggcaatggccagcagcgcattaacattaccttttagtcggattgcgcacgctgtcgatagcgctattccaacaaaatcagacgaaaaggttatctggagcgcctgtacagttaactgtggtagtcgctgcccgctacgtatgcacgtagtggacggtgaaatcaaatatgtcgaaacggacaataccggcgatgacaattacgacggcctgcaccaggttcgcgcctgtctgcgtgggcgttccatgcgtcgccgtgtctacaatccggaccgcctgaaatatccgatgaaacgagtcggggcgcgcggtgaaggcaaattcgagcgcattagctgggaagaagcctacgacatcatcgcgaccaaaatgcagcgcctgatcaaagagtacggcaacgagtctatctatctgaactatggcaccggtacgctgggcggcaccatgacccgctcgtggccgccgggaaataccctggtcgcgcggctaatgaactgctgcggcggttatctgaaccattatggcgactactcctccgcgcaaattgcggaaggtctgaactatacctacggcggctgggcagatggtaacagcccgtcggatatcgaaaacagtaaactggtagtgctgtttggtaataaccctggcgaaacgcgaatgagtggcggtggggtgacttactatcttgaacaggcgcgccagaaatctaatgctcgcatgatcatcatcgatccgcgctataccgacaccggtgccgggcgtgaagatgagtggatccctattcgtccgggaacagatgccgcactggttaacggtctggcgtatgtcatgatcaccgaaaacctggtagatcaggaattcctcgataaatattgcgttggctacgacgagaaaaccctgccagccagtgcgccgaaaaatggtcactataaagcttatattctgggtgaaggacccgatggcgtggctaaaacaccggaatgggcctcgcaaatcaccggtgttccggcagacaaaatcatcaaactggctcgtgaaatcggcagtaccaaaccggcgtttatcagccagggatggggcccgcagcgtcatgctaacggtgaaatcgcaacccgtgctatctcgatgctggcgattctgaccggtaacgttggtattaacggggggaacagcggcgcgcgcgaaggttcatacagcttaccgtttgtccgtatgccgactctcgaaaacccgatccagaccagcatttctatgtttatgtggaccgatgccattgaacgtggcccggaaatgacggcgctgcgtgatggtgtgcgcgggaaagataagctggatgtgccgatcaaaatgatctggaactatgccggtaactgcctgattaatcagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcactggatgcatcctgcgggaatatgtcttacgttattttcaatgatcaggtcattaaaccgcgctttgaatgtaagactatctatgagatgaccagcgaactggcaaaacgtcttggcgtcgaacaacagtttactgaaggtcgtactcaggaagagtggatgcggcatctgtatgcccagtcgcgggaagcgattcctgaactgccaacgtttgaagagttccgtaagcaggggatctttaaaaagcgcgatccgcaagggcatcacgttgcttataaagctttccgtgaagatccgcaggcaaatccactgaccacgccatcggggaaaattgagatttattcgcaggcgctggctgacattgccgctacctgggaattgccagaaggtgatgtgatcgatccactgccgatctacacgccgggctttgaaagttatcaggatccgctgaacaaacagtatccgctgcagcttacgggtttccactataaatctcgcgttcactcaacttacggcaacgttgatgtgctgaaagcagcttgccgtcaggaaatgtggatcaacccgcttgatgcgcaaaaacgcggtatcaacaacggcgataaagtcaggatctttaatgatcgtggtgaggttcatattgaggcgaaagtgacgccacgaatgatgccgggtgtggtcgcactgggtgaaggtgcctggtatgacccggatacaaaacgtgtcgataagggcggttgtattaacgtactgaccactcaacgtccgtctcctcttgccaaggggaatccatcacatacgaaccttgttcaggttgaaaaggtgtaaggagtaaccgatgacaacccagtatggattttttattgattccagccgttgcaccggttgcaaaacctgcgagctggcttgtaaagactacaaagatttgacgccagaagtcagcttccgccgcatttatgaatatgctggtggcgactggcaggaagataacggtgtctggcaccagaacgtgtttgcctactatctgtcgatttcatgtaaccactgcgaagatccggcttgtactaaagtctgcccgagcggtgcgatgcataaacgtgaagatggttttgttgtggtcgatgaagatgtatgcattggctgccgttactgtcatatggcttgcccgtatggcgcaccgcaatataacgaaacgaaaggccatatgaccaaatgcgatggttgttatgaccgtgttgcggagggaaaaaaaccgatctgcgtagagtcctgcccgctgcgggcgctggatttcggccctatcgacgagctgcgtaaaaaacatggcgatctggcggccgttgcgccgttgccgcgagctcactttaccaaaccgaatattgtgatcaaacccaatgccaacagccgcccaaccggggataccactggctatctggcaaacccgaaggaggtgtgagatgggaagtggatggcatgaatggccgctgatgatcttcacggtcttcgggcaatgtgtagcgggtggttttatcgttctggctttggcgctgctcaaaggcgacctgcgagcagaagcccagcagcgtgttatcgcctgcatgttgggtttatgggtgctgatgggcattggctttatcgcctctatgcttcatcttggttcaccgatgcgcgcttttaactcgctcaatcgggtaggggcttcagcactcagtaacgaaattgccagcggttcgatcttttttgctgtaggcggcatcggctggttgctggcaatgctgaaaaagctttcaccggcattgcgtacgctttggctggtggtgacgatggttcttggcgtagtctttgtctggatgatggtgcgtgtgtataacagcatcgatacagtacccacctggtacagcatctggacaccgatgggcttcttcctgacgatgtttatgggcggcccgttactgggttacctgttgctgagtctggctggtgtcgatggctgggcgatgcgtctgctgccagccatttctgttctggcactggtagtgagtggcgtgatgtcagtgatgcagggcgcagagctggcgaatattcatagctctgtgcagcaggccgcagcgctggtgccggactatggtgcgctgatgtcctggcggatcgtgcttttggccgttgccctgtgcttgtggattgcaccacagctaaaaggttatcagcctgcggttccgctactttctgtatcattcattctgcttctggcaggggaattaatcggtcgtggcgtattctatggtttgcatatgaccgtggggatggctgtcgcaagttaatcagtaacaaccggggtttcggccccggttcgcttttatttctgcttcgttaacgtgtcataactggtcatcaagttacgataatcaggaatgtggttagagaacaacgtcgccagtccttcaatatcattacgccagtcgcgatgcagctcgcacgccacgccgaaccatgtcatcaattgcgcaccagcttgcgacatgcgatcccatgccgaatgccgggtaatttcattaaaggtccctgacgcgtcagtcacgacaaagacgtcaaacccttcttcaatggctgaaagcgccgggaatgccacgcaaacttcggttaccacaccggcaataattaactgttttttacctgtcgctttgacagcttttacaaaatcttcgttatcccaggcgttaatatttcccgggcgagcaatgtaaggtgcatcggggaattgtgctttcagttctggaactaatgggccgttaggaccggtttcaaaactggtggtaagaatagttggtaagttgaaatacttagccaggtcacccagcgccagcacgttatttttaaacttatcgggttcgatatctcgtacaagggaaagtaaaccagcctggtgatcaacaagcaaaacggcagcatcatttttatcaagacgaacatacggtttggtcatcctcttctcctttcgagagtcagtggtacgtctaaatcggtcagacgtgatgcattgctctgaaagcatagacgggaaatatgagtttgctgtgaccatgaaatttttcgactgaacgaagcgtatgaaatttgtgttagatcaataaaaacaatcagatgagattaatcgtctcttcagcattagcgttatgaatgagtaatataaatcgataataccgccgctgcgatatgcgcgtattttcacccattgacaatgtttttggcggtggcatgatgcgcatgaaatttgaacttcctcacggttttaattcatgtccacgtatacccggcctgtcatgcttttgctgtctggcctgcttttgttgactctggcgattgcggtgttaaatacactcgtgccgctttggctcgcccaggaacacatgtctacatggcaggtaggcgttgtcagctcatcctattttaccggcaaccttgtcggtacattgctgacagggtatgtcattaaacgcattggctttaaccgtagctattatctggcctccttcatttttgccgctggctgtgccggccttggcctgatgattggattctggagttggttggcgtggcgttttgtcgctggcatcggctgtgccatgatttgggtggttgttgagagtgcgctgatgtgcagtgggacgtcgcgtaaccgcgggcggttgcttgctgcgtatatgatggtttattacgtcggaacgtttttaggccagttactggtcagcaaagtctcaaccgagttgatgagtgtattgccgtgggttacaggtttgacgttggcaggaatcttaccgctgttgtttacgcatgtcctgaatcagcaggctgaaaaccatgattcgacgtcaattacgtcaatgctaaaactccgtcaggcacggcttggcgtgaatggctgcattatctcaggaatcgtgctgggatctctatatggcctgatgccgctgtacctcaatcacaaaggggtgagcaatgccagcattggtttctggatggcggtactggtcagtgcgggtatcctcgggcaatggccgattggacgtctggcggataagtttggtcgactgctggtgttgcgtgttcaggtctttgtcgtcattctcggcagtattgcgatgcttagccaggcggcgatggccccagcgttattcatcctcggtgccgctggctttacgctatatccggtggcgatggcctgggcttgtgagaaagttgaacatcatcaactggtagcgatgaaccaggccttactgttgagctataccgtgggaagcctgcttggcccgtcatttaccgctatgctaatgcagaatttctccgataatttattatttatcatgatcgccagcgtatcgtttatctatttgctgatgctgcttcgcaacgccggtcatacgccgaaacccgtggctcacgtgtaaatgaattcaagcagagtgtgaacttactgtttcacactctgcttttctgtgcacaaaaaagcggcaacttaataaagttgccgctttacggggaaattagaacatgaccttatgaccgtactgctcaagaatgcctttcacgcgttccatggtctctttcttcggtggtttaacaccatcgagtttgtattcttcacccattgccacccatttgtgtttgcccagttcgtggtaggggaggagctcgattttctcaacgttgcccatatcacgggtaaattcaccaaggcgatgcgctgaatcgtcatcgtcagaccagcctgggacaacaacatagcggatccacaccttcacatttttgttcgccagatatttagcgaactccagcgtgcggtggttggaaactccaaccagattttggtggatctcgtcgttcatctgtttgagatcgagcattaccaggtcggttacttccagcagttcatcaatcaccggatcgtaacgacgaacaaaaccgttggtgtccagacaggtatgaatgccttcttttttgcaggcgcggaaccagtcacgaacaaactcagcttgtaggattgcctcaccgccggatgcggtaacgccgccgccggaagcgttcataaagtggcgataggtcaccacttccttcatcaaatcttcaacggtaacttctttaccgccatgcgtatcccaggtgtcgcggttatgacaatacaggcagcgcatcaggcagccctggaaaaaggtgataaagcgaatacccgggccgtctacggttccacaggattcaaaggagtgaatgcgaccaataactgacttggtagcccccgccgtagcggtattttctgttgtattacaattagttaaattactcatatcgcttcaattggctctagttaactctggtttatggacgcattatggacattcctgacaccgggttaagagtcactgcatcttgtaagaaatccggtgcaaagtgtgcgtaggtcatagtttgctgaatgttagaatgacccaggatgcgctgcaatgtgattatgttacctccattcattataaaatgtgtggcaaatgtatgcctcaaaacatgcactgcctgtccgtcaggtaaatcgggttttacttccctgagagcgttgcgcactttgtagtaactggcattaaaaagcctgcctgaatttttggtcttgatccgtttaatcaggtcctgcgaaacgggaattgtcctgcgctttccgtttttagttttcataaacgtaaccatctggttaatgatgtgttcagcttttaaattagacacttcactccagcgtccaccagtagaaaggcagaccagagtcgcatttaattcatcaccatcgagcatggataacagccgtgtaatctcttcactggacaaaaaagccatttctgtaacagcttcacgtaatcgcttaacctcacggaacgggttgtgagaatggtattcaccggcgtcaattaacttggtgaacatcccgctcattattgccagatgccgatttacgctggctggttttagaccatcgttcatcattacaacgcgataatcagttatcgttttctttgttagctggtcagctctggacactcccatttctgcaaatttggcgattattgtcgtcaaacgcccccgttcaatatctccacgctcatgtgattttccgtgatatatccaccatctgcctaacaactctgtaagagttcggcggtcggctggcttctccagccactctttgttgtggtagttaaccagtacatgacgttcgaatgcttgagcttcacctttagttttaaatttccgcctgatacgttttccatctgcaccctgcggtctgacgtccacttcataacgaccatcatcgagctttttaatagacataaagccctccgatgacgctgtttacttctactacttgaaaattaatgcaattttctttcgtacatttactgcatacatatgctgaataaatcgtcagccagtcttttggtctgagtggtgcaaggttgttgagtcttgcccaatgtgcgcgagcgccggggctatttgtccgccagcgggatcagtttcatcaaacatgaaccagtcacggtacttgcgaaatctttcaggcttgaaaaatttcatgcctgcgtcaaaagacatctttacttttccctgctcatatccagcataggtgttgtagttaattccagttaattcagcaacttgcttccttgtcattctttctgactcccgaataagtgcgagtttctctgcttgagatgtgatttgtgtatttgacatgaattgtcgtatctcgtaatttatgttgtatgcgacacaccagaacaacgcagagcggcttcaaatagctctggttgaatggcaccaaagttgaggatatcaaaatgagtattggatcagaaatgaataacgatgttggagaaaaagtatctgatctcacaaaaagtaaaaaatgtgacatcaaacttgcagccgcaccgtcggatttgctctcgaaagagggatttgctctttacatcggtaagacgcctcgtgctgttgctgaaatggcgaaagcaggcaagttaccagccttttatatgacggacccattaaagccgggcggtcatgctgagttatggattaatcgccgtgagtgggacaagtacgcagcccaactagttgatgaagctccgacagaatggcatgactggaaaaatcgcattagttacagcaaatcaagacatggccgtgcggcttaaggtggaaaggatgaacgagcctcgttgtattgctcagttattgcgtaacgaaagccccagggcgattgacttcaccattacccacggtaaggggcgtaagggaatcattatccgcaccaaaaaacagagtccgttaaaaaaggctctgacctttctgaaaagccggagggtatggaaatgacagtgatgacgctcaatctcgttgaaaaacaaccagcaactatgcgccggataattggtaagcatcttgccgtccctcgctggcaggagacatgtgattattataatcagatgatggagcgcgaacggctaacggtttgcttccatgcacagttaaaacagcgtcatgcaacgatgcgttttgaagaaatgaacgacgtcgaacgtgaacggctggtttgtgcaattgatgaattgcgtggggcattctcaaaacgccgtcaggtcggtgcaagtgagtatgcatatattagctttttaactgtcagtcagcgccgtactttatttatgcacgcacgactgacagaaaaagaatttaatcagccatactggcgaattaatgaagagtcatgttactggcgtgatgctttattccgtgcattacgtgaattattcagtctgtttgaatatgcaccgacaattctgacgtcggtaaaaccagagcaatatctgcattaagtaattaaccaaagtttttaacgcacttaatcgtgcggggcttctttttgcctggagaaagtcatgcatacagtttctgaaaatcagtgcggtaaatacgcattaatgctgcaacaggccagaaccgaagcacaggccgatgcagcaacgcgcttttcttctcatcttgatgccatgattcgccacatcacaaaggcggagttatcccgcgtggagatagtcgagttgctcagtcaggagtctgccaaattccataatctaggactcaataaataacagggaagttggagatgacaaatacaaaatggttcaggaaacgcttaacagattatcggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgttcaccgaatacgtgcgcaacaaccgtcttccggagactgtcatacgcgtaaaacagccagcgctggcgcgatttagccccgacatagccccactgttcgtccatttcagcgcagacaatcacatcactgcccggctgtatgcgcgaggttaccgactgcggcctgagttttttaagtgacgtaaaatcgtgttgaggccaacgcccataatgcgggcagttacccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcacccagattatcaactttcattacttaaaaaattagatgacaagactccactacatccttcaagcgatgtcttccgctcctgtcctagtcgtgtggaaaaagcatttatagcaatggggaaatgggggcttgtgaccaaatcaagagaaggtttctgtattaccgataatggacgggaaatgattgattctgcggagagggcatatagcgaatgaaaaatatattgcttaataactggctgaagatttcagtcatgaaaaatggtgatttgtcgctagctgatattaaacgcgataaaaacactggggatatggtggaatcaactatagccatttatgcggataaattaaatctcctgtctgatgtggtcaatttacttgttaaacgcgctgtatttcataagcaaatttcatccgtggatgaactgacaaaattaacgacagaaatcgccagctattgcgctgatgaatttaagaagctgaacgacaaaaggagctggtaatgccggacaacgtagattttattcaggaacaacaggctgaattactggagcgccagattaacgcggcaagggtaaaacattgcggtgtttctgcgctggtttgcgaagagtgtgacgtgccaatacctgctgcccgtcgtgcggcttatccgtcagccacgcgttgtgtttcctgtcagtcagtctttgaagcaaaaaacaaacattaccggagaacggcatgagtattcgtattgaaattggcgaacgttatgtcgttaccagtgacagctttcagtttattctccacgagaaaaagagagcggaaagcggtaaaaacgccggtcaggaatggctgtcggtggttggttattacccgaaattaagccagctcgtttccggcatgatgcatcacgatattctgaccggaagcgcaaagtcttttgctgatttaaacgcgcaggttgagcaactcagcaagcgttgttcagaggcttttggctcatatggccgttaaagcctccgggcgttttgtccctccatcagcatttgccgcaggcaccggtaaggcgtttaccggtgcttatgcatggaacgcgccacgcgaggctgtcgggcgcgaaagaccccttacacgtgacgagatgcgtcaggtgcaaggtgttttatccacgattaaccgcctgccttactttttgcgctcgctgtttacttcacgctatgactacatccggcgcaataaaagcccggtgcacgggttttatttcctcacatccacttttcagcgtcgtttatggccgcgcattgagcgcgtgaatcagcgccatgaaatgaacaccgacgcgtcgttactgtttctggcagagcgtgaccattatgcgcgtctgccggggatgaatgacaaggaactgaaaaagtttgccgcccgtatctcatcgcagcttttcatgatgtatgaggaactctgcgatgcatgggttgatgcacatggcgagaaagaatcgctgtttacggatgaggctcaggcgcatctgtatggtcatgttgctggcgctgcacgagctttcaatatttcccctctctactggaaaaaataccgtaaaggacagatgaccacgaggcaggcatattctgccattgcccgtctgtttaacgatgagtggtggactcatcagcttaaaggtcagcgtatgcgctggcatgaggcgttactgattgctgtcggggaggtgaataaagaccgttctccttatgccagtaaacatgccattcgtgatgtgcgtgcgcgccgccaggcaaatctggaatttcttaaatcgtgtgaccttgaaaacagggaaaccggcgagcgcatcgaccttatcagtaaggtgatgggaagtatttctaatcctgaaattcgccggatggagctgatgaacaccattgccggtattgagcgttacgccgccgcagagggtgatgtggggatgtttatcacgctgaccgcgccgtcaaagtatcacccgacacgtcaggtcggaaaaggcgaaagtaaaaccgtccagctaaatcacggctggaacgatgaggcatttaatccaaaggatgcgcagcgttatctctgccgcatctggagcctgatgcgcacggcattcaaggataatgatttacaggtctacggtttgcgtgtcgtcgagccacaccacgacggaacgccgcactggcatatgatgcttttttgtaatccacgtcagcgtaaccagattatcgaaaccatgcgtcgctacgcgctcaaagaggatggcgacgaaagaggagccgagcgaaaccgttttcaggcgaaacaccttaaccggggcggtgctgcggggtatatcgcgaaatacatttcaaaaaatatcgacggctatgcactggatggtcagctcgataacgataccggcagacctctgaaagatactgccgcggctgttactgcatgggcgtcaacgtggcgcatcccgcaatttaaaacggttggtctgccgacaatgggggcttaccgtgaactacgcaaattgcctcgtggcgtcagcattgctgatgagtttgacgaacgcgtcgaggctgcacgcgccgccgcagacagtggtgattttgcgttgtatatcagcgcgcagggtggggcaaatgttccgcgcgattgtcagactgtcagggttgcccgtagcccgtcggatgacgttaacgagtacgaggaagaagtcgagagagtggtcggcatttacgcgccgcatctcggcgcgcgtcatattcatatcaccagaacgacggactggcgcattgtgccgaaagtgccggtcgttgagcctttgactttaaaaagcggcatcgccgcgcctcggagtcctgtcaataactgtggaaagctcaccggtggtgatacttcgttaccggctcccacaccttctgaacacgccgcagcagtgctaaatctggttgatgacggtgttatcgaatggaacgacacggaggtcgtgagggcgctcaggggggcattaaaacacgacctgagaacaccaaatcgtcagcaaagaaacggaagcccgttaaaaccacatgaaattgcaccatcggccagactgacccgatcggaaagaatgcaaattacccgtatccgcgttgaccttgctcagaacggtatcaggccgcagcgatgggagcttgaggcgctggcgcgtggcgcgaccgtaaattatgacgggaaaaaattcacgtatccggtcgctgatgagtggccgggattctcaacagtaatggagtggacataatggcaaaaattcacgaggtaaagctgcacgcgaaatatttcgaccttgtgctggaaggaaagaaacgtgcagagttccggaaaaatgaccgtaattatgagcgcggggacacgttgattttgcatgaatgggtgcagggtgtgtatacggggcgaaaggttgaagcccggataacagatgttactgacctgtcagactggctggaagattatgtcttgctaagtattgagcggcttaatacaggcgcatgtgagattgtgaactggaaagaacttagtgagcgtggtctggtattcagaattaatcatgaaattatgcatcagctcggccttgctgttatgtatgaaccagagacggggatgtctggcggggcaatggttgccacggatggagcatggaactattcagatgaacagatggagcgtgcacagcaaaacgggtggcttggataatgcacagaataccaggcgagataccgcaccataaaactaaaaatatcaagctgatggctattgttcagcgtttacagaggattatggtcaacgaaaatctgacgccggatgagctggtcgggtgtgccgaaatagtacgggataattacgggcagcttaactatatcggtcagtccagagttgcgccaccaccacgaagacgatagagaacgccgccagtcgtgaaacttgttttcagggctggcggggttgaacaacgagcgaagcgaggcgttagttgacagacatatttttactgcgttggtgccggtttttgacggttgaaaggagttaggttggagagctaacaacttacaaatattcaaaagtaagcatcctgttgctaacatgaggtcgattttttatgtggatgatgtaaaaaggatagctatggatactataatcgcttttctatcactcgcttttttcgttgctttcttcatcgggttaatcaagccatcactggtgcgaatgccaaaccgcaaacgtgcaagtgcggtttatctcggaggaggttttgtattgagcataattggttcaatactctatccaacagaaaaaagccagccagttgctaaaactgaaacatcaaccgttgcagaacacaaagtccaaaaaacattcgaatatggtgaaaaaacactcaaggaatatcggaacgagtcaaagaaaacacgacacgatattgtgaatagttacattgattttaaggaagttccagccaccgcgtcagatgcgttttatgcctgcatgagtgagtatacatttaccaaagatgatgagttgaaactcggtgatgttcttgggtggtgctttaatgattatgaaaatgacccgaattcactaaacaataaaatcaatcttgatacatttcagagtaattttagtggttgggatggttcttatcgtccattggaaaaactaattaaagataatatgaacgatgattcatcttataaacatgtgtcaacggtatatcatctggttttgaataaagacccgcatgccattgtgaaaaccacgtttcgcggaactaatgcttatggaggagtggtgaaacagacgattgctgcgcgtgttgatataaaaactggtaaggtgatatcaatcatagataattgatatcttacaatgccgacgctgaatatttaattgggtgtcggcattttttttgactattagagcggcagagccgagatttgttacgtatgagattagcactgcgagaatgttatgaaagttataaaccaacttaagaagtttgataagaaaagaacgccagatgatggccgtattagtttgttatatgaaaacgcgattaagtatgatatgtactctgtatatattaaagataaaaatgatacagaatacctctttgactgtttggttgatgggaagataaaggcttttaaatgggatgatgaggaacgtagatttcatataagttcatacttggatatttctgagcttacgcctgattctttttttggtatttattactaccgtgcgcatgagttgcgatttaactctttaaatgatttaacctttttaagggagttgttttttagagtgaagtctaattatgaaaatataaagtttagtcgtgaaaaatatatttatcgacagcaaaaaaaagaaataactgatgtgatgcttgttctctcaacgattataagaatgtatcgtgaacgggatgctgaaactgtgtttagtgagttttcaataatgaccgaagtcgctggtagtttatgggtataccatgacgataaaaacaggatgcgtaaagagcttcgtttatgcctgaattctcttgttcagaatggagatcttgttgaaacaagtagtggatttaggctaacaggaaaggcactgaacacaatatctacattcaataaagatgagttgcggtacagagagaatttgagcactcagaagaaaatgttttgggctacttttttcgcagcagtcggcggcgtaggaagtatgattgcagctataatagggcttctaaaatgagccaacaaaatcgtatgatgaagtattgagtgaaaagcattctttatatgcattattttgcatgcaacatatgctatacattttagctatgaattgtcagacgtggcagtacttctgtatggtaatgcaactgcattaaaaccgccccatgaagcgggcgggcgaggcggggaaagcactgcgcgctggcggtggtgctgattttattttttcagcgtctcagcgcgtcgtgatggcatttagtcggcctgctggggcgttggtgtgtctgcggggtgttttgtgcggtggtgagcgtgtgagggcgtgatggcgggttgtaaaaaagccgcccgcaggcggcgatgttcagccgttgtcagtgtccagtgagtagtttttaaagcggatgacctcctgaccgagccagccgtttatctcgcggatcctgtcctgtagcgggataagctcattgcggacaaagacctttgccactttctcaatatcacccagcgacccgacgttctccggcttgccgcccatcaactgaaaggggatgcggtgcgcgtccagcaggtcagcggcgctggcttttttgatattaaaaaaatcgtccttcgtcgccacttcactgagcgggataattttaatgccgtcggctttcccctgcggggcatagagaaacaggtttttaaagttgttgcggcctttcgacttcaccatgttttcgcgaagcatttcgatatcgttgcggtcctgcacggcatcggtgacgtacatgatgtatccggcatgtgcgccgttttcgtaatacttgcggcggaacagcgtggctgactcattcagccaggcagagttaagggcgctgagatattccggcaggccgtacagctcctgattaatatcgggctccagcaggtgaaacacggaaccgggcgcgaaggctgtcggctcgttgaaggacggcacccaccagtaaacatcctcctccacgccacggcgggtatattttgccggtgaggtttccagtctgatgaccttaccggtggtgctgtaacgcttttccagaaacgcattaccgaaaaccagaaaatccagcacaaagcggctgaaatcctgctgggaaagccacgggtgcgggataaacgttgaagccagaatattacgtttgacgtaaatcggtgagctgtgatgcacggcagcacgcagactttttgccagaccggtaaagctgaccggtggctcataccatctgccgttactgatgcattcgacgtaatccagaatgtcacggcggtcgagtaccggcaccggttcgccaaaggtgaatgcctccattttcggggcgctggcggtcattttttttgccgcaggttgcagtgttttcccttttttcttgctcatcagtaaaactccagaatggtggatgtcagcggggtgctgataccggcggtgagtggctcatttaacagggcgtgcatggtcgcccaggcgaggtcggcgtggctggcttcctcgctgcggctggcctcataagtggcgctgcgtccgctgctggtcatggtcttgcggatagccataaacgagctggtgatgtcggtggcgctgacgtcatattccagacagccacggcggatgacgtcttttgccttgagcaccattgcggttttcatttccggcgtgtagcggatatcgcgcgcggcgggatagaacgagcgcacgagctggaacacgccgacaccgaggccggtggcatcaataccgatgtattcgacgttgtatttttcggtgagtttgcggatggattccgcctgggtggcaaagtccatgcctttccactggtgacgctcaagtattctgaatttgccaccggccaccaccggcggtgccagtaccacgcatccggcgctgtcgccacggtgtgacgggtcgtaaccaatccagaccgggcgggagccgaacggattggcggcaaacggcgcatagtcttcccattcttccagcgtgtcgaccatgcagcgttgcagctcctcgaacgggaacaccgacgccttgtcgtcaacaaattcacacatgaacaggtttttaaaatcgtcggcgctgttttcgcgtttgagctgttcaatgtcgaacagcgtgcagccacctttcagggcgtcctcaatggtgacaatctgccgccactggccgtccgcacagagaagcccaccggcaagggcgttatgactgacgtcgatttccacgcgttcggcggcgctggcgcgtccccggttgaacagttcacctgaccagaacgggtaggcgtcgtgcgccagcgtggacggggtggagaaataggtcgagcgcaggtgactctgtgaggccatacctgatgccaccttacgcagtacctgaaaattcgggatccagaaaatctcgtcgacgtacaggtcgccgttatggctctgtgcggtgttggagttggtgccgagaaaaatcagttttgcgccgttattgcccaggacaatcgggtcaccggtcaggtcaacgtcaaccagccgggcaaaggcgatgatgtattcgcggaacacatacgcctgcgttttactggccgacagaaaaatctggttatggccggttttcagggcgcgcagcagcgcctcgcgggaaaaataaaacgtcgcaccaatctggcgggatttcaggatatcgcggatgcggtgctcaagcccggcgcgataccagtgcaactgatagtcgaaagactgctcaaagaaaatctgctccagcttttcgatggcctcgtcactgaaaaaattttttttcggtttgcgccgcccgcctttgttgcggttagcgacgttcggattaaggtctgcctcgttgccggtctggctgtaacgatttacccgtgccagtcgttcaatctggcgtcccagcaggtcaatttccttgaagtcaccgccggttttctgcggtttgataatgagctgggtcagccgcgcttccaggctcatttcgacacggctgatgggggcaacgttgtcccagccgtcgcgctgtttccagctctgcactgtcgggcgtttcatctgcaacatggcggcaatctgcggcacggaaaatccctgccagtacagcagcgccgcctgacgacgcgggtcgtgtaaaagagtggtgtctgtggtgatggtcatgaatacctcgccgtgatgaatacacggcaaggctactgagtcgcgccctgcgattcgctaaggtgctgttgtgtcagtgataagccatccgggactgatggcgtaggatgcgcatcgtcgggaaactgatgccgacatgtgactcctctaatcactattcaggactcctgacaatggcaaaaaaagtctcaaaattctttcgtatcggcgttgagggtgacacctgtgacgggcgtgtcatcagtgcgcaggatattcaggaaatggctgaaacctttgacccgcgtgtctacggttgccgcattaacctggaacatctgcgcggcatcctgcctgacggtatttttaaacgttatggcgatgtggccgaacttaaggccgaaaagattgacgatgattcggcgctgaaaggcaaatgggcgctgtttgcgaaaatcaccccgaccgatgaccttatcgcgatgaacaaggccgcgcagaaggtctacacctcaatggaaattcagccgaactttgccaacaccggcaaatgttatctggtgggtctggccgtcaccgatgacccggcaagcctcggcacggaatacctggaattctgccgcacggcaaaacacaaccccctgaaccgcttcaaattaagccctgaaaacctgatttcagtggcaacgcctgtttgagctggaatttgaagacctgcctgaaacagtgttcaccgcccctgaccgaaaaggtgaagtccatttttggccgcaaacaggccagcgatgatgcccgtctgaatgacgtgcatgaagcggtgaccgctgttgctgaacatgtgcaggaaaaactgagcgccactgagcagcgcctcgctgagatggaaaccgccttttccgcacttaagcaggaggtgactgacagggcggatgaaaccagccaggcattcacccgcctgaaaaacagtctcgaccacaccgaaagtctgacccagcagcgccgcagcaaggccactggtggtggcggtgacgccctgatgacgaactgctgaccggcgtcagtcagtccgggaaaaccttcacgattaacccttaatttcaggaaaaactatgcgccaggaaacccgctttaaatttaatgcttacctgtcccgtgttgccgaactgaacggcatcgacgccggtgatgtgtcgaaaaaattcaccgttgaaccgtcggtcacccagaccctgatgaacaccatgcaggagtcctctgactttctgacccgcatcaatattgtgccggtcagcgaaatgaaaggggaaaaaattggcatcggtgtcaccggctccatcgccagcaccaccgacaccgccggtggcaccgagcgtcagccgaaggacttctcgaagctggcgtcaaacaagtacgaatgcgaccagattaacttcgatttttatatccgctacaaaacgctggacctgtgggcgcgttatcaggatttccagctccgtatccgtaacgccattatcaagcgtcagtcccttgatttcatcatggccggttttaacggcgtgaagcgtgccgaaaactctgaccgcagcagtaatccgatgctgcaggatgtggcggtcggctggctgcagaaataccgcaatgaagccccggcgcgcgtgatgagcaaggtcactgacgaggaaggtcacacgacctctgaggtcatccgcgtgggtaagggcggtgattatgccagccttgatgcactggtgatggatgcgaccaacaacctgattgaaccgtggtatcaggaagaccctgaccttgtggtgattgtgggtcgtcagctactggcggacaagtatttccccatcgttaacaaggagcaggacaacagcgaaatgctggccgctgacgtcatcatcagccagaaacgcatcggtaacctgccggcggtacgcgtcccgtacttcccggcggatgcgatgctcatcacgaagctggaaaacctgtccatctactacatggatgacagccatcgccgcgtgattgtggaaaacccgaaactcgaccgcgtggagaactacgagtcaatgaacattgattacgtggtggaagactacgccgccggttgtctggtggaaaaaattaaggtcggtgatttctccacaccggctaaggcgaccgcagagccgggagcgtaaccgatgacgagtcccgcacagcgccacatgatgcgggtctcggcagcgatgaccacgcagcgggaagccgccccgctgcgacatgcaactgtctatgagcagatgctggtcaagctggccgcagaccagcgcacactgaaagcgatttattcaaaagagctgaaggccgcgaaaaagcgcgaactgctgccgttctggttgccgtgggtgaacggcgtgctggagcagggcaaaggcgcacaggatgacattctgatgacggtcatgctgtggcgtctggataccggcgatattgccggtgcgctggagattgcccgttatgccctgaaatacggtctgaccatgccgggtaaacaccgccgcaccccgccgtatatgttcaccgaggaggtcgcgctcgcggccatgcgcgcccacgcggccggtgagtctgtggatacccgcctgctgacggagacccttgaactgactgccgctgctgacatgcctgatgaagtgcgcgcaaagctgcacaaaatcaccggtctgtttctgcgtgacggtggtgatgccgccggtgcgctggctcacctgcaacgtgcgacacagctcgactgtcaggcaggcgtcaaaaaagagattgagcgactggagcgggagctgaaacctaagccggagccgcaacccaaagcggccacccgtgccacgcgtaagacccggagcgtgacaccggcaaaacgtggacgcccgaaaaagaaagccagttaacaaccgaatgcgccccgcgccagggcggcacgccggtcagtgagggtgaatcacctgacactgcaccggcgtccaccgcccgacttttcagaggtagtcatgatgacgctgattattccgcgaaaggaggctcccgtgtccggtgagggtacggtggtcatcccgcaaccggcaggcgacgagccggtgattaaaaacacgttcttttttcccgatatcgacccgaagcgcgtccgggaacgtatgcgccttgagcagaccgtcgcccccgcccgtctgcgtgaggccatcaagtcaggcatggcggaaacaaatgcggagctgtacgagtaccgcgaacagaaaattgccgccggttttacgcgtctggcggacgttccggcggacgacatcgacggtgaaagtatcaaagttttttactacgagcgcgccgtgtgtgcgatggcgaccgcgtcgctttatgagcgttatcgcggtgtggatgccagtgcgaaaggcgacaagaaggtcgacagcattgacagcaccattgatgagctgtggcgggatatgcgctgggcagtggcgcgcatccaggacaagccgcgctgcatcgtgagtcaaatctgatgaagacctttgcgctacagggcgacacgctcgatgccatctgtgtccggtattacgggcgcactgagggcgtggttgagaccgtgctcgccgcaaatccgggactggctgaactgggggcggtgctgccacatggcaccgccgtcgaactgcccgacgttcagaccgcgcccgtggctgaaactgtcaatctgtgggagtaacgcatgacagcagaagaaaaaagcgtcctgtcgcttttcatgattggggtgctgattgttgtcggcaaggtgcttgccggtggtgaacccatcaccccgcgtctgtttatcgggcgcatgttgctcggtggttttgtctcgatggttgccggtgttgttctggtgcagtttcctgacctgtcactgcctgcggtgtgcggtatcggctccatgctgggtatcgccggttatcaggtgattgagattgccattcagcgccgctttaagggcagggggaaaccgtaatgccggtaattaacacgcatcagaatatcgccgcctttctcgacatgctggccgtgtccgaagggacggcgaaccatccgctgacgaaaaaccggggctatgacgtgatagtcaccggactggacgggaagccggaaatcttcactgactacagtgaccacccgttcgcacatgaccgaccggcgaaggtgtttaaccatcgcggtgaaaaatccacggcctccggtcgctatcagcagctttacctgttctggccgcattaccgcaaacagcttgccctgcctgatttcagtccgttgtcacaggacagactcgccattcagttgatccgcgaacgcggtgcactggatgacatccgggcgggacgcattgagcgcgccatttcacgctgtcgcaatatctgggcgtccctgccgggtgccggttacggtcagcgtgagcattcactggaaaaactggtcaccgtctggcgtaccgctggcggcgtaccggcttaaacggagtaaacaccatgaagaaattatccctttcactgatgctgaacgtgtcgctggcgctgatgctggcactgtccctgatttatccgcagagcgtggccgtcagttttgtcgccgcccgggcgattctggcgacggttatctgtgtggttgccggtggtgtcggcgtgtatgccacagagtatgtactggaacgctacgggcgggagctgccgccggaatcgctggccgtgaagattgtcacgtcgctgtttttgcagccggtgccgtggcgcagacggtcggcggctctggtagtgatggtggcgacgtttatctcgctggttgccgccgggtggatttttaccgcgctgatttacctcgtggtgtcggtgttcttccggctgatacgtacggcctgccgtcagcgttttgaggggcgggaaccatgtcaaggctgatgattgtgctggttgtgttgttatcactggcggtggctggtctgtttatggtgaaacacaaaaatgccagcctgcgcgcctcgctggacagggcgaacaacgtcgccagcgggcagcagacgaccatcaccatgctgaaaaatcagcttcatgttgccctcaccagagcagacaaaaacgagctggcgcaggtggtactgcgtcaggaactggagaacgccgcgaagcgtgaagcacagcgcgagaaaaccatcacgaggttacttaatgaaaacgaagattttcgccgctggtacggcgctgacctgcctgatgctgtgcgccggttgcaccagcgccccgcctgcactgacgccagtgattgtccacaacgcctgcccgaaagtgagtctttgcccgatgccgggcagtgacccggagacgaacggcgatttaagtgctgatatccggcagcttgagaacgcgctggcacgctgtgccagccaggtaaaaatgattaaacactgtcaggacgaaaacgatgctcaaacccgacagcctgcgcagggcgctgactgataccgtcacggtgctgaaaactaaccccgatatgctgcggatattcgtggataacgggagtattgcctccacactggcggcgtcgctgtcattcgaaaagcgttacacgctcaatgtgattgtgaccgactttaccggtgattttgacctgctcatcgtgccggtgctggcgtggctgcgggaaaatcagcccgacatcatgaccaccgacgaaggccagaaaaagggcttcacgttttatgcggacatcaacaatgacagcagctttgatatcagtatcagcctgatgctgaccgagcgcacgctggtcagtgaggtggacggcgcgctgcatgtgaagaatatcccggaacccacgccgccggagccggtcacccgcccgatggagctttatatcaatggcgaactggtgagcaagtgggatgaatgagtttaagcgttttgaagaccggctgaccggactgactgaatcgctgtcaccgtcagggcgtcggcgactgagtgccgaactggcgaaacgtctgcggcagagtcagcagcgtcgggtgatggcacagaaagccccggacggcacaccctacgcaccacgccagcagcagagcgccagaaaaaagaccggtcgtgttaagcgaaaaatgtttgcgaaacttatcaccagtcgttttttgcatatccgcgccagcccggaacaggcatcaatggaattttacggcgggaagtcgccgaaaatcgccagtgtgcatcagttcggtctgtcggaagaaacccggaaagacggtaagaaaattgattatccggcgcgtcctctgctcggctttaccggtgaggatgtgcagatgattgaagagattatcctggctcacctcgaccgttagttgtgccattcccgacacctcatcgtcacattgccgccggtatgacccggcggcatccttcccgttatgaacactctcgcaaatatccaggaactcgcgcgcgcactgcgcaacatgattcgcaccggccttgtcgtcgaaaccaaccttaaagccggtcgctgccgtgtgcagaccggcggcatgtgcaccgactggcttcagtggctgacctgtcgtgccgggcgttcgcgcacatggtgggcaccttccgtgggggaacaggtgctgattctggccgtgggcggtgaactcgacacggcgttcgttctgccggggatttattccggcgataaccctgcaccgtctgcgtcggcggatgccctgcatatccgtttccctgacggggcggtgattgagtatgaacctgaaaccagtgcgctcacggtaagcggaattaaaacggccagcgtgacggcttctgattctgttactgccacggtgccggtggtcatggtgaaagcgtcaacccgcatcaccctggacacaccggaggtggtctgcaccaacaggctgattaccggcacgctggaagtacagaagggcgggacgatgcgcggcaacattgaacacaccggcggtgaactctcatcaaacggtaaggtactgcatacccataaacaccccggcgacagcggcggcacaaccgggggacctctatgactgcgcgttatctcggaatgaatcgcagtgatggcctgactgtcactgaccttgagcatatcagccagagtatcggcgatatcctgcgcacaccggtcggctcgcgggtgatgcgtcgtgattacggctcgttgctggcgtcaatgattgaccagccgcagaccccggcgcttgagttgcagattaaggtcgcctgttacatggcggtgctgaaatgggaaccccgcgtcaccctgtcatccgtcaccactgagcgcagttttgacgggcgaatgacagttacgttaaccggccagcacaacgacaccggccagccactttcgttaaccatccctgtgagttgaaaccatgccgattatcgacctgaaccagctacccgcaccggatgtggtcgaggagctggactttgaaaccattcttgctgaacgcaaggcgacactgatttccctttacccggaagaccagcaggaggcggtcgcccgtaccctgacgctggaatccgaacctctcgtcaaactgctggaggaaaatgcttatcgtgagcttatctggcgtcagcgtgtgaatgaggccgcacgggcggtgatgctggcctgtgcagccggtaatgaccttgatgtgattggtgccaattacaacaccacgcgcctgactatcaccccggcagatgattcgaccattccgccgacaccggcagtgatggagtctgacaccgattatcgtctgcgtattcagcaggcgtttgagggcttaagcgtcgccgggtcggtgggtgcctatcagtatcatggtcgcagtgccgacgggcgtgtcgcggatatctctgtcaccagtccgtctccggcctgcgtcaccatctctgtgctgtcacgtgaaaataacggtgtcgcatccgaagacctgctggccgtggtgcgtaacgcccttaatggtgaggacgtcaggccggtggctgaccgtgtgaccgtgcagtctgccgccattgttgaataccagataaacgccacgctttacctttaccctggtcccgaaagcgaacccatccgcgcggccgccgtgaaaaagctggaagcgtacatcacggcacagcaccggctggggcgcgacatccgtctgtctgccatttatgccgctttgcatgtggaaggcgtgcagcgtgtcgagctggcggcaccactggccgacatcgtgctcaacagtacgcaggcgtctttctgtaccgaataccgcgtcgtgaccggaggctcggatgagtgattcgcgactgctgccgaccggctcatcaccgcttgaagtcgccgctgcaaaagcctgtgcggaaattgaaaaaacgccggtcagtattcgtgagctgtggaacccggacacctgcccggcaaatctgctgccgtggctggcgtgggcgttttcggtcgacagatgggatgaaaagtggccggaagcgaccaaacgcgccgttatacgcgatgcctatttcatccactgtcataaaggcactataggtgcaatccggcgtgtggtggagccgctgggctatctcatcaacgtgacggagtggtgggaaaccagtgacccgcccggcaccttccggcttgatattggtgtactggaaagcggtatcacagaggcaatgtatcaggaaatggaacggctgattgctgatgccaaacctgcaagccgtcaccttattggcctgaacattatccaggacattcccggctgtctgtatacaggcggtgtggtctgtgatggtgatgttattactgtttatcccggataagtgagaaacaatgagcacgaaatttaaaaccgttatcactactgccggagccgcaaagctggcagccgccactgtccccggcgggaaaaaagtaaacctgtctgcaatggccgtgggtgacggtaatggcaaattgccggtgccggatgccggtcagacgaaactggtgcatgaggtctggcgtcacgctctgaataaagtcagcgtggataacaagaataaaaactatatcgtggctgaactggttgtaccgccagaagtgggcggcttctggatgcgtgaacttggtctgtatgacgatgccggaacactgattgcggtatccaacatggcagaaagctataagccagaactggctgaaggctccggacgtgcgcagacctgccgcatggttattattctcagcaacgtggcgtccgttgagctgagtattgatgccagcacggtgatggcgacgcaggattacgtcgatgacaaaatcgcagagcatgagcagtcccgccgccatcctgacgccacgctgacagaaaaaggttttactcagttaagcagtgcaacaaacagcaccagtgaaaagctggcggcaacgccaaaagcggtcaaggcagcaaatgacaacgcaaattcacgtctggcgaaaaatcagaacggtgcagatatccaggataaatcagcttttctggacaatattggcgttaccagcctgacgtttatgaaacacaatggaatgattccaaccactgacaatcttgactcctatggcccagaagaaaaatatcttggaacgtggtcatgtccgtcacaatccactgcaaaaccagagtctggttaccctgaagataaaggcaatggggttctggaagtattcaatgctggtcgctttcactgcacacaacgctacaccacccgaaccggtaatatttacattcggatgcttgatgcagaatggaacccagccagtccaacatggagtgcatggagagttattacaagcgggactcgaccattaagcacgtcaattgacctgaattctttaggtggcgcggaacacctgggaatatggcgcaatagcagtacatcaatagcctcatttgaacgtcatttcccggaggacgggagctttggtcagggtattctggaagtctttgaaggcggtctgtatgggagaatgcaacgttacaccacccgtagtgggactatgtacattcgcggactgactgcctcatgggatgcagagaatccacaatgggaggactggattgctgttgggtatcagtccacgggatggacttattcaggggatcttgatgaccttttaaagcctggtatttatagcgtcacgaaacaggccacaaacgcaccagtcaccgactctaaagatcttgctgttggctcaatagttgaagtgaaaaaacgttgtgatattgaatcgtatatccagacatatacgacagtttctgcaacggatgcctataaaaaccggacatttcaacgaactcgtgccagcggtgaagctgactggggggaatgggcggaagtttacaactcaaaatcattactcactaaattaggtgtcggcggtgttaccgacaggttatccagtctggactggcagacctacgactttgtgccgggcagcatgataactgtcagactctccgatatgaccaatatccccgatgggatggaatggggcgtcattgatactaacctgataaatatcactgttggccccagtgaaggtggaggtgtcgcccgttcaatgcaggtatggcgcagcacctcaaacaaaaccaactatcgtttttttacagtccgcttatatggcaatcctggggagcgtagcttcaatattcgtcggctaccaattatcgacgaagcccagacatgggaggcaaaacagacattcagtgcaggcctctctggtgaactgtccggcaatgcggcgacagcaacaaagctgaaaacagcccgtaaaattaataacgtttcgtttgatggaacatcagatattaacctgacgccgaaaaatattggtgcatttgcttcaggaaaaacaggagacaccgttgcgaatgataaagccgttggatggaactggagtagcggagcctataacgcaactactggtggggcatcaacgttaattcttcattttaatatcggtgaaggaagttgtcccgcagcccagttccgcgttaattataagaacggcggtattttttatcgttctgctcgtgatggttacggattcgaggctgactggtctgagttttataccacaacgcgaaaacctacagcgggagatgtcggtgcactgtcgttatctggtggtcaattgaatggtgcactgggcatcggaacatccagtgctcttggcggtaattcgattgttttgggtgataatgacacgggctttaaacaaaatggtgatggtaatctggatgtttatgctaatagcgtccatgttatgcgctttgtctccggaagcattcaaagtaataaaaccataaatattacggggcgtgttaatccttcggattacggtaactttgattcccgctatgtgagagatgtcagacttggcactcgtgttgttcagaccatgcagaaaggggtgatgtatgagaaagcagggcacgtaattacagggcttggtattgtcggtgaagtcgatggtgatgaccccgcagtattcagaccaatacaaaaatacatcaatggcacatggtataacgttgcacaggtgtaatttatgcagcatttaaaaaatattactgcgggtaatccaaaaactgttgcccaatatcaactgacaaaaaattttgatgttatctggttatggtccgaagagggaaaaaactggtatgaggaagtaagtaattttcaggaagacacgataaagattgtttacgacgagaataatataattgtcggcatcaccagagatgcttcaacgcttaaccctgaaggttttagcgttgtcgaggttcctgatattaccgccaaccgacgtgctgatgactcaggtaaatggatgtttaaggatggtgctgtgattaagcggatttatacggcagacgaacagctgcaactggcggaattacagaagtcagctttgctttccgaagctgaaactatcattcagccactggaacgctctgtcagactgaatatggcaacagatgaggagcgtagccgactggaagcatgggaacgctacagtgttctggtcagccgtgtggatcctgcaaatcctgaatggccggaaatgccgcaataagttgtatgatctctggagtgagctaacgtatctatagcacagagtaaagcctaatctgacagtctgctctgtgctaggagcggactgacctgctccccgatgattaatacacagctatgctagtaatgtccgtagatcgctgtgtgttgcatccatcggttgaactcacagtccaaaccagactgtcagctttgattagattctacctactcaacctgtcagataaggtctgagctaatacatctaatatatggctttgtgcaggggacggctatcgcgaacgttaggccaggtatctgaatacgcacagttcacttggttgtacttcttgcactgatctgctatcccgcacagctatttataggtaatcttcagtgtataatctgccaacttatggaagcttgtacaacaggagaaatatatgaaaaaagaattgtttggacgttgcccgtttgatcttgacgaagatgtaaaaaaaatagccgcgataaataaatatatccatgcaaaatttgaggagcataaaaataaaatagacaacctaaagggtgtggaacaaaaattgatggtcttacagtactttaatgtactgaatgaacttagtaatcaggctatctcttctttgaatataggagccttttcagcatcggaagtattagctagggttataatagaacaggctgccaatcaattttatatagcaatagatgatggcgaaaatgcacaagcattactcaaggctagtaagaaattagttcatagtaatggaaaacggtggctggagtgtttaaaatccaaaggaatgactaatccagcagcaaatgaaaggattcgcatgggaaaagaactaactgatctatttaatagattgtggccaaatacacctgaatatccaggaaccagaaaactttttgaattaattggctgggaaacacactatcatgcccattacgttcccctttgtgattcaatacatacattctctgatgatatggtaaatatagtatctctatataatgcaatccaaagtgatgaaactactgctatcgaattcattcttgcagttaaacaagaaaataaacggctggcaatttataattttgtaattgctacggcccttcggtgtgaggccttagtaaatgtatttaactctttaggttatcaggatattataacagaaatgacaccaacaatagatacagtcaaccagactataattcgatatgatgattttgatcattccagaattgatgattgtcaataattaattgacagaatacgtacatgcgcaacaactagtgatagttgacttattttcgctcttgagagacaaccatactcaaatctcccacattgcaggagatttgaatatgaaaacatcaccgtggaataaagaccgtaccatcggtcaaaaaaggccacttcagatatctcatatctgggggatccggattagacttgagttggaaggtaaataaattgtcagtcggaaaataagtgagtacaaatcagggcaggtgagcgaattgcccgccttttctttaccggtggttgtgctgtcgattagccaaccgggacaaatagcctgacatctccggcacaactgaaaataccactcacccattaaccacggagttaaacggatgagcgactatcatcatggcgtgcaggtgctggagattaacgacggcacccgcgtcatttccaccgtatccaccgccattgtcggcatggtctgcacggccagcgatgcggatgcggaaatcttccccctcaataaaccggtgctgatcaccaatgtgcagagcgcaattgcaaaggccggtaaaaaaggcacgctggcggcatcgttgcaggccatcgctgaccagtcaaaaccggtcaccgttgtcgtgcgcgtggaagacggaaccggcgacgacgaagaaacgaaactcgcgcagaccgtttccaatattatcggcaccactgacgaaaacggtcagtacaccggactgaaagccctgctggcggcggagtcggtaaccggtgttaaaccgcgcattctcggtgtgccgggactggacaccaaagaggtggctgttgcactggcatcagtctgtcagaagctgcgcgctttcgggtatatcagcgcatggggctgtaaaaccatttccgaggtgaaagcctaccgtcagaatttcagccagcgtgagctgatggtcatctggccggatttcctcgcatgggatacggtcaccagtaccaccgccaccgcgtatgctaccgcccgtgcactgggcttgcgcgctaaaatcgaccaggagcagggctggcataaaacactgtccaacgtcggggtgaacggtgttaccggcatcagcgcatctgtattctgggatttgcaggagtccggcactgatgctgacctgcttaacgagtcaggcgtcacaacgctgattcgccgtgatggtttccgcttctggggtaaccgtacctgctctgatgacccgctgttcctctttgaaaactacacccgcaccgcgcaggtgctggccgacacgatggctgaggcgcacatgtgggcggtggacaagcccatcaccgcaacgctgattcgcgacatcgttgacggcatcaatgccaaattccgtgagctgaaaacaaacggctatatcgtggatgcgacctgctggttcagcgaagaatccaacgatgcggaaaccctcaaggccggaaaactgtatatcgactacgactatacaccggtgcctcctctcgaaaacctgaccctgcgccagcgtattaccgataaatacctggcaaatctggtcacctcggttaacagcaattaaggagcctgaccgatggcaatgccgcgcaaactcaagttaatgaacgtctttctgaacggctacagctatcagggcgttgcaaagtccgtcacgctgccaaaactgacccgtaagctcgaaaactatcgcggtgcggggatgaacggcagcgcaccggtagacctcggccttgatgacgatgcgctgtcaatggagtggtctctcgggggcttcccggattcggttatctgggagctttacgccgcaaccggtgtggatgccgtgccgattcgttttgccggttcttaccagcgcgacgataccggcgaaacggtggccgtcgaggtggtcatgcgtggacgtcagaaagaaatcgacaccggcgaggggaaacagggagaagacaccgagtcgaaaatctccgtggtctgtacctatttccggctgacgatggacggtaaggagttggtcgaaattgacaccatcaacatgattgagaaggtgaacggcgtcgaccggctggagcaacaccgccgcaatatcggcctgtgattttcatccggtcagccgggctgaccggttaaccccgattcataagtgagaaaaccatgaacaaagaaaatgtgattaccctggacaatccggtcaagcgtggtgagcaggttatcgaacaggtcacgctgatgaaacccaatgccgggacgctgcgcggtgtcagtctggctgcggtcgcaaattccgaagtcgatgcactgattaaagtgctgccgcgcatgacggcaccgatgctgaccgagcaggaggtcgccgcgctggaactgcctgaccttgtggcgctggccggtaaggtggtcggttttttgtcgccgaactcggtgcagtaacgtttccgaaaaatctctcggtcgatgacctgatggcggatgtggcagtgatatttcactggccgccatcagaactgtatcccatgagcctgaccgaactcatcacatggcgcgaaaaggcgctccggcgaagcggaaacacgaatgagtaacaatgtaaaattacaggtattgctcagggctgttgaccaggcatcccgcccgtttaaatccatccgcacagcgagcaaatcgctgtcgggggatatccgggacacacaaaaatcactgcgcgagctgaacggtcacgcatcccgtattgagggatttcgcaagaccagtgcacagctcgccgtgactggtcaggaactgaaaaaagccagacaggaagccgcagctctggctgtccagtttaaaaatactgaacgaccgacaaatgcacaggcaaaggcaatggaagccgcgcgtaaaaatgcgtctgagttacaggcgaaatataacagcctgagattgtcggtacagcgccagcgtcaggaattgagtcaggcgggtattaatacccgtaatctggcgcatgatgaacgagggctgaaaaaccgtatcagtgaaaccaccgcacagcttaaccgtcagcgtgacgcgctggcacgtgtcagtgcacaacaggcaaaacttaacgcagtcaaacagcgttatcaggccggaaaggaactggccggaaatatggcctcggtgggcgctgccggtgtggggattgcggcggcgggaacgatggccggagttaagttgctgatgcccggttatgagtttgcgcagaaaaactcagaattgcaggccgtgctcggagtggcaaaagactccgccgaaatggccgcgctccgcaagcaggcgcgccagctcggcgataataccgccgcctcggcggatgatgcggccggtgcgcagattatcattgcgaaagcgggtggagatgctgcggctattcaggcggcaacgccggtcacgctgaatatggcactggcgaatcagcggtcgatggaagaaaacgcgcaactgttactggggactaaggcatcctttcaactgtcaaatgatgatgtcagccatgtgggcgacgtgttgtcggcaacgatgaataagtcggcggctgattttcagggactcagtgatgcactgacttacctcgggccggttgcgaggacggcaggtgtaagtcttgagcaggcagcggccatgacaggtgtgctgcatgacaataacatcagggggtcaatggcgggtacgggtagcagtgccgttgtcacccgattacaggcaccgactggaaaagcatgggatgcactcaaagagcttggcgttaaaacctcggacaaaaagggaaatatgcgtccgttgttcaccattctgaaagagattcaggccagctttgataaacacaagctgggaacgtctcagaagggggaataccttaaaaccatttttggtgaggaagccctgaaatcagcgaacgttttactggcagcggcagcaagcggaaaactggatacgctgaccgccacgctgaaagcctcggacggtaaaacggaagagctggttaaaatcatgcaggataacctcggcggtgactttaaggagtttcagtccgcttatgaggcggtggggactgacctgtttgaccagcaagaaggcacactgcgtaagctcacgcagacggccacaaagtatgtgttaaaactcgacggctggatacagaaaaacaaatcactggcgtcaaccattggcctcattgccggtggcgcactggcgctgactggtgtcatcggtgccattggccttgtagcctggccggttatcaccggcatcaatgccattatcgcggcagcaggcgcaatgggggcaatcttcacgacggttggtagtgccgttatgacggccatcggtgtgattagctggccggttgtggccgtggtggctgccattgtcgccggggcgttgcttatccgtaaatactgggagcctgtcagcgcattctttggcggtgtggttgaagggctgaaagcggcatttgcgccggtgggggagctgttcacgccacttaagccggtgtttgactggctgggcgaaaagttacaggccgcgtggcagtggtttaaaaacctgattgcaccggtcaaagccacccaggacaccctgaaccgttgccgtgacacgggcgtcatgttcgggcaggcactggctgacgcgctgatgctgccgcttaatgcgttcaacaaattacgcagcggcattgactgggtactggaaaagctcggggtcatcaacaaagagtcagacacacttgaccagaccgccgccagaactcatgccgccacgtatggcaccggtggttatattccggcgaccagctcttatgcaggctatcaggcttatcagccggtcacggcaccggctggccgctcttatgtggaccagagtaaaaacgaatatcacatcagcctgacgggtggtactgcaccggggacacagcttgaccgccagttacaggatgcgctcgaaaaatacgagcgggataaacgtgcgcgcgcccgtgccagcatgatgcatgacggttaaggaggtgacgaaaaatgatgctcgcgttaggtatgtttgtttttatgcgccagacgctgccacaccagaccatgcagcgtgaatcagattatcgctggccgtcaaattcccgtatcggtaaacgggatgcctaccagtttctcggcgttggtgaggaaaacatgacgcttgccggtgtgctttatcccgaactgaccggcggcaagctgacgatgaccacgctcagactgatggcagaggaaggccgggcgtggccgttgctggatggtaccggcatgatttacggcatgtatgtcatcagcagggtgagtgaaacagggagtattttctttgcagacggcacaccccggaaaattgattttacgctgtcgctcacccgcgttgatgaatcactggccgcgctttatggcgatatcagtaaacaggcggagtcgctcatcggtaaggctggcagtatggcgaccagattcacaggtatgacgggggcgggataatgctggatacgctgacatttgatgcaggcagtacgctgacgccggattacatgctgatgctcgacagcagggatattaccggcaatatcagcgaccgtctgatgagtatgaccctgacggataaccggggctttgaggctgaccagcttgatattgaactgaacgatgccgacgggcaggtcgggctgccggttcgtggcgctgtcctgacggtgtatatcggctggaaaggttttgccctggtatgcaaagggaaatttaccgttgatgaggttgaacaccggggcgcaccggatgtggtcaccatccgcgcacggagtgcagattttcgcgggacgctcaattcccgccgtgaaggctcctggcatgacaccacgctcggtgcaattgttgaggcgatagccacccgtaacaggctggaagccagtgtcgctccgtcactggccggaattaaaattccgcacatcgaccagtcgcaggagtctgatgcgaaattcctgacccgtcttgcagaacgcaacggcggtgaggtctcggtaaaaatgggaaaactgttgtttctcaaagcggggcagggggtgacggccagcggtaaaaaaatcccgcaggtcaccataacccgcagcgacggcgaccgccaccattttgcgattgctgaccgtggagcctataccggcgtaacggcaaagtggcttcacaccaaagacccgaagccgcaaaagcagaaggtaaaactgaaacgcaaaaagaaagaaaaacacctgcgcgcactggagcacccgaaagcgaaaccagtcacgcagaagaaagcgccaaaagcgccggaagcgcgcgaaggtgaatacatggccggtgaggctgacaatgtttttgccctgaccacggtatatgccacgaaagcgcaggccatgcgcgccgctcaggcgaagtgggataaactgcaacggggcgttgcggagttctccatcagcctggctaccggtcgggcagatatttacacggaaacaccggttaaggtgtcaggctttaagcgcgtcatagacgagcaggactggacaatcactaaggtgacacattttctgaataatagcggcttcacgacgtccttagagcttgaggtcaggctttctgatgtggagtacgaaacagaagatgatgagtgacgtttttattttatctatttgttttataaggataaattaactaaaatggcaccatcaacaaaaccggaagaggtgctcgcgatgtttcattgtcctttatgccagcatgccgcacatgcgcgtacaagccgctatatcactgacacgacaaaagagcgttatcaccagtgtcagaacgtgaattgcagcgccacgttcatcacttatgagtcggtacagcgatacattgtgaagccgggagaagtccatgccgtgaggccgcacccgttgccgtcagggcagcaaattatgtggatgtaattagaaacaggaagcccctcagtcgaggggctttttttgtcgatgtggtcaatgtgtggacgtgaccagaaataaatccttttatttcatgcgattagatatcaaaaaatgtcaccaataactgacattgcggtgtttctccagatgtggcccatctgaggccgtgttggtgcgcagctcgaaggctacgtcgagtctgttttggcagtcaccttaaagtatagatagctgacaaaaaaggctctcgtgctaaaaaaggccccactttcgtggagcctttattgtacgctttttactgtacgatttcagtcaaatctaattacatagattgagtgaaggtacgagtaataacgtcctgctgctgttctttagtcagcgagttgaaacgtactgcgtagccagatacacggatggtcagctgcggatatttttccgggttttccatcgcgtcgagcagcatttcacggttcatcacgttaacgttcaggtgctgaccaccttcgatggatgcttcgtggtggaagtaaccatccatcagaccagccaggttggtcttacgaacttcgtcgtctttacccagtgcgttcggaacgatagagaaggtgtaggagataccatctttagcgtaagcaaacggcagtttagcaacggaagtcagagacgctacagcacctttctggtcacgaccgtgcatcgggttagcacccggtccgaacggcgcgccagcacgacgaccgtctggggtgttaccagttttcttaccatacacaacgttagaagtgatggtcagaacagactgagtcgggatagcgtcacggtaggtgtgcagtttctgaattttcttcatgaaacgttctaccaggtcaacagccaggtcatctacacgcggatcgttgttaccaaactgcgggtattcgccttcgatttcgaagtcgatagccagaccgtcttcgtcacgaatcggtttaactttcgcatatttgattgcagacagggagtcagcagcaacggacagaccagcgataccacacgccatggtgcggataacgtcacggtcgtgcagcgccatcagagaggcttcgtagctgtacttgtcgtgcatgtagtggatgatgttcagtgcagtgatgtactgtttagccagccagtccatgaagtgatccatgcgctccatcacttcatcatagttcaggacatcgcctttgatcggttcagacttcggaccaacctgcattttcagtttttcgtcaacgccgccgttgattgcgtacagcatggttttcgccaggtttgcacgcgcaccgaagaactgcatttgtttaccaacgatcatcgggcttacgcagcaagcaatagcgtagtcatcgttgttgaagtccggacgcatcaggtcatcgttctcatactgcagagaagaggtgtcgatggacactttagcggcgaatttcttgaagttcagcggcagtttttcagaccacagaatggtcatgttcggttccggagacggacccatggtgtacagggtgttcaggaaacggaagctgtttttggtaaccagggtacgaccgtcgaggcccataccaccgatagattcggttgcccagatcgggtcgccagagaacagttcatcgtattccggagtacgcaggaagcgaaccatacgcagtttcatgaccaggtggtcaaccatttcctgcgcttcttgttcggtgatcttgccagctttcaggtcacgttcgatgtacacatccaggaaggtggaggtacgaccgaaggacattgcagcaccgttctgagacttaacagcagccaggtagccgaagtaagtccactggatagcttcctgagcgttggtagccggaccagagatgtcgtagccgtatttcgcagccatttctttcatctgacccagagcgcggtgctgttcagcgatttcttcgcgcagacggatagtctgttccaggtttacgccgttttccagatcagcctgcagagaggtgaactgtgcaagtttgtctttcatcaggtagtcgataccgtacagcgcaacgcgacggtagtcaccgatgatacgaccacggccataagcatctggcagaccggtcagaacaccggatttacggcaacgcaggatgtccggagtgtaaacgtcgaacacgccctggttgtgagttttacggtattcagtgaagatttttttgatcatcgggtccagttcgcggttgtacgctttgcaggaaccttcgatcattttgataccaccgaacgggataagagcacgtttcagcggagcttcagtctgcagaccaacgattttctcaagctgcttgttgatgtaaccagcgtcgtgagaggtgatggtggaagcaacagcggtgtcaaagtcaactggcgcgtgagtgcggttttccagtttaacgccttccattactttgtcccacagggtggtggtcgcttcagtagcgccagccaggaaggactcgtcaccctcgtacggagtgtagtttttctgaatgaagtcacggacgtttacttcattctgccagtcacctttggtaaaaccttcccaggctgtggctaacttttcattaagctcggacatgtaacacctaccttcttaagtggattttttatttactgcgtacttcgacaaccattaatggtgatcgttttcacgcaggtaaatgacccagtatgtcaacccaaccaacaaaccaccgccgataatattaccgatcgtaaccggaatcaggttatcagtgatgaaattcatcacggtcaggtgagaaaaattttccggtgcagaaccgacagcggtccagaattccggagatgcgaagtcgcggattacaatacccatcgggatcataaacatgtttgcgatactgtgctcaaaaccgctggcaacaaacatcgcgaccggcagcaccataatgaacgctttgtccatcaggctgcggccagaataactcatccatactgccagacataccatcaggttcgccaggataccaagacagacggcctcaataaaagtatggtgcactttgtggtcggcggtttgtaggacgtttagtccccattgaccatttgcggtcatatactcgccggaaagccacattaaaagtacaaacagcagtgcgccgaccaggttgccaaaataaacatttagccagtttttcgccaactgaccccaggtgatgcgcccactcgccttggcaacaacaatcaacactgtggaagtaaagagatcggctccgcagacaacacaaagaatcaaccccagagagaagcaaatgccgccaaccagttttgccatgccgaagggcattgtacctgtgccagtggttgctgtgatatagaagacgaatgcgattgagatgaaaacaccggcggtaatcgccagatagaaagtcttaagcggatgtttcgttgctttatagacacctgcctcttcggccactttggccattgcagcaggaagtaaaagatcaaaagggttgtcagctttcacactaactctctctttattaagtcggcgacgagatactaacaaagcattatagatgagaaattgatatagatcatatctcgcctggcttataggcccgtaactcgcatggtttttatgcaaatacggagtaaatatttgattatccaaataaaaataaattttaaaaattaacaaatgagttgaattttttccgcatcctccgctaaaacagttaattaaaagggagcacctggcgaataaagtaacaatatcgatcgtatttattaaatacaaattaccgatatttaaccttataattacaattattttattaatgcaaatatatgtaaagcggggcattaaaaaaacgccccgtaatataactcagacgaatcattaagcctacattgcgtaggctatttgattttattttgcccagaatgctgctttggcgcgctgcagcttttcgtaggccttcaacaacgactgatgtgcagcaaacgcgtgcagatcgctatctactggttgcaagccataaaacgccgcttcgccgctcattgccgcactggcggcttccacggcatctgcgccgtacatgcgaacaaacgcattcagatattgcagcggctggcgatcttcttcctgcgccagtaataacaacgtttgcaggcagcgataataattggcgcgttccgggctgaatactgatgagttaaactccatcgtccattcggcccagaccagagcctgttccagatcgccaccagccagcgccagcatggcttttaattcaccgatacgcagagtgtaccagccgttatccgacccggtcgccagacccaacagttcacgcacgcgggtaaagtcatcaaaaccttcttcatccagttgctcgatgaggttcaggtaatcttccttttcccactcgctacctggtagcgaaagaatcgtttcacgtaaatggctgcccatactgttattcgccagccacagatcttcagccggataaatatcggacatgccaggcacgataatacggcaagcgtagacacccagatgctcgtaatcggcaatataaacttctttatcttcctttttgaagatagccatcagcgtggcgaactcttcttccgtggtgccggagaagctccagtcaacaaacggataatcggcatcctgcttgaacaggtcccaggagattaaaccgctggaatcgataaagtgcgtttcgaggttggtatgttcagcgacttcttcatcatcgaaggttggtggagtaaacacatccagatcttttaggccacgaccttgcagcagctcggtcacggtacgttccagtgcaacgccaaaatcaggatgcgcaccgaatgaggcaaagcaggtaccgttagcaggattgaacagtaccacgcaaatcaccggatactggccgccaagcgaaccgtcataagcgaagatcgggaaatcttccgcttccagcgtttcgatcgcttcaactactgctggataacgtgccagcacgtctgccgggatttccggcaagctgatgctttcagcaataatgcggtttttcacgtaacgttcgaaaacttcagacaatccctgaacgcgtgcttcgttacgggtattgccagcagacataccgttagaaacgtacaagttaccaatgatattcatcggaatataaatggtctgattgtcggactggcgcgtaaacggtagaccgcaaataccacgatcttcgttaccggattgcaggtcaatcagcatactaccggtcagttcattctccggatcgtaaaatgcgcgcagacggtcatcgagcagcccttctggtacatcgtcattttcggtcagtgggaaccatttttcgttgggataatgcacgaatgggccgttggcgatggtttcgcccagccagaagtccgcaaaaaagtagttggttgagagacgctcgaaatattcaccgagggcagaagccagcgccgcttttttggttgcgcctttaccgttggtaaaacacagtgcgcactctttgtcgcgaatatgtacagaccagacgttaggcacgggattcagccaggaggcctcttcaatctgaaaaccgaggtctgaaagtttttgctggaagcgtgcgatggaatcttccagagcggcatctttgccggggataaatgtttgcgtcatgaaaatcactttagtcgtacggaaagcgcgcaataatacgggttttatctcaaaggtgctatcaccgccgccacgctgatgaactgttagctatgcttttagcggattaactacgataagagcataaaaatgaaggcgtttgatctccaccgtatagcattcgataaagtgccttttgatttccttggcgaagttgcactacgtagtctttatacctttgtactggtctttttgttcctcaaaatgaccggaagacgcggtgtgcggcagatgtcgctgtttgaagtgttaatcattctgacactgggttcagcggcgggagatgtggcgttttatgatgatgtgccgatggtcccggtacttatcgtctttattactctggcgttgttataccgcctggtaatgtggttgatggcgcacagtgaaaaactggaagatcttctggaaggcaagccggttgtcattattgaagatggcgagctggcctggtcgaaactcaataactccaacatgacggaatttgagttctttatggagctacgattgcgcggtgtagagcagttggggcaggtacgtctggcgattctcgaaaccaacgggcaaatcagtgtttatttctttgaagatgacaaggtgaaaccgggattacttattttacccagtgactgtactcagcgttacaaagtggtgccggagtcggcggactatgcctgcatccgttgcagtgaaatcattcatatgaacgcgggggaaaaacaattatgtccgcgctgtgcaaatccagaatggacgaaggcaagtcgagctaaacgggtgacctgacagcaaaaacatcggctttttgctaataatccgagagattcttttgtgtgatgcaagccacatttttgccctcaacggttttactcattgcgatgtgtgtcactgaatgataaaaccgatagccactggaataatgtattacctgtggtcgcaatcgattgaccgcgggttaatagcaacgcaacgtggtgaggggaaatggctcaaatcttcaattttagttctggtccggcaatgctaccggcagaggtgcttgaacaggctcaacaggaactgcgcgactggaacggtcttggtacgtcggtgatggaagtgagtcaccgtggcaaagagttcattcaggttgcagaggaagccgagaaggattttcgcgatcttcttaacgtcccctccaactacaaggtattgttctgccatggcggtggtcgcggtcaatttgctgctgtaccgctgaatattcttggtgataaaaccactgcagattatgttgatgcgggttactgggcagcaagtgctatcaaagaagcgaaaaaatactgcacaccaaatgtgtttgatgcgaaagtgaccgttgatggtcttcgcgcagttaagccaatgagtgaatggcaactctctgataatgctgcttatatgcattactgcccgaacgaaaccattgacggtatcgctatcgatgaaacaccagacttcggtaaagacgtggtggtcgccgctgacttctcttcaaccattctttcccgtccgattgatgtcagccgttatggtgtaatttacgctggcgcgcagaaaaatatcggcccggctggcctgacaatcgtcatcgttcgtgaagatttgctgggcaaagcgaatatcgcctgcccatcgattctggattactccatcctcaacgataacgattccatgttcaacacgccgccgacatttgcctggtacttatctggcctggtcttcaaatggctgaaagcgaacggcggtgtggctgcaatggataagatcaatcagcaaaaagcagaactgctgtatggggtgattgataacagcgatttctaccgcaatgatgtggcgaaagctaaccgttcgcggatgaacgtgccgttccagttggcggatagcgcgcttgataaattgttcctcgaagagtctttcgctgcgggcttacatgcgctgaaaggtcaccgagtggtcggcggaatgcgtgcgtctatttataacgccatgccgctggaaggtgttaaagcactgacagacttcatggttgagttcgaacgtcgtcacggctaatgtcgaaattttgcataatccccacagccagcctgtggggtttttatttctgttgtagagagttgagttcatggaatccctaacgttacaacccatcgctcgtgtcgatggcactattaatctgcccggttccaagagcgtttctaaccgcgctttattgctggcggcattagcacacggcaaaacagtattaaccaatctgctggatagcgatgacgtgcgccatatgctgaatgcattaacagcgttaggggtaagctatacgctttcagccgatcgtacgcgttgcgaaattatcggtaacggtggtccattacacgcagaaagtgcccgggagttgttcctcggtaacgccggaacggcaatgcgtccgctggcggcagcactttgcctgggtagcaatgatattgtactgaccggtgaaccgcgaatgaaagaacgcccgattggtcatctggtggatgcgctgcgccagggcggggcgaagatcacttacctggaacaagaaaattatccgccattgcgtttacagggcggctttactggcggcaacgttgatgttgatggctccgtttccagccagttcctcaccgcactgttaatgactgcgcctcttgcgccggaagatacggtgattcgtattaaaggcgatctggtttctaaaccttatatcgatatcaccctcaatctgatgaagacgtttggtgttgaaattgaaaatcagcactatcaacaatttgtcgtaaaaggggggcagtcttaccagtctccgggcacttatttggttgaaggcgatgcatcttcggcttcttatttcctggcagcagcagcaatcagaggcggcactgtaaaagtgaccggcattggacgcaacagtatgcagggtgatattcgctttgctgatgttctggaaaaaatgggcgcgaccatttgctggggcgatgattatatttcctgcacgcgtggtgaactgaacgccattgatatggatatgaaccatattcccgatgcggcgatgaccattgccaccgcggcgttatttgcaaaaggcaccaccacgctgcgcaatatctataactggcgtgttaaagagaccgatcgcctgtttgcgatggcaacagaactgcgtaaagtcggtgcggaagtcgaagaggggcatgatttcattcgcattacgccaccggaaaaactgaaatttgctgagatcgccacttataatgatcaccggatggcgatgtgtttctcgctggtcgcattatcagatacgcctgtgacgattcttgatccaaaatgtaccgctaaaacttttccagactatttcgagcaattggcgcggataagtcaacccggctgaatgaataacgggcgataacatagacaatcctttcttttcaaagacgtcggcacattgccggcgttttttttcggaccttgtggggtatttttattaatggtagcgttaattatcaatgtaacttgttgatacataatgtttatatataattaatcaacggatgattcacatgaagaatactaaattattgctggcgattgcgacctctgcagccttactgacaggatgtcagaatacgcacggtattaataccgatttggctatcagctcaggtctgaatgcttataaagccgcaacattaagcgatgctgatgctaaagcaatcgccaatcagggctgtgtcgaaatggacagcggcaataaagtggcaagcaaatccagcaagtacgggaaacgtctggcaaaaatcgccaaagcattgggtaacaatattaatggcacgccagtcaactataaggtttatatgaccagcgacgtcaacgcatgggcgatggcgaacggttgtgttcgtgtctacagtggcctgatggacatgatgaacgacaacgaaattgaaggcgttctgggccatgaactgggccacgtcgcgttgggtcactcgctggctgaaatgaaagcttcttatgcgatcgtggccgcacgcgatgccatttcagctaccagcggtgtggcttcccagctttcccgttcacaattaggtgatatcgcagaaggcgctatcaatgctaaatactcccgtgataaagaatccgaagcagatgatttctcttttgatctgttgaagaaacgtggcatcagtacccaggggctggttggtagctttgaaaaactggccagcctggatggcggtcgcactcagtccatgtttgattctcacccaccatcaacagagcgtgcgcaacacatccgtgatcgtatcgcctctggtaagtaaatcattgtcatctttcgggctggtcttctgccagcccgctataattgcgcaataaatccccatctgaatacagacaaaactggtttttgcacacaacgttaacgatttgtggcgtcggcgcgtataatgcgcgcggttatgttaacggtacgcctgttttaaggagataaagatgacggcaattgccccggttattaccattgatggcccaagcggtgcagggaaaggcaccttgtgtaaggctatggcggaagcgttgcaatggcatctgctggattcgggtgcaatttatcgcgtactggcactagcggcattacatcaccatgttgatgttgcatcggaagatgcgctggtgccgctggcatcccatctggatgtacgttttgtgtcaaccaacggtaatctggaagtgatcctcgaaggggaagatgtcagcggcgaaattcgtactcaggaagtggcgaatgctgcttcacaagtcgcggcattcccacgcgttcgtgaagcattattgcgtcgccaacgcgcgtttcgcgaattaccaggcctgattgccgatggccgcgacatgggaacggtggtattccctgatgcgccagtgaaaattttccttgacgcctcctcggaagaacgtgcgcatcgccgcatgctacagttgcaggagaagggctttagtgttaactttgagcgccttttggccgagatcaaagaacgcgacgaccgcgatcgtaaccgagcggtagcgccactggttccggcagccgatgctttagtgttggattccaccaccttaagcattgagcaagtgattgaaaaagcgctacaatacgcgcgccagaaattggctctcgcataagcgaccgaatttgcagtacccccgttgcaatggaatgacagcgggtatgttaaacaaccccatccggcatggagccaggtggacgttaaatataaacctgaagattaaacatgactgaatcttttgctcaactctttgaagagtccttaaaagaaatcgaaacccgcccgggttctatcgttcgtggcgttgttgttgctatcgacaaagacgtagtactggttgacgctggtctgaaatctgagtccgccatcccggctgagcagttcaaaaacgcccagggcgagctggaaatccaggtaggtgacgaagttgacgttgctctggacgcagtagaagacggcttcggtgaaactctgctgtcccgtgagaaagctaaacgtcacgaagcctggatcacgctggaaaaagcttacgaagatgctgaaactgttaccggtgttatcaacggcaaagttaagggcggcttcactgttgagctgaacggtattcgtgcgttcctgccaggttctctggtagacgttcgtccggtgcgtgacactctgcacctggaaggcaaagagcttgaattcaaagtaatcaagctggatcagaagcgcaacaacgttgttgtttctcgtcgtgccgttatcgaatccgaaaacagcgcagagcgcgatcagctgctggaaaacctgcaggaaggcatggaagttaaaggtatcgttaagaacctcactgactacggtgcattcgttgatctgggcggcgttgacggcctgctgcacatcactgacatggcctggaaacgcgttaagcatccgagcgaaatcgtcaacgtgggcgacgaaatcactgttaaagtgctgaagttcgaccgcgaacgtacccgtgtatccctgggcctgaaacagctgggcgaagatccgtgggtagctatcgctaaacgttatccggaaggtaccaaactgactggtcgcgtgaccaacctgaccgactacggctgcttcgttgaaatcgaagaaggcgttgaaggcctggtacacgtttccgaaatggattggaccaacaaaaacatccacccgtccaaagttgttaacgttggcgatgtagtggaagttatggttctggatatcgacgaagaacgtcgtcgtatctccctgggtctgaaacagtgcaaagctaacccgtggcagcagttcgcggaaacccacaacaagggcgaccgtgttgaaggtaaaatcaagtctatcactgacttcggtatcttcatcggcctggacggcggcatcgacggcctggttcacctgtctgacatctcctggaacgttgcaggcgaagaagcagttcgtgaatacaaaaaaggcgacgaaatcgctgcagttgttctgcaggttgacgcagaacgtgaacgtatctccctgggcgttaaacagctcgcagaagatccgttcaacaactgggttgctctgaacaagaaaggcgctatcgtaaccggtaaagtaactgcagttgacgctaaaggcgcaaccgtagaactggctgacggcgttgaaggttacctgcgtgcttctgaagcatcccgtgaccgcgttgaagacgctaccctggttctgagcgttggcgacgaagttgaagctaaattcaccggcgttgatcgtaaaaaccgcgcaatcagcctgtctgttcgtgcgaaagacgaagctgacgagaaagatgcaatcgcaactgttaacaaacaggaagatgcaaacttctccaacaacgcaatggctgaagctttcaaagcagctaaaggcgagtaattctctgactcttcgggatttttattccgaagtttgttgagtttacttgacagattgcaggtttcgtcctgtaatcaagcactaagggcggctacggccgcccttaatcaatgcagcaacagcagccgcttaatttgcctttaaggaaccggaggaatcatgaccaagtcagaattgatagaaagacttgccacccagcaatcgcacattcccgccaagacggttgaagatgcagtaaaagagatgctggagcatatggcctcgactcttgcgcagggcgagcgtattgaaatccgcggtttcggcagtttctctttgcactaccgcgcaccacgtaccggacgtaatccgaagactggcgataaagtagaactggaaggaaaatacgttcctcactttaaaccaggtaaagaactgcgcgatcgcgccaatatttacggttaagtttttactcaaacttgaacgcgagaaaagcacctgtcgggtgcttttttcatttctctaatctggaactggaagctgcctcgcagagttttgagcagttttcaccctatcgttaaattcttctgaacgtgcctcggggaacgcaaaactcccaccagacaaccgttcaacaaagttgcacactttctataaacagggagggtgcatgaaaataacgacagtcggcgtatgcataatttgcggaatttttccgttgctgattttgccccaattgcctgggacagtaacccttgcgtttctgactctcttcgcctgtgtactggcatttatccctgttaaaaccgtccgttatatcgcgctgacgttgctgtttttcgtttggggcatattagcagcaaagcaaattttgtgggcaggagaaaccttaactggcgcgacgcaggatgcaattgttgagatcattgctactgacggcatgaccactcattacggtcaaattactcatctacaaggtcgacgtatattccctgcgccaggcctcgtactgtatggcgaatatcttccgcaagcggtttgtgccggacaagtatggtcaatgaaactcaaagttcgtgcagttcatggtcaacttaatgatggcggctttgatagccagcgttatgccattgcccagcatcaaccgctcaccggccgttttctgcaggcaagtgtcattgaaccgaattgtagcctgcgtgcacagtatctggcgtcactacaaacaacgctgcaaccctatatgtggaacgcggttattcttggattaggtataggggaacggttatccgtccccaaagaaatcaaaaatatcatgcgtgatactggaacggcgcatttaatggcgatatcaggattgcacatcgcttttgcggcgttgctggctgcaggactcattcgcggtgggcaagtttttctgcctgggtgctggatccactggcaaatgccattaattggtggaatctgctgtgctgctttttatgcctggcttacgggaatgcaacctcctgcattgcgtaccgtggtggcgcttgccatttggggaatgcttaagttaagtggacgacaatggagtggctgggatgtatggatatgttgtctggcggcaattttgctgatggatcctgttgccattctctcgcaaagtttatggctatctgccgctgcggtcgcggcactgattttttggtatcagtggtttccctgtccggagtggcagctgccgccggtattgcgcgcggttgtttccctcatccatctgcaactgggaatcaccctcctgcttatgcccgtgcaaattgtcatatttcatggcattagtctgacctcgtttattgcaaatctttttgcaattcccctggtgacatttatcacggttccgttgattctcgccgcgatggttgtgcatttaagcgggccgtttattctggaacaagggttatggtttcttgccgaccggtctttggctttacttttctgggggttaaagagtttgccggaagggtggatcaacattgctgaacgttggcaatggataacattttccccatggttcttactggtggtatggcgattaaacgcctggcgaacgttgccagcaatgtgtgtggctgtaggcttgctgatgtgcttgccgctgtggcaaaaacctcgacctgacgagtggcaagtgtacatgcttgatgtcgggcaagggctggcaatggtcattgcgcgaaacggcaaagcgattctctatgacacgggactggcctggcccgaaggggatagtgggcaacaactgattatcccctggctccactggcataatcttgaaccggaaggcgttattttgagtcatgaacatctggatcaccggggagggctggactcaatattgcacacatggccgatgttatggatccgaagtccgttaaactgggaacatcatcagccctgtgtgcgtggcgaagcgtggcaatggcaaggattgcgtttcagcgcgcactggcctttacaaggtagcaacgataaaggaaataaccattcctgtgtggttaagattgatgacgggacgaatagcattcttctaaccggtgatattgaagcccccgctgaacaaaagatgctaagccgttactggcagcaaatgcaggcaacattacttcaggtacctcaccatggcagtaatacctcatcatcgttgccattaattcagcgagtgaatggaaaagtggcactcgcatcggcatcgcgctataacgcatggcgactgccctcaagcaaagttaaacatcgctatcaacaacagggctataagtggcttgatactccacatcagggtcaaataacggtcaatttttcagcgcaaggctggcggattagcagcctcagagagcaaattttacctcgttggtatcatcagtggtttggcgtgccagtggataacgggtagaatatgcggctatttcaacaaatgctggttttttgaatgcataacgacaaagatctctctacgtggcagacgttccgccgactgtggccaaccattgcgccttttaaagcgggtctgatcgtggcgggcgtagcgttaatcctcaacgcagccagcgataccttcatgttatcgctccttaagccacttcttgatgatggctttggtaaaacagatcgctccgtgctgatgtggatgccgctggtggtgatcgggctgatgattttacgtggtatcaccagctatatctccagctactgtatctcctgggtatcaggaaaggtggtaatgactatgcgtcgccgcctgtttggtcacatgatgggaatgccggtttcattctttgacaaacagtcaacgggtacgctgttgtcacgtatcacctacgattccgaacaggtcgcttcttcttcttccggcgcactgattactgttgtgcgtgaaggtgcgtcgatcatcggcctgttcatcatgatgttctattacagttggcaactgtcgatcattttgattgtgctggcaccgattgtttcgattgcgattcgcgttgtatcgaagcgttttcgcaacatcagtaaaaacatgcagaacaccatggggcaggtgaccaccagcgccgaacaaatgctgaaaggccataaagaagtattgattttcggtggtcaggaagtggaaacgaaacgcttcgataaagtcagcaaccgaatgcgtcttcaggggatgaaaatggtttcagcctcttccatctctgatccgatcattcagctgatcgcctctttggcgctggcgtttgttctgtatgcggcaagcttcccaagtgtcatggatagcctgactgccggtacgattaccgttgttttctcttcaatgattgcacttatgcgtccgctgaaatcgctgaccaacgttaacgcccagttccagcgcggtatggcggcttgtcagacgctgtttaccattctggacagtgagcaggagaaagacgaaggtaagcgcgtgatcgagcgtgcgactggcgacgtggagtttcgcaatgtcacctttacttatccgggacgtgatgtgcccgcattgcgtaacatcaacctgaaaattccggcagggaagacggttgctctggttggacgatctggttcaggtaaatcaaccatcgccagcctaatcacacgtttttacgatattgatgaaggcgaaatcctgatggatggtcacgatctgcgcgagtataccctggcgtcgttacgtaaccaggttgctctggtgtcgcagaatgtccatctgtttaacgatacggttgccaacaacattgcttacgcaaggactgaacagtacagccgtgagcaaattgaagaagctgcgcgtatggcctacgccatggacttcatcaataagatggataacggtctcgatacagtcattggtgaaaacggcgtgttgctctctggcggtcagcgtcagcgtattgctatcgctcgagccttgttgcgtgatagcccgatactgattctggacgaagctacctcggcgttggataccgaatccgaacgtgcgattcaggcggcactggatgagttgcagaaaaaccgtacctctctggtgattgcccaccgcttgtctaccattgaaaaggcagacgaaatcgtggttgtcgaggatggtgtcattgtggaacgcggtacgcataacgatttgcttgagcaccgtggcgtttacgcgcaacttcacaaaatgcagtttggccaatgatcgaaaaaatctggtctggtgaatcccctttatggcggctattgctgccactctcctggttgtatggcctggtgagtggcgcgatccgtctttgctataaactaaaactgaagcgcgcctggcgtgcccccgtaccggttgtcgtggttggtaatctcaccgcaggcggcaacggaaaaaccccggtcgttgtctggctggtggaacagctgcaacagcgcggtattcgcgtgggggttgtatcgcggggatatggtggtaaggctgaatcttatccgctgttattgtcggcagataccaccacagcacaggcgggtgatgaacctgtgttgatttatcaacgcactggcgcacctgttgcggtttctcccgtgcgttctgacgcggtaaaagccattctggcgcaacaccctgatgtgcagatcatcgtaaccgacgatggtttacagcattatcgtctggcgcgtgatgtggaaattgtcgttattgatggtgtgcgtcgctttggcaatggctggtggttgccggcggggccaatgcgtgagcgagcggggcgcttaaagtcggttgatgcggtaatcgtcaacggcggtgtcccccgcagcggtgaaatccccatgcatctgctgccgggtcaggcggtgaatttacgtaccggtacgcgttgtgacgttgctcagcttgaacatgtggtggcgattgcggggattgggcatccgccgcgcttttttgccacgctgaagatgtgcggcgtacaaccggaaaaatgtgtaccgctggccgatcatcagtctttgaatcatgcggatgtcagcgcgttggtaagcgccggacaaacgctggtaatgactgaaaaagatgcggtgaaatgccgggcctttgcagaagaaaattggtggtatttgcctgtagacgcacagctttcaggtgatgaaccagcgaaactgcttgcgcaactaacctcgctggcttctggccactagttacgccgcggcagcgttcgattgatggagtcatgaatgtcgctgccgcacctctcccttgctgatgcgcgtaatcttcaccttgccgcgcaaggcctgttaaacaaaccccgccgtcgagcgtcgttggaggatattccggcaacgatctcccgcatgtccttgctgcaaatcgataccatcaatattgttgtccgtagcccatatctggtgcttttcagccgtctgggagattatcctgcgcagtggctggatgagtctctggcgcgtggagaattaatggaatactgggcgcatgaagcctgctttatgccgcgtagcgattttcgtcttattcgccaccgcatgctggcacctgaaaaaatgggctggaaatataaagacgcctggatgcaggaacatgcggcggaaattgcactgttaattcagcatattcatgataaggggccggtacgttcagccgattttgagcatcctcgtaaaggggcgagcggctggtgggagtggaagccgcataaacgacatctggaaggtttatttactgccggaaaggtgatggtgattgaacggcgcaacttccagcgcgtttatgatttaactcaccgtgtcatgcctgactgggatgatgagcgcgatctcgtttcgcaagcagaagcagaaatcatcatgctggataacagtgcgcgtagcctgggaatatttcgcgaacagtggctggcagattactaccggctaaaacgtccggcactggcggcgtggcgtgaagcgagggctgaacagcagcaaatcattgctgtgcatgttgaaaaattgggcaatctttggctgcatgctgatttgctgccgctactcgagcgtgcgctcgccggaaagctcactgcaacgcacagcgcggtactttcgccttttgatcctgttgtctgggatcgcaaacgcgcggagcagctttttgattttagctaccggctggagtgctatatcccagcgccgaaacgccagtatggatattttgttctgccgttattacatcgtgggcaattagttgggcgaatggatgccaaaatgcatcgccagacaggcatccttgaagttatctctctgtggttacaggaaggcattaaaccaacgacaacgctgcaaaaagggttacgtcaggcgattactgatttcgctaactggcagcaggcaacgcgggtgacattaggacgctgcccgcaaggcctctttactgattgccgcgccggctgggaaatagaccccgtcgcataaatgattatgataagatttatgcattcataacccgatccatctggaggaactatggatcatcgtctgcttgaaatcattgcctgcccggtttgcaacggaaaactttggtataaccaggaaaaacaagagcttatttgcaaactggacaacctggctttcccgctgcgcgatggcattccagtgttgctggaaacggaagcccgcgtgctgactgctgatgagagtaaatcatgagttttgtggtcattattcccgcgcgttacgcgtccacgcgtctgcccggtaaaccattggttgatattaacggcaaacccatgattgttcatgttcttgaacgcgcgcgcgaatcaggtgccgagcgcatcatcgtggcaaccgatcatgaggatgttgcccgcgctgttgaagccgctggcggcgaagtatgtatgacgcgcgccgatcatcagtcaggtacagaacgattggcggaagttgtcgaaaaatgcgcattcagcgacgacactgtgatcgttaatgtgcagggtgatgaaccgatgatccctgcgacaatcattcgtcaggttgctgataacctcgctcagcgtcaggtgggtatggcgactctggcggtgccaatccacaatgcggaagaagcgtttaacccgaatgcggtgaaagtggttctcgacgctgaagggtacgcactgtacttctctcgcgccaccattccgtgggatcgtgatcgttttgcaaaagaccttgaaaccgtaggcgataacttcctgcgtcatcttggtatttatggctaccgagcaggctttatccgtcgttatgttacctggcagccaagtccgttagaacatatcgaaatgttagagcagcttcgtgttctgtggtacggcgaaaaaatccacgttgctgtcgcccaggaagttcctggcacaggtgtggatacccctgaagatctcaagcgcgttcgcgccgaaatgcgctaatttcacttcacgacactccagccaattttgggaggagtgtcgtaccgttacgattttcctcaatttttcttttcaacaattgatctcattcaggtgacatcttttatattggcgctcattatgaaagcagtagcttttatgagggtaatctgaatggaacagctgcgtgccgaattaagccatttactgggcgaaaaactcagtcgtattgagtgcgtcaatgaaaaagcggatacggcgttgtgggctttgtatgacagccagggaaacccaatgccgttaatggcaagaagctttagtgcgcccggaaaagcccgacaactggcatggaaaaccaccatgctggcaagaagtgggactgtccgtatgccgactatttatggtgtgatgacgcatgaagaacaccccggccccgatgtcctgctactggagcgaatgcgtggtgtttcggtggaggcaccagcccgaacaccagaacgctgggaacaactcaaagatcaaatcgttgaagccttactggcctggcaccgtcaggacagtcgtggttgcgtcggcgcggtcgacaatactcaggaaaatttctggccctcatggtaccggcaacatgttgaagtgctatggaccacgctcaatcagttcaataacaccggtctaacgatgcaggataagcggatcctgtttcgcactcgcgaatgtctcccggcattatttgaaggctttaacgacaattgtgtactgattcacggtaacttctgtttacgtagcatgctgaaagattcgcgcagcgatcagttactggcgatggtcggaccgggactaatgctttgggcaccgcgagaatacgaactgttccgactaatggataattctctggcggaagatttgctctggagttatctgcaacgcgcgccagtggcggagtcgttcatctggcggcgttggttgtatgtgttatgggatgaagttgcgcaactggtcaacaccggacgatttagtcggcgtaacttcgatctggcatcaaaatcactcttgccgtggctcgcctgacgaaccttttagccactgccagatgcggccaagcgtttcatagccaacacgatcgctatgcatcaaccaaaccggagaagggattgcccgttcccacggattaagcggcgagtcgatggccaactgattcgccggggctggcagcggatttagcccttcctgctgaaaaaagatcatcgcccgcggcagatgtgatgcggaggtcaccagcaggaaaggggcgtcaccaattgcctgtttcactgccgcagcttcttcttcggtatcttttggcaaatccagagtgataatttgctcgcgcggcacgcccagcgattgcgcaactcttgcacttacttcggctgtactcaccgtattggtttttgctacgcctcccgtgaagatcagttttgatcccggattttcgcgccataagcgaataccttcattcaggcggggcagactgttattgattaaattcgagcttggtgcccactgcgggttccaggtataaccacctccgagcaccacgatatagtccactttttgcgaattattccatgtcggataggtgctttcgatgggacgcagcaggcggtcggctaccggttgcaaactcaataacaagagcgccagccacccaatgctaataaaaatcttcccggttttttgaaaacggctaaaccacagcagcgccaggccagcgccaataatcaacaacatcagcggaagtggcagcaacatattgccaatcacttttttcagtgtaaaaagcatcctttctggttccttttttgaccatatagcaagggatcgccagcgatattacaccagacgggttcattctcgccgtggctgtgacaaaatagcgtctttatcagaaaacgtcttagccaaccggtggagaaagcaatgcaggatcgcaattttgatgatattgcggaaaagttttcccgtaacatttacggcaccaccaaagggcagcttcgacaggctattctgtggcaggatctcgatcgcgtgctggcggaaatgggcccgcaaaaactgcgtgtgctggatgctggcggtggagaagggcagaccgcaatcaaaatggccgagcgcgggcatcaggtcattttatgcgatctttctgtgcagatgatcgaccgcgcaaaacaggcggcagaagcaaaaggtgtgagcgacaacatgcaatttatacattgcgccgctcaggatgttgcttcgcatttggaaacgcccgttgatctgatattgttccatgcggtgctcgagtgggtggccgatccccgcagcgtattacagaccctgtggtcagtgttgcgtccaggcggcgtgttgtcgttaatgttctacaatgcgcatggtttgttgatgcataacatggtcgccgggaattttgattacgtgcaggcgggaatgccgaaaaagaaaaaacggatgctttcgccagattatccacgcgacccggcgcaggtttatctgtggctggaagaagctggttggcaaattatgggtaagacaggcgttcgcgtgtttcatgattatctgcgcgagaagcaccagcagcgcgactgctatgaagcattacttgaattagaaacgcgttattgccgtcaggaaccgtatattaccctggggcgttatattcatgtcaccgcgcgcaaaccgcagagcaaggataaagtatgagtgaattttcccagacagtccccgaactggttgcctgggccagaaaaaatgacttctccatctcgctgccggtagaccgactctcttttctgctggcggttgccacgctgaacggcgagcgtctggatggtgagatgagtgaaggcgagctggtggatgcattccgctatgtgagtgatgcgtttgagcaaaccagcgaaaccatcggcgtgcgcgccaacaacgcgatcaacgacatggtgcgtcaacgtctgctgaaccgctttaccagcgagcaggcggaagggaacgcaatttaccgtctgacgccgctcggcatcggcatcactgactattacattcgtcagcgcgagttttctacgctgcgcctttctatgcaattgtcgattgtggcgggtgagctcaagcgcgcagcagatgccgccgaagagggcggtgatgaatttcactggcaccgtaatgtttatgcgccactgaaatattcggtagcagaaattttcgacagtatcgacctgacgcaacgtctgatggatgaacagcagcagcaggtgaaggatgatatcgcccagttgttgaacaaagactggcgggcggcgatttccagctgtgaattgttgctttcagaaacttccggaacgctgcgtgaattgcaggatacgctggaagcggcaggcgataaattgcaggccaacctgttacgcattcaggatgcgacgatgacccatgacgacctgcattttgtcgatcgtctggtgttcgatcttcagagcaaactcgaccgtattatcagttggggccagcaatccatcgacttgtggattggctacgaccgccacgtacacaaatttattcgtactgcgatcgatatggataaaaaccgcgtctttgctcagcggttacgtcagtcggtacaaacctattttgatgagccgtgggcgctaacttatgccaatgccgatcgtctgctggatatgcgtgacgaagagatggtactgcgcgatgaagaagtgactggggaacttcctgaggatctggagtacgaagagtttaacgagatccgcgaacagctggcggcgatcatcgaagaacaacttgccgtgtacaaaaccagacaagtgccgctggatcttggtctggtggtacgcgaatatctgtcacagtatccgcgtgcacgtcactttgacgttgcgcgcattgttattgatcaggcggtacgtcttggcgtagcgcaagcagatttcaccggactgccagcgaaatggcagccgattaatgattacggagccaaggtacaggcgcatgtcatcgacaaatattgaacaagtgatgccggttaagctggcgcaggcgctggcgaatccgttatttccggcgctggatagcgccttacgttcaggccgtcatattggcctcgacgaactggataatcatgcattcctgatggattttcaggaatatctggaagagttttacgcgcgttataacgttgagcttattcgcgcaccggaagggttcttctatctacgcccacgttccaccacgctgatccctcgttccgtcttgtcggaactggatatgatggtcgggaaaatcctctgttatctctatctcagcccggaacggctggcgaatgaggggatttttactcaacaggaactgtacgacgaactgctcaccctggccgatgaagcgaaactgctgaaactggtgaacaaccgttcaaccggttcagacgttgaccgtcagaagttgcaggaaaaagtacgttcttcgctcaaccgtctgcgtcgtttaggcatggtgtggtttatgggccacgacagcagcaagttccgcattaccgaatcggtgttccgcttcggcgccgatgtgcgtgctggcgacgatccccgtgaagcacagcgtcgcctgattcgtgatggtgaagcaatgccgattgaaaatcatctgcaactcaacgatgaaaccgaagagagtcagccagatagcggagaggaagaataatgattgaacgcggtaaatttcgctcactgacgctgattaactggaacggcttttttgcccgaacttttgaccttgacgagctggtcacgacgctttctggcggtaacggggcgggtaaatccaccaccatggcggcgttcgttacggcgcttatccccgacctgaccctgctgcatttccgtaacactacggaagccggggccaccagcggttcgcgcgataaaggtctgcacggtaagctgaaagcgggtgtctgttattcgatgctcgacaccattaactcgcaccaccagcgcgtagtggtcggtgtgcgcctgcaacaggttgccggacgcgatcgtaaagtggatatcaaaccatttgccattcagggcctgccgatgtcggtgcagccgacacaactggtgaccgaaactctgaacgaacgccaggcgcgcgtgctgccgcttaatgagctgaaagacaagctcgaggcgatggaaggcgtgcagtttaagcagttcaactccattaccgattaccactcgctgatgttcgatctgggcatcatcgcgcgtcgtctgcgctcagcgtctgaccgtagtaaattctatcgtctgatcgaagcctcgctgtatggcgggatctccagcgccattactcgttctctgcgcgactacctgttgccggaaaacagcggggtgcggaaagcgttccaggacatggaagcggcgctgcgtgaaaaccgcatgacgctggaagcgattcgtgtcacccagtcggaccgtgacctgtttaagcatctgatcagcgaagccaccaactacgtggcggcggactacatgcgtcacgccaacgagcgccgtgttcatctcgataaggccctggagtttcgtcgcgagctacatacttcgcgtaagcaactggcggctgagcagtacaaacacgtcgacatggcgcgagagctggctgagcacaacggtgccgaaggcgatctggaagcggattatcaggcggccagcgatcacctgaacctggtgcaaaccgcactgcgtcagcaggagaagatcgaacgctacgaagcggatctcgatgagctgcagatccgtctggaagagcaaaacgaagtggtggcagaagccatcgaacgccaggaagagaacgaggctcgtgcggaagctgccgaactggaagtggacgagctgaaaagccagcttgctgactaccagcaggcgctggacgtccagcaaacgcgcgcgatccagtataaccaggcgattgctgcgcttaatcgtgccaaagaactgtgccatctgccggacttaaccgccgacagcgctgccgaatggctggaaaccttccaggcgaaagagctggaagcgaccgaaaaaatgctctctcttgagcagaaaatgagcatggcgcaaaccgcgcacagccagtttgagcaggcttatcagctggtggtggcaatcaacggcccgctggcgcgtaacgaggcgtgggatgtcgctcgcgaactattgcgcgaaggggtcgatcagcgtcacctggcagagcaggttcagccgttgcggatgcgcttaagcgaactggaacagcgtctgcgtgagcagcaagaagctgagcgtctgctggcagatttctgcaaacgtcagggcaagaattttgatattgatgaactggaagctctgcatcaggagctggaagcacgcattgcctctctttccgatagcgtctctaacgcccgagaagagcggatggcactgcgccaggagcaggaacagctgcagtctcgcattcagagtttgatgcagcgtgcgccggtttggctggcagcgcaaaacagtctcaaccagttgagcgaacagtgcggcgaagagttcacctccagccaggatgtcaccgaatttctgcaacagttgctggagcgtgagcgcgaggcaattgttgaacgcgatgaagtaggcgcgcgcaaaaacgccgtcgatgaagagatcgaacgtttaagccagccaggtggttctgaagatcagcgtctgaacgcgctggcggagcgttttggtggtgtgctgctgtcagaaatttatgacgacgttagcctggaagatgcgccgtacttctcagcgctgtatggcccgtcacgccacgccatcgtggtgccagatctgtcacaggtaaccgaacacctggaaggcttgaccgattgcccggaagatctctatctgatcgaaggggatccgcagtcattcgatgacagcgtgttcagcgttgatgagctggaaaaagcggtggtggtgaaaatcgccgatcgtcagtggcgttattcacgtttcccggaagtgccgctgtttggtcgtgctgcgcgtgaaagccgtattgaaagcctccatgccgagcgggaagtgctttccgaacgcttcgccacgctctcctttgatgtacagaaaacccagcgtctgcatcaggcgttcagccgctttatcggcagtcatctggcggtggcgtttgagtctgacccggaagcagaaatccgtcaactgaacagccgtcgcgtcgaactggaacgggcgttgagtaatcatgaaaatgataaccagcagcagcgtattcagtttgagcaggcgaaagagggcgttacggcgctgaaccgcattctgccgcgtctcaacctgttggctgatgacagcctggcggatcgcgtcgatgaaatccgcgaacgtctggatgaagcccaggaagccgcgcgttttgttcagcagtttggcaatcaactggcgaaactggaaccgatcgtttcggtattgcagagcgacccggaacagttcgaacagttaaaagaagattacgcgtactctcagcagatgcagcgcgatgcccgtcagcaggcgtttgccctgacggaagtggtgcagcgtcgtgcgcactttagctactctgactcggcagaaatgcttagcggtaacagcgatctcaacgaaaaactgcgtgaacgtctggaacaggcggaagcggagcgtacccgcgctcgtgaagcgttgcgcggacacgcagcgcagttgaatcagtacaaccaggtgctggcttcgctgaaaagttcgtatgacaccaaaaaagagctacttaacgatctgcaacgtgaattgcaggatatcggcgtgcgtgctgatagcggggcagaagagcgggcacgtattcgccgtgacgagttgcacgcgcaactgagcaataaccgttcacgacgcaatcaactggaaaaagcgcttacattctgcgaagcggagatggacaacctgacccgtaaactgcgcaagctggagcgggattactttgagatgcgcgagcaggtagtgaccgccaaagcgggctggtgtgcggtgatgcgcatggtgaaagataatggcgttgagcgtcgcttacaccgtcgtgagctggcttatctctccgctgatgatttgcgttccatgtcggataaggcgttaggtgcgctgcgtctggcggtggcagataacgaacatctgcgcgacgtgctgcggatgtcggaagatccaaaacgtccggaacgtaaaattcagttcttcgtggcggtttatcagcatctgcgtgaacgtattcgtcaggatattattcgtaccgatgatccggtggaagctatcgaacagatggagatcgagcttagccgtctgaccgaagaattaacctcccgtgaacagaaactggcgatcagttcccgcagcgtggcgaacatcattcgcaaaaccattcagcgcgagcagaaccgtatccgtatgctcaaccaggggttgcagaacgtatcgtttggccaggtgaacagcgtacgtctgaacgtgaacgtacgtgaaacgcacgccatgctgctggatgtgctctctgaacagcacgagcagcatcaggatctgtttaacagcaaccgcctgaccttctcagaagcgctggcgaaactgtatcaacgtcttaacccgcagattgatatggggcagcgcacgccgcagaccatcggtgaagaactgctggattaccgcaactatctggaaatggaagttgaggttaaccgtggttccgatggctggttgcgtgcagagtctggtgcattgtcgaccggtgaggcgattggtaccggtatgtcgattctggtgatggtggtacaaagctgggaagatgaatctcgccgcctgcgcggtaaagatatctctccttgccgcctgctgttcctcgatgaagcagcgcgactggacgcccgttccatcgccacgctgtttgaattgtgtgaacgtttgcaaatgcagctcattatcgcagcgccggaaaatatcagcccggagaaaggcaccacctataaactggtgcgtaaagtcttccagaataccgaacacgttcacgtcgtcggcctgcgaggatttgcgccgcaacttcctgaaacgcttccaggaagtgacgaagcgccttctcaggcgagttaaaattaaggcggcagcaatgccgccttttctttttccgaaaactccgtttctgcactaaaaaagtggcacattacggcgcgcttttctttaaacttctttacattaggttatgtaaaaacgtatcggcgtttatatactgaagataagcctgatgagtaacaggcttgctcgtcatactttcgtgagtattggcgttgtacaggcaagtcgtaaaataacagcctggctattcagagtatgataaaaacagggggcaagggatgttgcttaatatgatgtgtggtcgtcggctgtcggcaatcagtttgtgcctggccgtaacattcgctccactgttcaatgcgcaggccgatgagcctgaagtaatccctggcgacagcccggtggctgtcagtgaacagggcgaggcactgccgcaggcgcaagccacggcaataatggcggggatccagccattgcctgaaggtgcggctgaaaaagcccgcacgcaaatcgaatctcaattacccgcaggttataagccggtttatcttaaccagcttcaattgttgtatgccgcacgcgatatgcaacccatgtgggaaaaccgtgatgctgttaaagccttccagcaacagctggcagaggtggcgattgccggtttccagccgcagtttaataaatgggtagagttactgaccgatcctggtgttaacgggatgacacgcgacgtggtgctctctgatgcgatgatgggctatctccatttcattgcaaatattccggtcaaaggcactcgctggctatatagcagtaaaccttatgcgctttcaacgccgccgctttcggtgattaaccaatggcagctggcgctggatcaaggtcaattgcctacgtttgttgcaggactggcaccgcagcatccgcaatatgcggcgatgcatgaatcgttactggccttactcagtgacaccaaaccgtggcctcaactgaccggtaaagcaacgttgcgcccaggacagtggagtaacgacgtaccggcgttgcgcgaaatattgcaacgtacaggcatgttggacgggggaccgaaaattacgctacctggcgatgacacgccaactgacgcggtagtcagcccatccgctgttactgttgaaacagcagaaactaagctgatggacaaacaaactacgtctcgtagtaaacctgcgcctgccgttcgcgccgcctacgataatgaactggtggaagccgttaaacgttttcaggcatggcaaggattgggagcagatggtgctattggcccggcaacgcgtgactggttaaacgtaacgcccgcccagcgtgctggcgtgttggcactcaacatccagcgattgcgcttgctgccaacagagctttctaccgggatcatggttaacattccagcctattcgctggtctactatcagaacggcaatcaggtgctggattcgcgagtcattgtcggtcgccccgatcgcaaaacgccgatgatgagcagtgcccttaacaacgtggtggtaaacccgccgtggaacgtcccaccaactctggcacgcaaagatattctgccgaaagtgcgcaatgatcctgggtatctcgaaagccatggctatacggtgatgcgcggctggaacagcagagaagcgattgacccatggcaggttgactggtctacaatcacggcctcgaatttaccgttccgcttccagcaggctccaggcccacggaactcgctggggcgctataaattcaatatgccgagttcagaggccatttatttgcatgacacgccgaaccacaatctgttcaagcgtgatacacgcgcattgagctcaggctgtgtacgagtgaataaagcttccgatctggcgaatatgctgttgcaggatgcaggctggaatgacaaacgtatttctgatgcgctgaagcagggcgatacgcgttacgtcaatattcggcagtcgattccggtgaatctctactatctgacggcctttgttggtgcagatggtcgtacccagtatcgtacagatatttacaattatgatctgcctgcgcgatccagctcgcaaatcgtatcgaaagcggaacaattaatcaggtaaatgaagcagttcggggaaatcagttgtcgtaataattagcatgatcgggggcgattctctgcagcccccgtcactgctggggttgagtcatcttgacgtctgctttacgggcggttaaggtgcctcttgtgcgccagaagtgcatataaacgataacattgacctgtagacttgattatcatggacaaattcgacgctaatcgccgcaaactgctggcgcttggtggcgttgcactcggtgccgccatcctgccgaccccggcgtttgcaacactctctaccccacgcccgcgcattttgacactcaataatcttcataccggagagtcaatcaaagcggagtttttcgatggcagaggctatattcaggaagaattggcaaaacttaaccattttttccgcgattaccgcgcgaacaaaataaagtccatcgacccaggattattcgaccagttgtatcgcctgcaagggttgttaggcacccgcaaaccggtgcaactcatttccggttatcgttccattgataccaacaatgaactacgcgcccgcagccgtggagtagcgaagaaaagctatcacactaaaggccaggcgatggatttccacattgaaggtatcgcgttaagcaatattcgcaaagccgcgttatctatgcgcgcaggtggtgtaggatattacccacgtagtaactttgtgcatattgataccgggccagcacggcactggtagtaatcgcttaacgaaacaggggcagtatgaactatcgtattattccggtcaccgcattctcccagaactgttcattgatctggtgtgaacaaacccgtctggccgcactggtcgatcctggcggcgatgcggaaaaaatcaaacaggaagttgatgccagcggcctgacactgatgcagatcctgctgactcatggtcatctggaccacgttggcgcagcggcggaactggcgcaacattacggcgtgccggtttttggcccggaaaaagaagatgagttctggctgcaaggcttgcctgcgcaaagtcgtatgtttggtctggaagagtgccagccgctgacgccagatcgttggctgaacgaaggcgataccatcagcatagggaatgtgactttacaggtgttacattgccctgggcatacgccgggtcatgtcgtgttttttgatgatcgggcaaagctgctgatttctggcgacgttattttcaaaggtggagtagggcgcagtgacttcccgcgtggcgatcataatcaactgatttcttcaatcaaagataaattgctgccactgggggatgacgtgacatttattccgggtcacggaccattatccacacttggttatgagcgcctgcataatcccttcctgcaagacgaaatgcccgtctggtaaaggtgcataaaaaagcccgctttcaagcgggcttcattgtttttaacgcttacagcactgccacaatcgcttcgcacagcggcgccatgttatctggtgtcatcccggccacgtttacgcgaccagaagcaacagcatatacgccaaactcttcgcgcagacgcagcacttgttcttttgtcaggccactgaaggagaacatgccgttctgtttgatgataaagctgaagtcgcgatttgcgcctttttcctgcagcgtattgacgaacaactgacgcatacgctgaatacgctggcgcatatcagtcagttcttgttcccaaatcgcacgtaacgcatcgttgctcaggatggtggcaacaacagaagcgccgtgtgctggtgggttagagtagttagcacgaatcgccgctttcatttggctgaatgcgcgttcaacagtttcactgtcagcagcaaccagagtacaagcgccaacacgctcgttgtacaggccaaagtttttagagtaggaactggcaacaatcagctccttatgcagagccgcgaaagcgcgcagtccttcagcatcttcttccaggccacgggcaaaaccctggtaagcgaagtcaaacagcggtaaccagcctttctcaacggagagttgtgccagtgtctgccattgttccagcgtagggtcgatgccggttgggttatggcagcagccatggaacagcactacgtcgccagcctgggcttcgttcaggctgttaatcagtgcatcgaagtcaagagtgtgattttccgcatcataataagcgtattcacgaacttccagacctgcagagttaaagacgctcttatggttcggccagcttgggttgctcacccacacacgcttaacgctggtattttttgccaggaaatcggcagccacgcgtagtgcgccagtgccacccggagtctgtgccgtgcgagcacgtttgtcattgatcagggcgctacctttaccaaacagcagttcctgagtgcagcgaccaaattcagggatgccgtcaatgccgaggtaatttttggtggtttcattttcgagcagatactgttcagcctttttcacgctggtcagtaccggggttttacccgtctcatctttatagacaccaatcccgaggttaattttgccgggacgttcatcggcacgaaacagatcggccaggcccagaatcgggtcggcaggagcggcggtaatgttctcaaacatgacgaggttccattatggttacagaagagaagtccgctatcagggtaacgggagatttacaaaattccaactattactgatgaaaacgcaggctgtttttgcaagacgtgagattgctctggaaggcataaaaaaaacaggaccaaagtcctgttttttcggcatttaacaaagaggtgtgctattagaactggtaaacgatacccacagcaacggtgtcgtcagaacctacgcccagtttgttgtcagaatcgatctggttgatgatgtagtcaacataggtggacatgtttttgttgaaatagtaggttgcgcccacttcaaagtagttcaccagatcaacatcaccgataccttctacgtctttcgctttagatttggtgtaagcgatggacggacgcagaccgaaatcaaactggtattgcgcaactaacagaacgtcttgcgttttgttggcgaagccgctggtgtttgtaaatttattagtgatcggcgtagcgttacgggtttcaccgtagttcgctgccaggtagatgttgttcgcgtcatacttcagaccagtagcccactgttcagcttttttgcctttgccaagggaagactcttcctgcaggttggtacggtcagcggcaccataagcaccaacgataccaaagccttcgtattcgtagctgatagaaccgccaacaccgtcgccgttagagcggcgtgcagtgtcacgctcgtttttacccaggtactgaacagcgaagttcagaccatcaaccagaccaaagaagttggagttacgataggtagcaacgccgccaacacgaccaacgaagaaatcatcgctgtatgcagtatcaccaccaaattctggcagcatatcggtgtaacccagtgcatcataaaccacaccgtagttacggccgtaatcgaaagaaccaacgtcagcgtatttaagacccgcgaatgccagacgcgttttgttaccagtttgagcgtcagcgccctcagagttgttaccctggaagttatattcccactgaccataaccggtcagatcggaattgatttgagtttcccctttaaaaccaagacgggcataggtcatgtcaccattgccaccgtaactgttttcaccgttacccttggagaaataatgcagaccgacagctttaccgtacagatctactttgttgccatctttgttatagatttctgcagcgtttgcagtacctgctactaacagagcagggacgatcactgccagaatattgcgcttcatcattatttattaccctcatggtttttttatgacacctgccactgccgtcaataagttctgtcaataaaaatttacggaactattgatgagagtttggtgtctttatgtgtctgcaggcatctttccattcaaactaacgtttcgctaccgtgaaagtgctacaaagataaagatttagtttcaaaaagaaaaaatatgtgacaaaaagtaaaaattaaggaactttgtgaacaccgtcatatttccatagaagcgtgatgatatttacagcaatttttatctatttatatgattttcttatatttaaattaactaaacggaaattttgtttctgatggaaactttatcgaccaggcacaaaatcttctttcagacatccagaatgccaaaaatttgtatgaaaattgtgctatcagctaagaaaaaactaatccgcaataagaatgcagattattttttgtgcgtaaatgttgcagcgtaatattccgtaacaggatgatcgttatggcggggttgcaaatagattgcttgacttaacaaacagataacttgacagaaaggataaaaaaagagccagcgggcgctggctcttgaagacgctaaattagaagctggcgttacgcggagtacgtgggaacggaataacatcacgtacgttttgcacgccagttacgtaagcaatcaggcgttcaaaaccaagaccgaaacctgaatgcggaacagtaccgtagcgacgcagatcgcgataccaccagtaatcttctttgttcaggcccatttcaagcatacgctcgtccagcacgtccagacgttcttcacgctgggagccaccaatgatctcaccgatgcccggagccagaacgtccatagccgcaacggttttaccgtcttcgttaaggcgcatatagaacgctttaatatctttcggatagtttttaaccactaccggtgctttaaagtgttcttccgccagataacgctcatgctcagaagagagatcgacgccccagtaaaccgggttttcaaacttcctgccgcagttttcgagaatggtcactgcgtcggtgtaatccacctgcgcgaaatcggcctcaatgaagcgttccaggcgtgaaacggcatctttatctacgcgttcagcgaagaatttcatgtcgtcagcgcgttcttcgagaaccgctttgaagacatatttcagcatggcttcagccagacccgcgatatcgttcaggttagcaaacgccacttctggctccagcatccagaattccgccaggtgacggctggtgttggagttttcagcacggaaagtcgggccgaaggtataaattttggataatgcgcaagcgtaggtttcgccgttcaactggccagatacggtcaggaaagactctttaccaaagaagtctttgtcgaaatctactttgccctgatcgttacgcggcaggttttccagatccagcgttgaaacacggaacatttcgccagcaccttcggtatcagatgcggtaatcagtggcgttgaaacccagaagaatccctgctcgttaaagaagcgatgcagcgcctgcgccagcgtatggcgaacgcgcgcgacggcaccaatcaggtttgtgcgcggacgcaggtgagcgacttcacgcagatactcaatgctgtggcgttttgccgccatcgggtaagtgtctggatcttcaacccaaccagcaacttcaaccttgctggcctgaatttcaaattgttgcccctggcccggcgacgccacgactttacccgtcacaatgaccgagcagccggtggtcagacgcaagacgtcttcattgtaattgggcagagaattattgatgacagcctgtacaggatcaaagcaggaaccgtcataaacggcgaggaaggagatgccagcttttgaatctcggcgggtacgtacccatccgcgcacggtgacttcgctgtcaacggctacgcggccctggagtacgtcggctacaggcacaacgctcataatattctctctgttaatagtcggaaaaaataaacacttgtccacccgtaaatggggggatacctatgttacctggcatctgcaatcagacaagcagaattcgcaaatgcagcgaaagatttcggaattaaaggtaaaaaaagggagccgattagctccctgatgatattaactggcttttttaatatgcggaaggtcgaacgctttgcgcagcgcccgaacaaacgctttatcgtggcagatagttttgccagggctgtcagaaagtttcgccaccggtttaccgttacactctaccaacttaatgacaatattcaggggttttacctgggggatatcgcaggtcaggcgagtcccaataccaaaacttaattgcacgcgggaagagaagtggcggtatagctcaaccgctttgcgtaaatccagattgtcagagaaaaccagcgttttactctgtggatcaattcccagcttttcataatgtgcaatggctttttcaccccattcaaccgggtcgccagagtcatggcgcaggccctgatagcgactggcgaactcgacaccgaaatcacgcaggaaagcatccatagtgatgcagtcggttaacgcaatgccaagttggtcgggatactcttccagccaggcagcaagtgcagctcgctggctgttggctagatccgggctgatttgctgatgcgcctggaaccattcgtgtgcctgtgttcccatcggcgtgagggaaagccgacgcgccagatcgtagttgctggtgcccacgaaccaggattcctgttgcagacgtttcacgatggtttcttgtacttcgcgagaaaaacggcggcgggtgccaaaatccatcagatggaagcgcgacatatcaagaccggcggttaatgccgagaagtcgactaatttgttttccagcgtgtcgagggcttgcgcaacgtcggcctgcggtgagcgatagcgatgtaccatttcactgataaccgccagcaaaggaacttcccagaggatgacttcacgccacgggccgcttaaacgaatatccagcttgccattatcgttggacacggtgacttgttccgggttaaagcggaactcgcgtagccagttaagatagtcagccttaaagaaaggcagggcagagagccactgatattcatcatcctgcaggcgcaggtgctgcatcgcctgaacctgttcacgaatagcatcggcataaatacccagcagatcgtcacctcggcaacgaaactccgccgcgacatgcacatcgtaatagtgatgaaacacggcttgctgcatatgcaacttataagcatctgtatccagcaacgagtgcagaacaggagaagcgaattgtgtcataggtgcgcagtagcgtcctcgtacaggagcgtttagtacaataaacatcttcaggaactgctggagtataccttgtttcgcaatttattgaaccccgatcacaccatatgccacctttctggtcgatggcataacgcggtgtatgttataaaaatgtagcaataaaggcgtttgtacctgaaaagatgaagattctgcatagcgcgatttacgcaacaggaatagactgaacaccagactctataaaagatgctaaaggttatttatgactcaacagccacaagccaaataccgtcacgattatcgtgcgccggattaccagattactgatattgacttgacctttgacctggacgcgcaaaagacggtcgttaccgcggtcagccaggctgtccgtcatggtgcatcagatgttccgcttcgtctcaacggcgaagacctcaaactggtttctgtttatattaatgatgagccgtggaccgcctggaaagaagaagagggcgcactggtcatcagtaatttgccggagcgttttacgcttaagatcgttaatgaaattagcccggcggcgaatactgcgctggaagggctttatcagtcaggcgatgcgctttgcacccagtgtgaagccgaaggtttccgccatattacgtattatctcgaccgcccggatgtgctggcgcgttttaccaccaaaattattgccgataaaaccaaatatcccttcctgctttccaacggtaaccgcgttgcgcaaggtgaactggaaaatggacgtcattgggtacggtggcaggacccgttcccgaaaccgtgctacctgtttgcgctggtggcaggcgactttgatgtgctgcgcgacactttcaccacgcgttctggtcgcgaagtagcgctggagctgtatgtcgatcgtggcaaccttgatcgtgcgccgtgggcaatgacctcgctgaaaaactccatgaaatgggatgaagaacgcttcggcctggagtatgacctcgacatctatatgatcgtcgcggtggatttcttcaatatgggcgcaatggagaataaggggctgaatatctttaactccaaatatgtgctggcccgcaccgacaccgccaccgacaaagattacctcgatattgaacgcgttatcggccatgaatatttccataactggaccggcaaccgtgtcacctgtcgcgactggttccagctcagtctgaaagaaggtttaaccgtcttccgcgatcaggaattcagctctgaccttggttcccgcgcggtaaaccgtatcaataatgtgcgcaccatgcgcggattgcagtttgcagaagacgccagcccgatggcgcacccaattcgcccggatatggtcattgaaatgaacaacttctacaccctgaccgtttacgagaagggcgcggaagtgattcgtatgatccacactctgcttggcgaagaaaacttccagaaagggatgcagctctatttcgagcgtcatgatggtagcgcagcgacctgtgacgactttgtgcaggcgatggaagatgcgtcgaatgtcgatctttcccatttccgccgttggtacagccaatccggcacgccggttgtgactgtcaaagacgactacaatccggaaactgagcagtacaccctgaccatcagccagcgcacgccagctacgccggatcaggcagaaaaacaaccgctgcatattccgtttgccgtcgaactgtatgacaacgaaggcaaagtgatcccgttgcagaaaggcggtcatccggtgaattccgtgctgaacgtcacccaggcggaacaaacctttgtttttgataatgtctacttccagccggtgcctgcgctgctgtgcgaattctctgcgccagtgaaactggaatataagtggagcgatcagcaactgaccttcctgatgcgtcatgcgcgtaatgatttctctcgctgggacgcggcgcaaagtttgctggcaacctacatcaagctgaacgtcgcccgtcatcagcaagggcagccgttgtctctgccggtgcatgtggctgacgctttccgcgcggtgctgctcgatgagaagattgatccggcgctggcggcagaaatcctgacgctgccttccgtcaatgaaatggcagaactgttcgatatcatcgacccgattgctattgccgaagtacgcgaagcactcactcgtactctggcgactgaactggcagatgagctgctggctatttacaacgcgaattaccagagcgagtaccgtgttgagcatgaagatattgcaaaacgcactctgcgtaatgcctgcctgcgcttcctcgcttttggtgaaacgcatctggctgacgtgctggtgagcaaacagttccacgaagcgaacaatatgaccgatgcgctggcggcgctttctgcggcggttgctgcacaactgccatgccgtgacgcgctgatgcaggagtacgacgacaagtggcatcaggatggtctggtgatggataaatggtttattctgcaagccaccagcccggcggcgaatgtgctggagacggtacgtggtctgttgcagcatcgctcatttaccatgagcaacccgaaccgcattcgttcattgattggcgcatttgcgggcagcaacccggcagcgttccatgccgaagatggcagcggttatcagttcctggtggaaatgcttaccgacctcaacagccgtaacccgcaggtggcttcacgcctgattgagccgctgattcgcctgaaacgttacgatgccaaacgtcaggagaaaatgcgcgcggcgctggaacagttgaaagggctggaaaatctctctggcgatctgtacgagaagatcaccaaagcactggcttgatacttttgagccaaaatgcttgacgcgtcttatcaggcctacaagtccgttgaaattgctggttttgtaggctggataaggcgttcacgccgcatcaggcagtcgtgcccaactgcctgatgcgacgcttgacgcgtcttatcaggcctacaatcccgttgaaaatgctggttttgtgcgccacatccggcatattaaccatgacgtcgaatcggttgttcagagtgcccacgttgcatcacccgctgcaacacttccgcttccagctctgctaatcgtaccgaccctaaccggcgcggacgggggatatccaccgtcaaatccagaccaatttttccctcttcaattaacaacacccggtcagccatcgccaccgcttcgctcacatcatgcgtcaccagcaagacggtaaagccgtgctcctgccagagtgacacaatcaaatcctgcatctcgagtcgcgttaaagcgtccagcgcaccgagtggttcatcaagcaacaataaacccggtcgatgaatcagcgcccttgccagcgccacacgttgtttctgtccgccagaaagtgcggcaggccattcccccgcgcgattctccagccctaccgcagccagagcctgacgcgccgcatcgcgccactggcctttaaggcctaacccaacgttatcaatcaccgatttccacggcagcagacgcgcgtcctgaaacatcattcgcgtatcatcctgaatctcagccagcggtgtggtgcccgctaacacgtcgcctgcggttggcgtttccagacctgccagcaggcgcagcagagtacttttgccaccgccgctgcggcccaccaccgccacaaactgacctgccggaatatgtaaatccagttggttcaggacgatattttccgcgtaatgtttgcttactgcattgagcaacaatggtgtgccctggttcagacgagccgtattcataccgtggcctccttcaaatgataagccgggttccagcgcaaccagagacgttctaacagctgcgcgctgacgtcagcaagtttgccgagcagggcgtaaagaataatagcgactaccaccacgtccgtttgcagaaactcccgcgcattcatcgccagataaccaatgccggaattggcagaaatagtttcggcaacgatcagcgtcagccacatcaggcccaacgcaaaacgcacaccgaccataattgagggcagggcaccaggcaggatcacatggataaacagcggtatgccggataatccatagctacgtgccatctccaccagcccacggtcgatattacggatgccatgccaggtgttgatataaatggggaatagcgtaccgagcgccaccagaaagatttttgcggattcatcaatgccaaaccacaaaatcaccagcgggatcagcgccagatgcggcacgttgcgcaacatctgaatggaggtatccagcagtcgctcaccccagcgtgacagcccgctaatcagccccagaattaatcccagcgatccgccaattgaaaaaccaatcagcgcacgccaggagctgatcgccagatgctgccacaattcgccgctggcagagagcgtccagaacgccatcaccactccttccggtgagggcaaaatacgcgtcgataaccagccaaccgaggaggccagttgccacaccgccacgatgcccaccggtaaaaaccagggggcaacgcgcaataaccacttcttcactggcgttgccatcatcgtgttccttagctttgcgcgacgttacgggggataaaatcattcgccaccgcttcgccttgtggattcagcggttgtggctggggaatttccgggatggcgacatccagatgtgggaacagtaactcgccgacccgatacgcttcttccagatgcgggtagcccgaaagcacaaaactgtcgatgccaagtgcagcgtattcgttgattcgcgcggcgaccgtaggaccatcgcccaccagcgccgtcccggcaccgccgcgcactaagccaacacccgcccataaattggggctgatctccagattgtcgcgcttgccgttatgtagcgccgccattcgctgttgtcctacggaatccgttcgggcgaatgcggcctgtgctttggcgatagtttcatcatcaagacgcgagattaaccgctcggcggcctgccacgcttcgtcgttggtttcacgaacaatcacatgcagacgaacaccgaaacgaattttgcgtccatgcgcggcagctttcgcccgcacgtgttcgattttctcttttaccagttccggtggttcgccccaggtaaggtagagatcaacttgttctgccgccagctcctgggcgacatctgacgatccgccaaagtaaagcggaggataaggctgttgaatcggcgggaagagcagtttggctccgcgtacatgaatatgtttgccgttgaaatccacagtctcgccaagcaacaaccgccgccagacctgggtaaattctgccgaggcttcgtaacgctcgctatgatcaaggaacacgccgtcgcctgccagttcttgtggatcgctgcctgtgaccaggttaaacaacgcacgtccgttagagagacggtcaagcgtggcggcctgacgggcggcaacggtaggtgaggttacgctggggcgcagggcgacaagaaacttcagccgttgtgtcaccgggatcatcgacgccgccaccagccacgcatcttcacacgatcgccccgtcgggatcagcacaccggtatagcccagacgatccgccgcttgcgcaatttgttgcagataaccgtgatcaaccggacgtgaaccttcttccgttcccagataatgcccgtcaccgtgggtcggtaaaaaccagaacatattcagactcataattgttttccttccagttgagtgggctgccagatgcgctggcgaatatcgacttttttcggcaccagacggttttcataaaacagatctgccgtttgctgctgtaaggcggcaacttcagcgctcaacggtttgatggtggtgggaggacgatgatccagatatgaggcaataaccggtgccggtaagcccatcgtttttgccagtaaagcgatgctttgttcgcgctggctgcgggttaacgcatcggcctcactaaaggttgtcagcacaccctgaataaaagcgccgtttttttctgcatacggacgagctgccagataaaacgatccagtttgattgagatcggtgccgtctttcagcacccgcacgccgccctgtaataatgcagcggagtagtagggatcccagatagcccaggcgtcaacgttaccttgctggaacgcggcgcgggcatcggcaggcgtcaggtaagtgggctgaatatccgtgaatttaagcccggcctggcgaagggctcgcagtaaaagattgtgcgaactggaacctttctgaaaggcaactttgtgacctttaagatcggctacggttttgatcgggctgttttctgccaccagaatcacttcggctttgggtttcggtggctcgacgcccacgtataccaaatcagccccggcagcctgggcaaagattggcggaatatccccggtactgccgagatcgatactgccaacgtttaacgcctccagcatctgtgggccagcggggaactccacccaggagatttttgtttgcggatagcgtttttccagtaactggtggctttttgccagcaccataccaatactgcctttttgatagcctatacgtaacgcctctggcgaagactccgcggcaacagcaagtgtagagacgctaagtaaacccgccagcgccagtttaatgatcttacgcatgggcattacctcgcagagacagaaggtcaggaacctgaacatcgcggcggtgcaacgcctgccagaaagtttctagcgcggtatcaagacgagtttgcagatttggcgtgaactggggtttgtgttggtaatcaattacttgcgagtcatcggcaaacacgccgtgcaggatctcctgggctttcagcgtacttaaaactggcttaagggcataatcgaccgccagcagatgggccacggtgccgcctgtcgccagcggcagcaccactttgccttgcaacgcacgttctggcagcaggtcgagcagggttttcagtgcaccggaataggcggctttatacacaggcgtggcgacaatcagcccatcggcctgttgcagctgttcggtgaaggtcttgagtgccggactatcgaaacgagcataaagcagatcttccgggacgaagttttgcaaattccagtgataaacctctacatccaggccatttagtttttcccgcgcatattccagcaaggagctggagcgagaaggaaagcgaggactacccgccagggtgatgacacgcatactctctccttataaccaattgttcttgttttgttaacattgataacaattcggtcagtctgacagagggcgtccgcgagtcgaaatgatttatctgaggaagaaaagccaaaaaaagcataaaaaaagcgcaataagaaaacgtttgctatttattgccgcaggtcaattcccttttggtccgaactcgcacataatacgcccccggtttgcacaccgggaatccaggagagttcatgtactaccccttcgttcgtaaagcccttttccagctcgatccagagcgcgctcatgagtttacttttcagcaattacgccgtattacaggaacgccgtttgaagcactggtgcggcagaaagtgcctgcgaaacctgttaactgcatgggcctgacgtttaaaaatccgcttggtctggcagccggtcttgataaagacggggagtgcattgacgcgttaggcgcgatgggatttggatccatcgagatcggtaccgtcacgccacgtccccagccaggtaatgacaagccgcgtctctttcgtctggtagatgccgaaggtttgatcaaccgtatgggctttaataatcttggcgttgataacctcgtagagaacgtaaaaaaagcccattatgacggcgttctgggtattaacatcggcaaaaataaagatacgccggtggagcagggtaaagatgactatctgatttgtatggaaaaaatctatgcctatgcgggatatatcgccatcaatatttcatcgccaaataccccaggattacgcacactgcaatatggtgaagcgctggatgatctcttaactgcgattaaaaataaacaaaatgatttgcaagtgatgcaccataaatatgtgccgatcgcagtgaagatcgcgccggatctttctgaagaagaattgatccaggttgccgatagtttagttcgccataatattgatggcgttattgcaaccaataccacactcgatcgttctctggttcagggaatgaaaaattgtgatcaaaccggtggcttaagtggtcgtccgcttcagttaaaaagcaccgaaattattcgccgcttgtcacaggaattaaacggacgcttgccgattattggtgttggcggcattgactcggttatcgctgcgcgtgaaaagattgctgcgggtgcctcactggtgcaaatttattctggttttatttttaaaggcccgccgctgattaaagaaatcgttacccatatctaattatttcttcaaattcctctttataagataatcagggctttattttcagccctggttgttttatattcatcgctgttgcttatttagacattttgtacttttattgttgaggttattaagcgaagcgacaatggattgtgtcgctgcggttttataaggttggggagtggcagatgcgaattaaaccagacgataactggcgttggtattacgatgaagagcacgatcgaatgatgctcgatttagccaatggtatgctatttcgctcacgttttgcgcgcaaaatgttgactccagatgccttttctcccgcaggtttttgcgttgatgacgccgcgctctatttctcttttgaagaaaagtgccgcgattttaatttatctaaagaacaaaaagccgaactggtgctgaatgcactggtagcaattcgttatctcaaaccgcaaatgccgaaaagctggcattttgtatctcatggtgaaatgtggatgcccatgccgggcgatgcggcctacgtttggttgagcgacactcatgagcaagtgaatttactggtcgttgaatctggcgagaatgccgcgctatgtctactggcacaaccctgcgttgttattgcgggtcgcgcgatgcagttgggcgacgccattaaaatcatgaacgacaggctgaaaccgcaggttaatgttgacagcttcagcctcgaacaggcagtctaacgcgccagcttaagcgcagtcttcggtacacaactacagcaaagaatagtgccatcatcgcctattgctgatttttttagcggcgtgacttcgccttctaaaagctgaacacggcaacttccacaaatgcccgcgtggcaagaataagggatacgaattccctgattttctaattgctccagcagcacctgttggttatttccacgaaatgcctgtccctgccagtcaatatctacgtttgcgtccggttgttgcgtgatgttggcagtatcatcagcggcacctgcgccgtaaattttagccggagccgttgccagaatttccacctcatcgccaacgcgaatcacgccgctattacggacaattaaattctgaccaaaatcgacatcgccgttatcctgggcagtacggaaagattgcagcgtttttaatggttcgcctgccggatgtttttgccctttttctgggctgacggtggtgaaaatacagcggctacaaggcttaaccacatcaaacacgacatcaccaatgcgaatcactttccagctatcttcttcccaggccgatgcaccggaaaccaccagattggggcggaattgctccatttttacactggccggacaacgttgttggagatcacgtaacgaggcctcgttagcaagaaggtaaggatagccatcagcaaatgacaggggtacagtgttgtggcgtttcacgcgccgggtcatttgtggccccacccagcgtaattgcacttcgcgggagaaaaatccacttagccatttgttgatcgcgtctggcgcaattcgcgcggtaaaatgtgtgccccaaacttcggttggtgcgtcttgtgtggcgaaatcagcaaaacgaacatatgcactactgccatctggtgcggtgagatgcaagccatcatgcacgggtgaaggagtaaaccgtaccattagcggaaactggcgagcggtaataaacgtaccgtcagtttcagtgatcataaagatgcgatcgaaggccagaccactgacatctgccagggtatgtgtaagaccaatgccgcgcatcgatttaacaggatgaataaaaagccgggttaatgtcgccacggtgcggtcctcaaatgaaaataagccctcaactttatgacatgacgcgcttattagctataatgcgcaacaattttcttagagtaaaagtgacaatatgaattctctgtttgccagtacggcccgtgggctggaagagctgttaaaaactgaactggaaaacctgggggccgttgaatgccaggtggttcagggtggggtccatttcaagggcgacacacggcttgtttaccagagcctgatgtggagccgcctggcctcgcgtattatgttgccgctgggcgagtgtaaggtttacagcgatttagacctctatctcggtgttcaggcgatcaactggacagagatgtttaatcctggcgcgaccttcgctgtccacttcagtggtttgaatgacaccatacgcaacagtcagtacggtgcgatgaaagtgaaagacgcgatcgtcgatgctttcacgcggaaaaatctgccgcgtccaaatgttgatcgcgatgcgccggatatccgcgttaacgtctggctgcataaagaaaccgccagtatcgcccttgatctcagtggtgatggtttacatctgcgtggctatcgcgatcgtgctggcatggcgccgatcaaagaaaccctggcagccgctattgtgatgcgatccggctggcagccaggaacaccgctgctcgatccaatgtgtggttcaggtacgttgctgattgaagcggctatgttggcgaccgaccgcgcaccgggcttgcaccgtgggcgttggggctttagcggctggacgcagcatgatgaagctatctggcaggaagtgaaagcggaagcgcaaactcgtgcccgtaaaggcctggcggagtatagctcccatttcttcggttcggacagtgacgcacgggtgattcaacgtgcgcgcactaacgcccgtcttgcggggattggtgaactgatcacctttgaggtgaacgatgtcgcgcaactggccaatccgctgccgaaagggccgtacggtacagtgttgagcaacccgccatacggtgaacgtctggacagcgaaccggcgctgattgcgctgcatagtctgctgggccgaatcatgaaaaaccagttcggtggctggaatctctctttgtttagtgcctcgccggatctgctaagctgcctgcagctgcgtgcagacaaacagtacaaggcgaaaaacggcccgctggactgcgtacagaaaaactaccatgttgccgaaagcacaccagacagcaaaccggtaatggcagcggaagactacgccaaccgtctgcgtaagaacctcaaaaaattcgagaagtgggctcgccaggaaggaattgaatgttaccgcctgtatgacgccgatctgccggaatataacgttgccgttgaccgttatgccgactgggtggtggtgcaggagtatgcgccgccaaaaactattgatgcgcacaaagcgcgtcagcgtctgttcgatattatcgctgcaaccatttcggtactggggattgcgccaaacaaactggtgctgaaaacccgtgaacgccagaagggcaaaaatcaataccagaaactgggcgagaagggcgagtttctggaagttaccgaatataacgctcacttgtgggtgaacctgacggattacctcgataccggtctgttcctcgatcaccgtatcgcccgtcgtatgctcggtcagatgagcaaaggcaaagatttcctcaacctgttctcttataccggcagcgccaccgtgcatgcgggattaggcggtgcacgcagcaccaccaccgtggatatgtcgcgtacttatctggagtgggcagaacgcaacctgcgtctgaatggcctaaccgggcgtgcgcatcgcctgattcaggccgatkgcctggcgtggctgcgtgaggcaaatgaacagtttgatctgatctttatcgatccgccaaccttctctaactcaaaacgaatggaagatgcgtttgatgttcagcgcgatcatctggcgctgatgaaagatttgaaacgtctgctgcgtgcaggtgggacgatcatgttctcgaacaacaaacgcggcttccgtatggatctcgacggcctggcgaaactgggactgaaagcacaagaaattacgcaaaaaacgctctcccaggatttcgcccgtaaccgccagatccacaactgctggctgattaccgcagcctgaaaggaatagtaatgtcattaatcagtatgcatggcgcatggctgtcgttcagcgacgcgccgcttctcgataacgcagaactgcatatcgaagataacgaacgtgtttgtctggtggggcgtaacggtgcaggcaaatcaacgttaatgaagatcctcaaccgtgaacaggggctggatgacggtcgcattatttatgagcaagatttgattgtagctcgtctgcaacaggatccgccgcgtaacgttgagggtagcgtttatgatttcgttgccgaaggcattgaagaacaagcggaatacctgaaacgctatcacgatatttcgcgcctggtgatgaacgacccgagcgagaaaaatctcaacgaactggcgaaggttcaggaacagctggatcaccacaacctgtggcagctggaaaaccgcatcaacgaagtgctggcgcaactgggattagatcctaatgttgcgctgtcgtcgctttccggcggctggttgcgtaaagcggcattaggacgcgcgctggtgagcaatccgcgcgtattgctgctcgacgaaccgactaaccacctggatattgaaaccatcgactggctggaagggttcctcaaaaccttcaatgggacaattattttcatttcccacgaccgttcgtttatccgcaatatggcgacgcgcattgttgatctcgatcgcggcaagctggtgacctatccagggaattacgaccagtacctgctggaaaaagaagaagccctgcgcgtggaagaattacaaaatgccgagttcgatcgcaaactggcgcaggaagaggtgtggatccgccaggggatcaaagcacgtcgtacccgtaatgaaggccgcgtacgcgccctgaaagcaatgcgtcgcgagcgtggtgaacgtcgcgaagtaatgggtaccgcaaagatgcaggtggaagaagccagccgctccggtaagatcgttttcgaaatggaggacgtttgctaccaggttgacggtaagcaactggtgaaagatttttctgcccaggttctacgcggcgacaaaattgccctgattggtccgaatgggtgcggcaaaaccacgctgctgaaactaatgctcggtcagcttcaagcagacagcgggcgtattcacgttggcaccaaactggaagtagcttatttcgatcagcaccgcgcggaactggatcccgataaaacggtgatggataaccttgccgaaggtaagcaagaggtgatggttaacggcaagccacgccacgtattgggctatttgcaggacttcctgttccatccgaaacgcgcgatgacgccagtacgtgcactttctggcggagagcggaaccgcttgctgttggcgcgtttgttcctcaaaccaagcaacttattgattcttgacgaaccgaccaacgatcttgatgtcgaaacgctggaactgctggaagaactgatcgacagctatcagggcacggtattgctggttagccacgatcgtcagtttgtcgataacaccgttacagaatgctggatcttcgaaggcggcggtaaaattggtcgttatgtcggcggttatcatgatgcccgtggtcagcaagaacagtatgtggcgctcaaacagcctgcggtgaaaaaaatcgaagaagccgccgcgccaaaagcagaaactgtaaaacgcagcagtagcaaactaagctataaattgcagcgcgaactggagcagctaccgcaattgctcgaagatctggaggcgaagctggaagccctacagacgcaagtggcggatgcttccttcttcagtcagccccatgagcagacacaaaaagtgctcgccgatatggctgctgcagagcaggagctggagcaagcctttgaacgctgggagtatcttgaagcgttaaaaaatggtggctgatcgcaaaatagtcgatttaaacagagacagctgacaacggtaaaattgcctgatgaactgggtttatcaggcatgaaaaccaacactttgttcgtcatctgtaaaatagcgcatcattaaggagtaccaatgtgcgaacatcatcatgccgcgaagcacatcctgtgctcgcagtgtgacatgctggtggcgttaccgcgccttgagcatggtcagaaagcggcatgtccccggtgtggcacaacgttaaccgtggcgtgggatgcccctcggcagcgtcccaccgcctatgcgttggctgcactgttcatgctgttgctgtccaacttgtttccttttgtgaatatgaacgttgcaggagttaccagtgaaattacattactggaaattcccggcgtgcttttttctgaggactacgccagcctcggcacctttttcctgttgtttgtgcaactggttcccgcgttttgtctgataaccattctgttactggtgaatcgcgcggaattaccggtccgtttaaaagagcaactggcacgggtgctttttcaactcaaaacctggggaatggcggagattttcctcgcgggtgtgctggtcagtttcgtgaaactgatggcttacggcagcattggggtaggcagcagctttctcccctggtgtttattttgtgtcctgcaactgcgcgcttttcagtgtgttgatcgtcgctggttatgggacgacatcgccccgatgccagaactgcgccagccgctaaaaccaggtgtcacggggatacgtcaggggctgcgttcgtgctcctgttgtacggcaatccttcctgctgatgaatccgtgtgcccgcgttgtagtaccaaagggtacgttcggcgtagaaacagcctgcagtggacactcgcgctgcttgtaacgtccatcatgctgtatcttccggctaatattttgcccatcatggtgacggatttattaggctcgaagatgccgtcgacgattctcgctggggtcattctgttatggagcgaaggctcttatcccgtcgctgcggtgatttttctggccagtattatggtgccaacgttaaagatgatcgccattgcgtggctgtgttgggatgccaaaggacacggcaagcgcgacagtgaaagaatgcatttgatttatgaagttgttgagtttgtaggccgctggtcgatgattgacgttttcgttatcgcggtgctctcggcgctggtgcgtatgggaggtttaatgagtatttatccggcaatgggtgcattaatgtttgctttagtcgtcataatgacaatgttttctgctatgacgtttgacccgcgtttgtcgtgggatcgtcaacctgaatcagagcatgaggagtcctgacagtatggaatctaataatggggaagccaaaatccagaaagtgaagaactggtctcccgtgtggatatttcctatcgtcacggcgctcattggggcctgggttcttttttatcattacagccatcagggaccggaagtgaccctgatcaccgcgaatgcggaaggaattgaaggtggcaaaaccaccattaaaagccgtagcgttgacgtcggcgtggttgaaagcgccacactggctgatgatttgacgcacgttgaaatcaaagcgcggctgaattccggtatggaaaagttgctgcataaagataccgtcttttgggtggtgaaaccgcagattggtcgagaagggattagcggcctgggaacactgctgtctggggtttatatcgaactgcagccaggcgcgaaaggcagcaaaatggataaatacgatttgctggactcgccaccgttggccccacctgatgcgaaaggtatccgtgtgcttctcgatagcaaaaaagccgggcagctctcgccaggagatccggtgctgttccgtggctatcgggtaggttcggttgaaaccagcactttcgatacgcaaaaacgcaatatcagttatcaactgttcatcaatgcaccttatgaccgactggtgaccagcaatgttcgtttctggaaagatagtggcattgcggttgatctgacgtcagcgggaatgcgtgtggagatgggctcattgacaacgctgcttagtggcggtgtcagctttgatgtgccggaaggtctggatttagggcagccagtggcaccgaaaacagctttcgttttgtatgatgatcagaagagcattcaggattcgttgtacaccgatcacattgattatctgatgttctttaaagattcggtacgcggtctgcaaccgggagctccggtagaattccggggtattcgcctgggtaccgtaagcaaagtgccattctttgcgccgaatatgcgtcagacatttaacgatgattaccgtattccggtactgattcgtatcgagccagagcggctgaaaatgcagcttggcgaaaatgcggatgttgttgagcaccttggcgaattgttgaaacgtggtttacgcggatcgctgaaaaccggaaacctggtcactggcgcactgtatgttgatctcgatttctatccaaatacgcctgcaataaccggtattcgtgaatttaatggttatcagattatcccgaccgtcagcggcggcctggcgcaaatccagcaacgactgatggaagcgttggataagatcaacaaactgccactgaatccgatgattgaacaggcaaccagtacgctttctgaaagtcagcgcacaatgaaaaacctgcaaacgacgctggatagcatgaacaagatccttgccagccagtcgatgcagcagttaccgacggatatgcagtcaacgttgcgtgaattgaatcgcagcatgcagggcttccagcctggttccgcagcctacaacaagatggtggcggatatgcagcgccttgatcaggtgttgcgagaactgcaaccggtgctgaaaacgctcaacgagaagagtaacgcgctggtatttgaagcgaaggacaaaaaagatccagagccgaagagggcgaaacaatgaaaaagtggctagtgacgattgcggcactgtggctggccggatgcagctccggcgaaattaataaaaactattaccagttacctgtggtgcagagcggtacacaaagcaccgccagccagggtaatcgcctgttatgggttgagcaggtcgctgttcctgactatctggcggggaatggtgtggtttatcaaaccagtgatgtgaagtatgtgattgccaacaacaacctgtgggccagcccgttggatcaacagttgcgcaacaccctggttgccaacctgagtacgcaactacccggctgggtggttgcctcccagcctctgggaagcgcccaggacacgctcaatgttaccgtcacggagtttaacggtcgctatgatggcaaggtcattgtcagtggtgagtggctgttgaaccaccagggacaactgatcaaacgtccgttccgtctggaaggagtgcaaactcaggatggttacgatgagatggttaaagtgctggccagtgtctggagtcaggaagccgcttctattgcgcaagagataaagcgtctaccttaatcataaagatttgtaaatataaccgtctccggtatgttgcctgaggcggtttttttgtttctaacgtgcggaaaaagttgttcctcttcacattttttgtacaaccgacatgcccgtgtagctcacaaatatgacagtggcgtgaattttgcgcattgacggcagttatgattcgcggtattgcttaactgtgattgcatatttagtaatcactgttttcttttccaccagaaaccagtatgagggaaacgaggcatgaagagacaaaaacgagatcgcctggaacgggcacatcaacgtggttatcaggccggcatcgccggacgctcaaaagaaatgtgtccctatcagacgctgaatcaaaggtcacaatggctgggaggctggcgagaagccatggcggacagggtagtaatggcctgattctgtctctttaaaaagaaacctccgcattgcggaggtttcgcctttatatactctgtctgattaaaatcagaatgcagacgtatcctggaacagacctactttcaggtcgttggcggtatagatcaaacgaccatcaaccagcacttcgccatcagccaggcccataatcagacgacggttaactatgcgtttaaagtgaatacgataggtcacttttttcgccgtcggcagcacctggcctgtgaatttcacttcacctacgcccagcgcgcgacctttaccttcgccgcccagccagccgaggtagaaccctaccagctgccacattgcgtccaggcccaggcatcccggcataaccggatcgccgataaagtggcatccgaagaaccacagatccggattgatatccagctctgcttcaacataccctttgtcgaagttaccacccgtttcggtcattttgaccacacggtccatcatcagcatgtttggtgctggcaattgcgggcctttagcgccaaacagttcaccgcgaccagaggcaagaaggtcttcttttgtataggattcgcgtttatctaccatgttctctgtaagccttattttattgaagcacgcaggatagctaacacgtgtacgctgaacaagtccgatcagttcggaataaaccagttcagccaacgtaatggccatggaaaacggtgacgtccttcctgttgcgatgcttgtgcgatacgttcctggatggtttgcatcagcgtcgtttggccttcgccatcccacaccagatttaataataacggcagtgcgtcagtcacatcgtctactgcccagatggtgaatttgtcttcttctaccgctttcaccagttcactgtgaagacttaaatggcgaacgttagctgtggggataatgacaccttgtttccccgttaactcacgttgctggcaaatagcaaagaagccttcgattttctcatttaaaccaccgactggctgggcgcgaccgaactgatcgactgaacctgtgatagcgatactctgattcaccggcacatcggcgagggcgcttatcagggcgcagagttcagccatcgaggcactatcgccatccacttcactgtatgactgctcaaatgtcagcgatgctgagaaggggatctgttgctcaagctgtagttccgacatcaggaacgcttgcatgatcatcatccctttcgcatggatattgccgccaagctccgctttgcgttcgatgtcggtgaattcaccatcgccaatatgcacaacgcagctaatgcgagaagttcnnnnncattccattcattaattaattaatgaatgaatgnnnnngcacgctgtttcacgttgtcacaggtgttgccagtaaccgggttggattcgcccataccacgtgcggagattttgtctgccgggatacctttagagatcaggtaatcaacaacggactgagcacgacgctcggacagagcctggttataagcgtcagaaccgatgcggtcagtgtaacccagaacaactacggaaccgtctttcggatccaggttgctcagctggctgtacagctgatccagagcagcctgaccttccggtttcagggttgctttgttgaaggtgaacagaacgtcagacttcagagtgaagtgcttggtctgtacttccggtgccggagctggagccggagcaactactggagctgcttcgccctgaccgaaacggtaggaaacacccaggctcagcatgccgttgtccggacgagtgccgatggtgtgtgcgtcaccgatgttgttggtccactggtattccagacgggtagcgatttcaggagtgatcgcatactcaacaccgccagcgaagaccggagaaacgccggtgtcgtggtttttaccataaacgttggatttagtgtctgcacgccataccataccacccagacgagtgtatacgtccagatcgtcagtgattgggtaacccagtttagcggtcagctgaacgccctgagctttatatgcaccgttttcaacgctgcctttgtatggcatacgacctaaccagtcataacccatttcaaagccaacatacgggttaacctggtaaccaccaaaagcaccagcgcccagttggttttcatgggtcggaccattgttgttgatgaaaccagtgtcatggtactgggaccagcccagtttagcaccagtgtaccaggtgttatctttcggagcggcctgcgctacggtagcgaaaccagccagtgccactgcaatcgcgatagctgtctttttcattttttgcgcctcgttatcatccaaaatacgccatgaatatctccaacgagataacacggttaaatccttcaccggggatctgctcaatattaactctaccgatatcttcggcttatgccgagcacccctggcgatgtaaagtctacaacgtagttgaaaacttacaagtgtgaactccgtcaggcatatgaaaaaaaagtcttgtataaggtacgtttaatcttttttgtcagcgacaatttacagaagaaaatcgcggaaaccgcttcagacaagcctccgcaaggaaaattagtcacgactgaaagcattggctgggcgacaaaaaaagttccaggattaatcctaaatttacttaatgatacaaattagagtgaatttttagcccggaaagttgtctcgttgcgtgagaggatgcgcttaccggacgcataataaaccccatagcgttaccttcatttgccgcatcaacaagttcagcatgctcttcttcagtcaaatcatctgccaaccaaccgatcaccacgctgtaattgcccgtgcgtaaagcgcgaaccattgactccacggtgtggcaaggggagagctggctaatctgcattactttcgttaagggtagcccagatgcctgaacccattcgcgactcagtttttgttgcggtgttaaccagagttgccagcgcgattgctgaccgagttgctgtaacaatggcaacagtagaagttgcgtcatcatgggctgatcttcgcgatagacaacttcactgataagcccggctgtagtgttttccgtagagacacgcgcaattttacttgctgtggatgagaacgacgaatcacgatgtgcatagcctgcagtgtacataatcaatccagcccctgtgagttactgtatggatgtacagtacatccagtgacgacaaagatcaactctattttcggaaagagcctcgcaaattttgtcgttggtgacgggaaaacataaattaatcttgccccttaagaataagttgcctattttcgtagttaacggatccgttaatgtgaatcattcttttattttatgattttaaaaggaattttatgaaaagcctctcctataagcggatctataaatcacaagaatacctggcaacgttgggcacaattgaataccgatcattgtttggtagttacagcctgaccgttgacgacacggtgtttgcgatggtttctgatggtgagttgtatcttcgggcttgtgagcaaagtgcaccgtactgtgtaaaacatccgcctgtctggctgacatataaaaagtgtggccgatccgttaccctcaattactatcgggttgatgaaagtctatggcgaaatcaactgaagctggtgcgtctgtcgaaatattctctcgatgcagcgctgaaagagaaaagtacgcgcaatattcgggaaagactgaaagatttgctcaatatgtcttttcatctggaagcgattctcggggaggtggggattaaggatgtacgggcgttacgtatacttggggcaaaaatgtgttggttgcgactgcggcagcaaaacagtctggtgacagaaaagattctgtttatgcttgaaggggccattatcggcattcatgaagctgcgctcccggtggcacgccgccaggagcttgcagaatgggctgactctcttacgccgaaacaggagtttcctgcggaacttgagtaatctggcgttgcagacgaccaatctctggcagtaatgcaatcaataacccaacttgttgtacgaccagaggttctttgctgtctgcccgtggttcaagttgctgcatccgctgtttcaggccagctaatgcctgattgacgcgttcttcatcagcaggttgatgatgtagcgcgtcatcaacatagcaaactgcgtcatcaagaaacgccagaatttcaggattagttaactgctcccggtgagcaccgagggctgagatatagctggtaaacgtatggttaaggcacagcaaccgaaacgcggcttcgcgaatttgcggggtaacgttcggttcgctggacatatttgataccaccgacgccagttcagcatcacggttgtgtgcatcgcggcgggcaatacgatacgccagacggttatcacgcccctgatggtattgttccagtatggcatcgagataccggcagttggcctctgtggcgcgttcgagcattcgcggcagattgcgaaacttccagtcaggccagatgtagctcactgccgcccacgcaatggcacaaccaatcagcgtatcgattacgcgaggtaacgccacttcaaaaccttcacccagcaagttgaaacacagtagcaccaaaagtgtgatgaacatcgttgcatgggcgtattgcacgttacggaaggcaaaaaagagcacgccggtaataaccagcagcaccaactgcccttccagtgatggcacaaaccacagcacaggaataccaattgcgatacctaccagcgtaccaataatccttaacttcaggcggtggcgcgtggcgttatagtttggctggcagacaaacaaacttgtcagcaagatccaatacccgtgatgcattccggttatctgaatgatggcgtagccgaagcacaacaccagcgacattcttaccgcatgacggaagagggcggattccggcgtgaagtgacggctaagacgcagccagatatcactcaatccgtgcgggctgtcatcagcgagctcattttcgtcattattatggggcagtgcctgggcctgttctgattcaattgttgccagttgggcatcaatggcacgtaaattgttcagtaaaaatcccagtgttttgagtaaatcagcaggagcgccgttatcgcgcatccgctccagcgcagcatcaatatgcgtaaaagcgcgctcaaaatgcggatcatgttgataaggctgacgcagcaaaatacagcgtgacagttgctggcacgcctggccctgcatcgacatcagccgctgaaaacggaacagcacgtcgctgtggcgaaaatgctcacgcaatgtttgatattgaatatgagaagagctggcacgctcgtgaatatcctgtgcgacaaagtaataatgcagtgtgcgacgcgttcctcgttgaccacgatcgccacgtaagcgggtcagcagcgagagtttcgtctgattcaatgtcgccatcagctgaccgttggcgagagccaaatcgtacagcggtgcctggctttcatcttcaatatcaggatcaaacatgcgcgacttgagctcaagataacgcgccagttgttcatagcaacgcgccaggttgtcctgcagcgggcggaccgggaacagcagatgaccaataagtgtcaggacgttgtaccagacggcaccggccagaagatacatcggctgctgataccagtgctcatacagtgatgttcccaacatagtgtaaatggcgatcagcaatgcaccgaaggcaattgttgcatagcgttgacccagaccgccgagcaaaatgaagccgctggtagagagcgttaagccaatcgcaaatagccagggccagggaaacagcaattctactgaggccgaggcgataaaaaagcagaacagcgtaatgatgaggttacgcaaacgtcccgccagtcggtcatcgagatcggtcagcgccgctgccaccatcccaagcgtcagcggaatcgtcagttttacatcacccagccaccacggaaacgctgtggttccacaaagcgcaataaaaatacgcgcgtaatacagccaggcgctgttccaggtatagcgtttgagcaaaggacttagcataaaggccatattagtggattattggaaacgacgacgtgcattggcttcgcgcgcagcttgcgctgtttctaccgataccacgcgacgaccgaccggccatagtgcaatagcggcaattttaaagttcgcaataccgacaggaatgccaatgatggaaatacattgtgcgatgcccgttgcaatgtgcatcaggcataaccaccagccaaagaaaatcagccagaaaatattcaataccgtaccgccagtatttagcagcacatttttgccagccgggttcagttcatcgacatgaatagcttcattgccataaggcaccagagacagtttggtgatctcccagcaggatcgtgtcagtggtaaggtaaaaatcagcacaatactgaccagagtcgccaacagccagcccagagtggtggcaaatccgccaagcacaaagttcagaatgttcaaaacggtacgcataaaacctcgctttactgtggttttcagtaatgggcggcaattgtaacgtttttttgggctggagcacgttttctctgacggttacactgataagaaataatttcgtgtggatctacagagtcatggaactgaaagcgacaacgcttggaaaacgtctggcacagcacccttacgatcgggcggtgatcctcaatgccgggattaaagtctccggcgatcgccacgaataccttattcctttcaatcaattactggcgattcactgtaagcgcggtctggtatggggcgagctggaatttgtactgccggacgaaaaagtggtgcgtctgcacggcaccgaatggggcgagacgcagcgtttttaccatcatcttgatgctcactggcggcggtggagtggcgagatgagcgaaattgcgtctggcgttttacgtcagcaactggatttgattgccacgcgcaccggagaaaataaatggctgacgcgtgagcaaacctctggcgtgcagcaacaaatccgccaggctttgtcggcgttaccattgccggttaaccgactggaagaattcgataactgccgtgaggtgtggcgtaaatgtcaggcctggttgaaggacattgaaggcgctcggttgcagcataatcaggcgtataccgaagccatgcttaccgagtatgcggattttttccgccaggtcgagtcttcaccgctgaatccggcgcaggcccgggcagtcgttaatggcgagcattctctgttagtgctggcaggtgcaggaagcggaaaaacgtcggtgctggtggcccgtgctggctggttactggcgcgtggtgaagcgtcccctgagcaaattttattgctggcgtttggtcgcaaagccgctgaagagatgcacgagcgtattcgagaacgactacataccgaagacattaccgcacgcacgtttcatgcgctggcgctgcatattattcagcagggcagcaaaaaagttccgatagtcagcaaactggaaaatgataccgctgcccgtcatgaactttttattgctgagtggcgcaagcaatgcagcgaaaagaaagcgcaggcgaagggctggcggcaatggctgacggaagaaatgcagtggtcagtgccagaaggtaatttctgggatgatgaaaaattacagcgtcgtcttgcctctcgcctcgatcgctgggtaagtctgatgcggatgcacggtggtgcacaggcagaaatgattgccagtgcacccgaagagattcgcgatctgttcagtaaacgtatcaagttgatggccccgttattaaaagcctggaaaggtgcgctgaaggcagaaaacgctgtcgatttttcgggccttattcaccaggcgattgtgattctggagaaaggtcgctttatcagcccgtggaagcatattctggttgatgaatttcaggatatctcgccgcagcgtgcagcgttgttagcggcattacgcaagcaaaatagtcaaacgacgttgttcgctgttggtgatgactggcaggcgatttaccgattcagcggtgcgcaaatgtcgcttaccacggctttccatgaaaactttggtgaaggtgatcgctgtgatttagacacgacctaccgttttaacagtcgtatcggtgaggtggcaaacaggtttattcagcagaacccaggccagcttaaaaagccgctaaacagcttaaccaatggagacaaaaaagccgtcacgttattggatgagggtcaacttgacgctttgctggataaactctctggttatgccaaaccggaagagcgcattctgatcctggcgcgttaccatcacatgaggcctgccagcctggaaaaagcagcaacacgctggccgaagttgcaaatcgactttatgaccattcatgccagcaaagggcaacaggcggattacgtcatcatcgttggcttgcaggaggggagtgatggttttccggctgcggcgcgggagtcgattatggaagaggcgctactgccaccggttgaggatttcccggacgctgaagaacggcggttaatgtacgtggcgctgacccgggcacgtcatcgggtatgggcactgtttaacaaagagaatccctctccctttgtggatatactgaaaaatctggatgtgccggtggcgagaaaaccgtaagaaacaggtggcgtttgccacctgtgcaatattacttcagacggtctgcgagataacgctgataatcggggatcagaatatcgaccgcgtcgttaaaatgcggtgactggataatgaagtctgccgttgccacgttggtggcgaccggaatgttccataccgttgccagacgcagcaaggctttcacgtcaggatcgtgcggcacggcatttagtgggtcccagaagaaaatcaatacatcaattttcccttctgagatcaatgcgccaacctgctggtcaccccccattgggccactcaacatcgcgttgacgttcatgccggtcgcgcgggaaattaagttaccggtagtgcctgttgcatacagtacgtgttgttccagtaacggttgatgccgttccacccagctcatcagcatttgtttgcagtgatcgtgtgccaccagcgcaatatgtttccgcgaaggtaaagtgcgagtcgtcagttccataatgtacatccgtagttaactttcctacagattactgtaagtacttatcgctgcaagataaagactgaaaaagcctgcgcacaggcacaaaaatctcaggaggatggttgtttttccgcccattgcaggaaagtatttcgcgtttgtgggtcagccagtttaaaccaatacttcagccgttgttctgtgagcacctgagactgcggcggaatagcatccagctcggaaacacccgaaagcagcgtactgtcatctgccatcatcgtggcaaattgcggtagtgaagcgcgtttcgcggatttgttatagcgttcaacctcgacctcataatcaatcgtttttgcagttgaggtaatggcgagaatatccagctttaccggaatcggcgtcgcatcgccatccaacaattcaaggcgcggcgcggcatcaaaatggttagcttcccgctcattctccaggcgaggcaggcgaaaattgacctggttgatgagctgggtattaaaactaaccaccagtggaggggagatatagagccgttcttcactattggaaagatgaatcgtcttctcaacgcgaaacactaactgatgcggtccattgtccagttcaatgctgtccgcaccgcgcagcagagagctggaaaccttcttaccgtcgagtaccagaagatcgacatcagtagaaagccgcagcgtggtggcaaaaacggataccggcaaacataatgcaatcaaggtggtcacgatgccggttttcatagatagctcctgttaaaagaccgcccgaataataatgtgtcaaaatttttctttaatcatacttactaacatatagacatatttcccgcttttgctctcattcattcgtattagctgcatggttggcatgtcggctttgtcgtacactttgttaaacagtctggaggaaataatgaaagaaaccgatattgcaggcattttaacgtccactcacaccattgcgctggtgggggcaagcgacaaacccgatcgtcccagctatcgcgtgatgaaatatctactcgaccaggggtatcacgtcattcctgtttcgccaaaagttgccggcaaaacactgctgggccagcaggggtatggcacgctggcagacgttccggaaaaagtcgatatggtcgatgttttccgtaattcagaagcggcgtggggcgtggcgcaggaagctatcgccattggcgcgaaaaccctctggatgcaactgggggtgattaatgagcaagcggcagtgctggcgcgtgatgcagggctaaacgtggtgatggatcgctgcccggcgattgagatccctcgcctgggcctggccaaataaaaaatccccggaaggcaaaaaccttccggggatttgttcagggattagttacgcagacgcggggcctggagttgtttgcggatggtctgcgccagctcatccatggatggctgttcaggatgttcatcctgcaattcgctacttagctgggcttcagccaggtaggtatgaaccggtaggccgttatcatcctccatcaccacgtgataccacggagcggcgcgaagctcgtcattcaccgccagctcatcaggcgacggttcagagagcgaataaaccgggtcgatatccacgaccactccgagataacctaacagggaatggcggacctgctggccgataccgaatttgctggcaatcatagtcacctcccgggaaatctttacctttgatataagggtaaaattccacatttcaagttacatgacgcgacaggcaaaccctttcagatatagcccttccgggtaggtagcgatcaccggatgatcggctgcctgacggaactgctctataaattgtacatcacgaccggcatcaattgcggcatccgcgatgattttctgaaataaatcgctggtcatcagaccggaacaggagaaagtcaggagaataccgccttcattcagcaactgaatcgccagcatgttgatgtctttataaccacgacacgcgcccatcaactggcttttattctcaacaaacttcggcgggtccatcacgataacatcaaatttttcaccgcgatcgcgataagtacgcagcaatttaaagacatcatcacggacaaactctgccttgctcagatccagtttgttcagctcaacgttctgccgtgcaatatccagcgcttcgtgggaggtatcaacgctgacaacctggctgcaaccgcccatcaatgccgatacggcgaaaccaccggtataggaaaaacagttaagtacgcgtttattttcgacgtagcggcgggtagccaggcggctgtcacgctggtccaggtagtagcccgttttgtgtccgtgctgaatatccaccagcagtttcatgccgtgttcttcaatcggcagcagggcaggcggcaactcgccggtgatggggccctgagtcagctccatcccttcttttttacgtaccgcgacgtcgctgcgatcgtaaatagcacattccgggtacagcgtttgcagggcactaattaatgccgcgcgctgatactctgcgccagcactcagcagttgcagcaccagaaaattaccgaaacgatcgatagtaatacccggcaggccatcagattctccggcgattaaacgatagctgtcgaggccatctttttgcgccagccagtcacgccatttttgtgcttgctgtaaacggcgggtaaaaaaagcaatgtcgatagactcagacgggtcaaacgtccagacgcgcgcccggatttgcgaagctggcgaataagcgccgcgtgctaaccattttccctgatgatcaacaatatcgatggtttcaccgaggctggctttaccttccatgcgggcaacggccccggaaaagacccacggatggcgacgaagtaatgatttttcgcgccctttggctaacactaaacgtacactcataatttacttttctgtcgatgcaaagaaatgggcgtcattgtccggagttttccatggatttgcaacgcgtccattaaggataaggagagcagcaatgtcgaaagtctgcataattgcctggatttacgggcgagttcagggcgtaggattccgctacaccacgcagtacgaagcgaaaaaactgggactaaccgggtacgccaaaaatcttgacgatggcagcgtggaagtggttgcctgcggtgacgaagggcaggtggaaaaattaatacagtggttaaaaagtggcggcccgcgttcagcgcgtgtggaacgggtgcttagcgagccgcatcatccctccggggagttaacggattttcgtatccgttaaatgcattttaccggtttaggcaggccagcaattttggtggcttgctttgccggacctttcggaaacagtcggtataaatagcggctgttacctttttcttcgccaaatttattcgccatcgcttttaccagcatacgaatcgccggagaagtattgaattccagatagaaatcacgcacaaaacgcaccacttcccagtgttctggcgacagcgcaatcccttcgttctctgcaatcaccaccgccagtggttcactccactggctgctttctttgagatagccttcggtatccgtttctatctctttaccttcgaagatcagcataattctttactaccttaatcagactggcggcagtgtaacaaaaaacaaagccccgcataaagcgaggctcggtaagtaaccctgggcgagattaatcgcggctggcgaagcccagaatgctcagcaggctgacgaagatgttgtacagcgaaacatacaggctaaccgtggcacgaatatagttcgtttcaccgccatgaatgatgttgctggtttcaaacaaaatagcgccagaggagatcagaatgaagaccgcgctgatcgccagatgcagggcaggcagctgcaggaagatattagcaaccataccaatcagcaccaccacaatacccgccatcagcataccgccaaggaacgacatatctttgcgggtggtcagcacatacgcagagcagcagaagaacaccaacgccgttccgcccagtgccatagcgattacgtcacccattccagcagacaggtaggtgttcagaattggtccgaggatatatcccagaaaaccggtaaaggcgaatgcggagataatcccggtcggcttattcgccgttttgtaggtcaggaacatcaaaccatacatacccaccagcgtcagaatcagacccggagatggcagcatcagcaccgtactggcagttgcggtaatcgccgaaaaggccagcgtcaggctcagcagaaaataggtattacgcagcaccttatgggtgctaagcagcgatgtacggtcatgtgaagaactaactatacgatccattgagtcactctctatgacagatgtaattaattaagcagcataatgataatgtgggaaggtacacagaagttttacccatctttacgcatttgatctggaacaggtttaacagcggattatcaggtcattaagcaaatataacgccctgagaatttcgacaggcaaaagaaaaaggggttagcatttagctaaccccttatcttatttggcggaagcgcagagattcgaactctggaaccctttcgggtcgccggttttcaagaccggtgccttcaaccgctcggccacacttccggaatgacgcgcactataaacatcccgatgcggcgtgtaaacccctaatttgtttgtttgcctgaaaaacagccaaaagtgcattgttagcgtgaaataacagcagactgatcatttcatcaccatgaattccttctcttttactcgtttagcaaccggctaaacatccccactgcccggcaaaaagaaaaataggtccatttttatcgctaaaagataaatccacacagtttgtattgttttgtgcaaaagtttcactacgctttattaacaatactttctggcgacgtgcgccagtgcagaaggatgagctttcgttttcagcatctcacgtgaagcgatggtttgccttgctacagggacgtcgcttgccgaccatgtgcgcccggtgtcctgccggtgtcgcaaggagaagagacgtgcgatatgaataacgaggaaacattttaccaggccatgcggcgtcagggcgttacccggcgcagctttctcaaatattgtagtctggctgccacgtcgctgggattaggcgcgggaatggcaccaaagattgcctgggcgctggagaataaaccgcgcattccggtggtgtggatccacggtcttgaatgcacctgctgtaccgaatcttttatccgctccgctcacccactggcgaaggacgtcatcctttccctgatttccctcgattacgacgatactttgatggctgccgccggaacccaggcggaagaagtctttgaagacatcatcgcgcaatacaatggcaaatatatcctcgccgttgaaggtaatccgccgctgggcgagcaggggatgttctgtatcagcagcggacgaccgtttattgagaaactcaagcgtgccgccgctggagccagtgcgattatcgcctggggaacctgcgcgtcctgggggctgcgtgcaggccgcgcgacctaatccgacgcaggcaacgnnnnncattccattcattaattaattaatgaatgaatgnnnnncacgcacatgtcacgacgagtcacgacagataaagatacagataaagatacagatcaagaagatcaaaacactatggtccatggcgtaaaaaacgccacgaaccaggcaggggatgttcagaccgtcaatcttggtcagccagcaggcacgacaccggaagccgattcagcgtatgcgctgaaagccgattcgggcgctgtgcagcaggtgatgaccgcaaggccggagcaatcacaccaactgcagcagcctgaagccgattccgccattcagcgggaagccgatcgggtagtcccggaaaacaccgggcagcctgtgggacgagtggattatccggatgtgttcgaacaggtctggcgggaatacccgttgcgtgctggggcaaacccgaagaaatccgctttcagtgcctggaaggccagattacgcgagggggtgccaccagaggccatgctggatggtgtgaggcgttacgcaagatacctggcggctaccgggaaaacgggaacggaatttgttcagcgagcgacgacgttttttggaccggaccggaattttgaaaacccctggttgctcccggtaagcggcacgaacaaccagcgttgtgtgaatcatatttctgaaccggataacgaaattccgccgggcttcagggggtaagtgttaatttctggtcatgaggtaattttcaggagggcttgtggcaaaagtttttacacaagaagagcgggaaaaaattaaagggcaggttcttgaactcgtacgccagagtgggcgcgagacgttacgacaactggaagctaaaactggggcaacaagatatctgatgagcgttctggccagagagctggttgccagtggcgatgtatacaactctggttacgggttattcccgtctgaacaggcgcgtaaggactggcaaaatgcccgtaaaaagctctcaagggcaaagctgaataaaccatctgcggttgatccggaccttatctggtcgttaccagacggcgaaatacgccgctacgacaggcgcctgaatataatctgtcgcgagtgccggaagagcgaagctatgcagcgtgtactggcattttatcaaggaaatgttaggtattttagacgttactagattaaagagcattagttcagatgtgaattgacattttcatggcgcagggtagagccagcgtggttgtccgctttgcgtcaaaaccagatattaccagatttagacatatattcccgatagccctgctctgatgctacactctgtgctattttcatgaccccaataaaaatatttatgactattgctgatttcaaacggcctaaattggagctcccaaacggggcaaacaaactactactgcactcttgctgtgctccatgttccggtgaagtgatggaggcgcttcaggcctcgggaatcgactacaccatctttttctacaacccgaacattcatcctcagaaagagtatttaattcgtaaggatgaaaatattcgctttgctgaacaacacggcgtgccgtttatcgatgctgattacgacaccgacaactggtttgaacgtgccaaaggaatggaatgggagcctgagagggggatccgttgtaccatgtgttttgacatgcgttttgagcggacagcgttgtacgctgctgaaaatggtttcagtgtgatcagcagttcactgggcatttcacgctggaaaaatatgcagcaggttaacgagtgtgggcggcgagctgttgcgcattatccgggtatggtgtactgggattataactggcgcaagcagggcggctcgtcccgtatgattgaaatcagcaagcgcgaaaaattctatcagcaggaatattgtggctgtgtgtattctctgcgcgataccaatctacaccgcaaatctcaggggcgccctcttatcaaaattggccaactccactacggaaaagaagagaaggagtgattttatggatcacctttctgattgatttcatattggcgaggtgacgtgagttaagtagaattgctgcgggtgcttgaggctatctgcctcaggcatgaacaccaaaaggcagatagagaaaagccccagttaacattacgcgtcctgcaagacgcttaacattaatctgaggctcaatccatgctgaacacatgtaggttagcctcttacgtgccgaaaggcaaggagaagcaggctatgaagcagcaaaaggcgatgttaatcgccctgatcgtcatctgtttaaccgtcatagtgacggcactggtaacgaggaaagacctctgcgaggtacgaatccgaaccggccagacggaggtcgctgtcttcacagcttacgaacctgaggagtaagagaccaggcgggggagaaatccctcgccacctctgatgtgtcaggcatcctcaacgcacccgcacttaacccgcttcggcgggttttgttttttcctggcattctggtttacaattcgcacgccagcctgaacaactggcacctgctgcgccagcagagacaaccgatggcgcacgataccaaattacacaattctaatgattctgccgtctttgccagcaggtgcggacggcgttttcacgcattcaaatcagactggttccagcatcctccatgcactgaagagcaggctgaatggataattcagtgttaccgcaggcgtggatacgaggttaagaaagccctcagcctcgattatcgtcactggataatctacgtcaggctgccgtactccgagcgcccaccgcgtccgtcccgcacattccagcaacgcatctggaggtaacgtgcgggtattacttcgacctgttccggtaccggaacttgggctggtggtccttaaaccaggccgtgaatccatgcaggtattccataaccctcgagtgctggtggagccggaaccgaaaagcatgcgtggtctgccgtccggcatcgtccctgccgttcgccagccgctggcggaggataaatcattactgcggtttttcagcaatgagcgtgtgattcgtgctgctggcggcgctggtgcactgtctgactggctgttgcgtcatgtcaaatcctgccagtggcctcatggtgactatcatcacagtgaaaccgtcatacatcgttacggcaccggcgcgatggtgttgtgctggcactgcgataaccagctgcgtgaccagacatccgaatcacttgagcaacttgctcaacaaaacctggcagcatggatgattgacgtcatacgccatgcaatgaatggcacgcaggagcgggagttatcgctggctgaattatcctggtgggcggtctgcaatcaagtggcggacgcgcttccggaggcagtattacgtcgttctctggggttacgtgcggaaaaaatccgcgcggtgtaccgcgaaagcgacatcgtaccgggagagcagaccgccaccagcatactaaagcagcgcacaaaaaatcttgcgccgttgcctcacttccaccagcaacagaacccaccactggaaaaggcggtggtcagcattgccgttgatccggactctccggaatctttcatgaggcgacctaaacgtcgccgttgggtaaatgagaaatatacgcgctgggtgaagacacagccgtgtgcgtgttgtggtcagccagccgacgatccccatcacctgattggtcacggtcagggagggatgggaacaaaggcccacgatattttcacgctaccgttgtgccgggaacatcacaacgaacttcatgcggatccgctggcgttcgaagaaaagcatggttcccaggttgatttaatttttcgttttcttgatcacgcctttgcaaccggcgtgcttgggtaaaagaggttattgatgcgtattgagtttgttttgccttatccgccgacggtgaatacttactggcgacgtcgtggcaacacatattttgtatcaaaagtcggtgagcgttatcgccgtgatgtggcgctaattgttcgccggcagcggttaaaatcaaacctgtccggaaggctggcgataaaggtgattgcagagccaccggataagcgccgtcgtgacctggacaatatcctgaaagcaccactggatgcgctgacgcatgccggactacttatagacgacgagcagtttgatgaaatcaatattgtgcgcggtcagctcgttcctggtggtcggttgggcgtgaagatttacgaaataatgcatgacgggcaggtccaaaaatgagactggaagatttaccgaaatactattccccaaaatcgccaggcctgactgatgcatccgtctcgacgtcaaaagatgcgctgagcatcactgatgtgatggctgcgcagggtatgacacaaaaccgggctgagatgggattttctgcgttcctggggaaaatgggtattagtatgaatgacagggcgcgggcaacagaattactggcagattatgcattaagtcagtgcgatcgcgtggcggcgttaagaaaacttccggcagaaataaaaccggcagtgatgcgcattatggcttcgtatgcttttgaggattatgcccgcagcgcagcgagtaaaaagcagtgcccctgttgccgaggggaaaaatttattgaaagcgaagtttttacaaacaaggttcagtatccggatggcaagccgccagtatgggcaaagtgtacgaaaggtgtgtatccgtcttactgggaagaatggaaaaaaatccgggaggtggtgaaagtttcttgtcctgaatgtaaagggaagggggagatttccactgcctgtaaagactgccgtgggcgtggtgttgccattcatcgtgaagagtcggaaaaacggggtatgcctgtaatcaggaactgccagcgttgtggcggtcggggctatgaaagactaccatcaacggaggcatttaatgccatacgcaaagtgacgagtgctatcacgcttgatacgtggaaaaaatcagtgaaacgcttttacgatacgttggtggttcggtttgacattgaagaggcatgggcggagcggcagttaaagagggtaacgcgatagtgttgttgatttttcccgaatctgtggtaaatttgctctaacgatgggcgttttatgcctgacgttagaaggatttttacagcccgccatcgagcgggttttttatatctggaaagcggtgcataacgttaaacgtgatggcgattgcgcaatgagtttctcctgctctgaagtctcttgactgcatggaatctcctttgttatgtaagatgagttgatgttttaaaattgttagagagatgggtatggatgacagcactctgctgaggaactcttcactttttattgcttatatgggctgtcttggatggggaagcgcttatttctatggatgggggacttccttttactatggctttccatggtggatcgtcggggttggcgttgatgatgtggcccgaagtttgttttatgctgtgagcgttatcgttatattccttactggatggggagtaggtattgttttctttttaggcataaaacaaaaaaacaatatacagaatttgagttttatcagactttttctggcaatattgctgctttttattccgcctgttctggagttttcggtaattcatcagcacgttgagccagatgtgctgtttttttgtgttattgctgcctttacaattacgctttttgtcaggtcaggaagaagacttatttcagtcaaatgtttttcggaagtgtcttttattcgccatcaccgaattgagtttattatggctggattcatgatttatttctggacattctctcttattgccggttggtataaaccccagtttaagagggaatatcagacgatccactatgagaatacttggtattacgttcttgcacgctatgatgatcgtctggttttatcgaaatcgtacagtaatgggagttctgcattcgttatacttaatagcgggcagattgatgactttgaaattaatgtagtcagagttcgttaatattgcctgagtaactttctgttgaccgctcagattcttttatcatgtgtaggccaatatgcaggatttaatcagggtagggtattgcagagctaaactggcataagtattattccgcatatggccctttagctcagtggtgagagcgagcgactcataatcgccaggtcgctggttcaaatccagcaagggccaccaaccgccactagctcatcaggaaagagcgtcaaccctttaagttgagagtgcgaggttcgagtccccggtggcggtccagtgccgacttagctcagtaggtagagcaactgacttgtaatcagtaggtcaccagttcgattccggtagtcggcaccatatgcgggcatcgtataatggctattacctcagccttccaagctgatgatgcgggttcgattcccgctgcccgctccagtcagagtctttcagtctgcgatgatgggaaatcccggagtgactgaaagacgtttaagttatgaatgatcgcctttttttgcaaaattgctgtgcagaaatactaaccttcgggcaggcgatcattcataagcactctgcttttattccgatcaactgtgggtggtttgttggatagagtgctttcctttctgtatatatcgtttcgcccgcttttgcgggtttttcttttcaaatccctttcatttctcagtgtaaaactacgccatccgttatttgcggaggtgaggctatgaaatccatggacaaaatttcaacgggcattgcctacggcacctccgcaggcagtgctggctactggtttttacagtggcttgatcaggtcagtccgtcacagtgggctgcgattggtgttctggggagtctggttctgggcttcctgacttatctgacaaatctgtacttcaaaatcagagaagacaagcgtaaggctgcacggggagagtaattcaatgactcaaaactatgaactgattgtgaaagggatccgcaattttgagaataaagttacggtaactttagcgttacgggacaaaaaacgctttgacggtgaaatttttgacctggacatctcgctggaccgtgttgaaggtgccgcgctggagttttatgaggcagcagccagaaggagcatcagacaggtcttcctagatgttgctgccgggttatgtgaaggggacgagctgttgccagaaacgcgcccctgttcagaggcgcggtataccataaaaattaacagttctgataactcgattacaggttgttagctttttgcagttggctttccagtatctttcattggtagcatcctgataaatatccatgagcgcaaaaatcaaatacggcctgtcagctgcggttctggcgctgattgctgcaggtgcgtctgctcctcaaatacttgaccagtttctggatgaaaaagaaggtaaccacacaacggcataccgcgatggggccggcatctggaccatctgtcggggtgccacgatggtggatggaaaacccgtttttcccggtatgaaactgtcgaaggaaaaatgcgaccaggtcaacgccattgagcgtgataaggcgctggcatgggtggagcgcaatattaaagtaccaatgaccgaaccacaaaaagcgggtatcgcgtcattctgtccctataacattggccccggtaagtgttttccgtcgacgttttataagcggctgaatgccggtgatcgtaagggcgcatgcgaggcgattcgctggtggataaaagatggtgggcgcgattgccgcatacgttcaaataactgctatggacaggttattcgtcgtgaccaggaaagcgcattagcctgttgggggatagatcagtgagcagagtcgccgcgattatttatgctctggttatttgcatcatcgtctgcctgtcgtgggcggtcaatcattaccgtgataacgccatcgcctacaaagaacagcgtgataaaaaagtcagtgagctgaagcaggcgatcgccaccatcgctgacatgcagcagcgtcagcgtgatgttgctgcgctcgatgcaaagtactcgagagaattagccaatgcgaaagctgaaaatgaaactctgcgcgctgatgttgccgctggtcgtcgtcggttgcacatcaaagcagtctgtcagtcagtgcgtgaagccaccaccgcctccggcgtggataatgcaaccagcccccgactggcagacaccgctgaacgggattatttcaccctcagagagcggctgatgacgatgcagatgcaactggaaggggcacaggagtatatccgcactcagtgcattaagtagcctttttatcgtggtaaacatttcgcagggtatgaggtatttatgccatcacgaatcccacgcgcctgccgtaagcgtggatgtgtaggtacaaccacagacagttctggttactgcgataaacatcgtggcgaaggatgggtacagcatcaacgcggactgagccgccaccagcgtggctatggctcgaaatgggatgccatacgtgcgcgcatactgaagcgtgataatcatctgtgtcagaactgcctgcgcaatgggagagccgttgaagccagaactgtggaccacatcattccgaaagctcatggtggcacggatgcagacagtaacctgcagagtctgtgctggccctgtcataaagcaaaaacagcgcgcgaacgcatcaattgataacagttcccatctgtaggggaggggcgggtcaaatctctgcaaccctggctgctcagtaccgccgcctgacctttcctcgcatcgccgcaggttcgaaaacttttttttggaatgtgattaaatgattgataggtaaaaccgattatgtctggacccccgaaaaccccgccacgcctgcatttgatacgaggtaacccctcaaagcggccagttaaagactccaaaaaaaccgctaaaaaggatgaaaaaggtctccctaaaattccgcaacatttaggggcgcaggggaagtactggttcaggcgaatggcggaagagctgaatgcggaagggatcatttctcagctcgatgcacgtgcgctcgagttactggtggaagcctacaccgaataccggcatcactgcgaaatactcgatgttgagggttatacctaccgcacgaaaacgcagaatggcgatgtgctgatcaaggcacacccggctgctgcgatgaaggctgatgcctggaagcggatccgggcgatgcttgcagaatttggtatgtcaccggcaagccgggcaaaagtaaataccgccggaccggataatgttgatccgctggcagagcttttaaaagcgagagactgatggcaaaagtggctgacgggatccgctacgccgaacgtgttgttgcaggagaaattgttgctggcgaatttgtccgcctggcctgccagcgttttcttgatgatctgaagtacggcgaaaagcgggggatttatttcagtgaaccccgtgcgcagcacatcctgaatttctacaaatttgtgcctcatgtaaaaggggcactggcaggccagcccattgagttgatggactggcatgtatttatcctcattaatatttttggttttgtcattccgctggtcaatgaagaaaccggggaagttgtcatgcgcagcgatggcagcggacgtccggtgatggtgcgccggttccggacggcgtacaacgaagtcgcccgtaaaaacgcaaaatcaaccctgtcatcgggtatcggcctgtatatgacgggggcagatagtgaaggcggagctgaggtgtattcagccgcaaccacgcgtgaccaggccagaatcgtgtttgaagacgccaaaaatatggtcagaaaagcccggtcgacactcgggcggttgtttgatttcaacaagctggcgatttaccaggagcagagcgcatcaaaatttgaaccgctttcctcggatgcaaacaacctggacggtctgaacatccactgcgccattattgatgagctgcatgcacataaaacccgcgacgtgtgggacgttctggaaacggcaaccggtgcccgtctgcagtccctgttatttggtatcaccacggctggctttaacaaggaagggatttgttacgagcagcgtgattacgccatcaaggtattgcgaggctataacagcgacgtggagggcgctgtaaaagacgactcttactttgcgatcatttacacgctcgatgagggagatgatccgtttgatgaaacggtctggcagaaagcgaatcctggcctgggcatctgtaaacgctgggatgatctgcgtcgtctggcgaaaaaagcgaaggagcaggtctctgcgcgggtgaatttttttaccaaacacatgaatgtgtgggtcactgccgaatctgcctggatggatatgattaagtgggagaagtgcgaatacattgctccacaacatgagctgaaaacatatcccatgtgggtcggcgtcgaccttgctcataagattgatatctgtgcggcggcaaaactctggcgaaccgataacggacatgttcatgctgattttaaattctggcttccggaaggacggctggaacgatgctcgcggcagcaggcagaactttaccggaagtgggcggagatggataagctcatcctgacggatggtgatgttatcgatcatgctcagataaaaagtgacttactggaatggattggcggtgaaaacctcagggaactgggatttgacccgtggagcgcaatgcagttcagtctggcactggctgaagaagggataccgctggtggaggttccgcagacggtccgcaatctgtcagaggccatgaaggaaacggaatcactggtttatgccgggcgtttccatcacagcaatcatccggtcatgaactggatgatgtctaacgttactgtaaaaccggacaaaaacgacaacatcttcccgaataaatccacgccggaagccaaaatcgacggccctgttgcgctttttacagccatgagccgctttctggtaaatggcgggggcgtgaatgactttctgtccacgcttgatcctgatgaggacctgttaattctgtgaaacagcttattactgatatgaccgggctgatcggtttcggtctgctcactgctggcgtttatctgtatgcaggtctgccagcgtctctgatgctgtctggctgtttgttgctgctttatgcactggtggtgtccatgaggagaaaacatgcttcttgatgctctgtttcgcagtgagcctctggaaaatccctcggttccggtaaccggagaggccgctgagacggataatatttttgcccgggatgtgtatgtcagtccggaaacgtccatgaggctggctgctgtctatgcctgtatttatgttatttcatccagtgtggctcagatgcccctgcatgtgatgcgaaaaacgaatgagcatgttcagccggcacgcgatcacccgttgttctggctcgttcatgatgaaccgaatgcctggcagaccagctataagtggcgggaactgaagcagcgtcatgtgctggggtggggcaatggttatacgtgggtgaaacgtaatcgtcgtggcgaggttaccagtcttgaatgctgtatgccatgggaaaccacgttacttaacactggagggcgtcatacctacggtgtgtataacgaagagggtgcatttgcggtaagtccggacgacatgatccatatcagggcgctgggaaacaatcagaaaatgggactgagtccgatcatgcagcatgctgaaaccattggtatgggaatgagtggtcagcagtataccagtgctttttttaacggtaatgcccgtcctgccgggattatttctgtgaaaaatgaactgaacgaacagagttggagcaggctcaagaatatgtggcagcgggcggtgacagcgcttcgcagtcaggaaaataaaaccatgctgctgcctgcgcaactggattaccgtgccctgacagtttctccggtggatgctcagatcattgatatgaccaagctgaaccggtcgatgattgccggaatttttaatgtcccggcgcacatgattaatgacctggaaaaagccacattttcgaatattacacagcaggcgattcagtttgttcgctacacgatgatgccctgggttgcgaactgggagcaggagcttaaccgtcgcctgtttacccgcacagaacgggctgccgggtattacgttcgtttcaaccttacaggattgctccgcgggactccacaggagcgtgcgcagttttatcactttgccattacagatggctggatgagccggaatgaagcgagggcatttgaggacatgaacccggttgatggtctggatgaaatgctggtcagcgtaaatgcagcaaatccgttgaatgattttaaagatacgaaaggcaaagaggaaaagaacgatgaatgaccgtgaaacgcgctgttacagcggggaagtgcgggcagaacaatatgataatgccccgactcatattttggggtatggctcggtatttaacagtcgttcagaacctctgtggggatttcgtgaaatcatcaagccgggggcttttgacgacgtgctgaatgatgatgtacgtggattgtttaatcatgatcctaatttcattctcggacgaagttctgccggcacgttgtcattatcagtggatgaacgtggtttgcgttacgacattgttgcaccggatacgccgacgatttgtgacctggtgctgtcaccaatgttgcgtggtgacattaatcagtcctcgttcgcgtttcgcgtcgctcgtgatggagagagctggtatgaagacgacgaggggattgttatccgggaaatcacgcgcatttctcgtctgtatgacgtcagcccggtgacatatccggcctatcaggacgcagactctggtgtccgctcaatgaaagcctggcaggaagcgcgggcgagtggtgcgctgaagaaagctgttaacgaacgaatggcgcgtgagcgtcttttgacccttcttaatgcataaggatactactgacgatgaaacttcatgagatgaagcaaaaacgaaacaccattgcaaaggatatgcgtgcactgcatgaaaaaattggtgataacgcatggactgatgagcaacgggcagagtggaacagggcgaaagctgagctggatgcgctggatgagcaaatcgcccgtgaagaagagttgcgccgtcaggatcaggcatatgtggatgagtccgggccggaagagcgccagaataatgaggcggagaacgggaaaaaggcggtggaagagaagcgcgctgcggcatttaaccgttttctgcgtgccggatttgcagaactgaatgctgaagagcgtaatctgatgcgtgaactgcgggctcagagtgtaacaacggattctcagggcggatatacggtgcccacgcagatgcgtaacaaaatcattgacaccatgaaggcttatggcgggattgccagtgttgcgcaacttctgaccacatcaaccgggcaggatatcacctggtcaacgtctgatggcacgactgaagagggcgaactgctggcggaaaatacagccgcaacggaacaggatgtgacgttcgggaccgctattctgggggctaaaaagctgtcatcaaaaataattcgtgtgtccaatgagctgctccaggacagtggggtggatattgaatcttatctggcaaaccgtattgcccagcgtattggtcgtggagaggcgaaatatctggttcaggggaccggaacgggatcaccgttacagccaaaagggctggcagcgtcggtgacgggaatcatccagactgcagcctctgccgctttcacctggaaagaaatgaatgccctgaaacatgccattgatccggcatatcgtggtgggccgaaataccgctgggcattcaatgatgccacattgcagactattgaagagatggaggatggacagaaacgcccgttatggctgccggatattgcaggcggtacgccggctactgtgctggggatcccttatgttattgatcaggctattgacgggattggtaccggaaaaaaattcattttcctgggggatttcaaccgctttatcattcgccgcgttacttatatggaactgaaacgtctggttgagcgttatgctgagtttgatcaggtggcatttctggctttccatcgttttgactgtgtgctggaagatgtggcagccatcaaggcgctcactggcaaataaccactcgttgttcagttacagaccgcgccgacgcggtttttttatgcccgcacagtgttgcgggcaggagtttctgatggcagcaatagtggaaaaactcagggcgcagtgccgtattgatacagatgatgcaactgatgatgagttactgatgctgtatttccgggctgcctgccgcaaggcagaaaattttatcaaccgtaagctttatgaggagacggtgccggaaggtgatcctgaaggggtgcttatagctgatgatgttttgctggcgctcatgttgctggtcgggcactggtacgaaaaccgggaaaattcctcagatgtcagcaaggcaccagtcccgtttggtttttcttctctgctggagccttatcgttttattcctttgtaggaggagacatgcaggcgggcagattacgtgatcgcgtaattattctgaatgtcaccaccgcccgctctccgtcagggcatccggtggagacggtgacggagggagctaccgtatgggcagaagttaagggtatcagcgggagggagataatctcaggcggagcagaaaccgctcaggctacggtcagagtctggatgagattccggcgcgatgtgacagcgacttcacgtctgaaagtgctgaccggtgcatttaaaggggccattctgggtatagaaggtccaccaataccggatgcacgcgctacccggcttgaaatactctgcagcctgaaggggaatgtgtgatggatttcagtcttgatttttccggcctggcggatattgcacgggatttggagacgctcagcagggcagaaaacaataaggttctgcgcgatgccacccgtgccggtgctgaagttatgcgggatgcagttgttgaacgtgcgccggagcgaaccgggaaactgaagaaaaatgtggttgttctcactcagcgttcaaagcgtcggggggaaattatctcgggtgtccacattcgcggacggaacctgcgaaccggaaacagtgataacagcatgaaagccagcgatccccgaaatgcattttactggcgctttgtggagctgggaacgataaacatgcccgcgcatccattcattcgcccggctttcgatacgacagaggaactggcagcacggattgctatacagcgaatgaatcaggctattgatgaggtcttaagtaaatgagagaggccacactgtattccctgttgtctcagctggccggaggacaggtttatccttatgtggtcccactgacggagggaaagcctgcggtatctccgccgtggctggtgttttctgtggtgtctgacacggcatctgatgtgcttgatgggcaggctgaatccagaattaccgtgcagatcgatgtctgggcgacagtacctgatgacgcagataatattcgtgagcaggcgcttgatgcggtaagaaaactggcaccctccgttatttctaaaacgcagggttatgatcctgactcccgtctgagcagagccacgcttgaattccaagtaatagcctgaggtcattaatgattttacccacccgccgctggcgggtttttttattttcaggagacgagtatgtcctctaattttgagcgttcgcaactgacgaaaattatgatttcgtctgcaccggtaacagcagaaaccctggattctgccagctatcttggcctgagctgtacaatcaaagaggtgcagtttaccgcaggacaaaagcaggatattgatgtcaccacgctgtgttctgttgagcaggaaaatattaacggccttggggctgcttcagagatttccatgtcaggcaacttttatctgaatgctgcccagaacgcgttgcgcagtgcctatgacaatgacaccacgtatggctttaaagttatttttccgtcaggcaacggatttacctttatggcagaggtgcgtcagcatacctggtctgcaggaaccaatggtgttgtggctgcaacgttttccttgcgcctgaaaggtaaacctgtgctgacgacagagccgctgaaagtgaaggccgatttaaaaagcacgctgcgggttgcttccggagcgaaacttgaaatggcggttgaggctgcgggtggtgtgccgccttattcttatgtctggaagaaaggtggttctcctgtttccggacagacggcggcaacgttcagtaaggcattggtagtatccggtgatgcgggtgcatatacctgcgagatttctgattcagcaagcccggttaacaaagtgacctccacttcctgcactgtaaccgtcagttaatgaggatggatgtgatgactaaaaatatccgtaatctggcactggcaacgatgtcggggtttcgccataaaaccgttgatgtgcctgaatgggagggagcaacggttgtgttacgggaaccttctgcagaagcctggttgcgctggcaggagatcgttaaagcaaaagatgatgagacaccgttatccgttgcggagcgcgcccgccgaaatctggaggcagatgttgaactgttcattgatgttctgtgtgataccggactgcaacccgtattttcagaggatgatcgtgaacaggtgattgccgtgtatggcccggtgcatgcgcggcttcttcggcagtctctggaactgatcagtgatgccggcgaggttaaaaaaaagtagcgcttccggggatgcgttttctgatgatgctggcgctcaggatggggcgcacattgtcagagttacgccgggaaatgtccgcatcagaaatcatgatgtgggcagaatttgacaggttcagcccgctgggggacgaacgggctgatatccgggctgcccagattgtttcagctgtttacggtgcgcagggggtcaaagtgccactgaatgatgcgcttcttcagtgggagaaggagcagacagaaggcgtatcagatccatttgccggactggaaaacgcgcttttaatagtgtctcagtgagtcaacataaccgcttcggcggttttttttcgtccggagaatgagtgtggcgacattacgtgaactgattattaaaatctcggcaaattcccggtcattccagtcagagatctcccgggcttcgcgtatggggcaggattactaccgtaccatgcagaacggaggccggcagtccgctgctgcatcccgtgaaatgcggcgtgcactggcagaagtgacggatcagataaatacagctaaatcttcggcactgaatatggcgggggcatttgccggggcttttgctaccggtcatcttatttctttcgccgatgagtggaattcagtaaatgcccgtctgaagcaggcctcacagtccagtgatgattttcaggcatcacagcgtgaattaatggcgatcagccagagaacggggacggcgttttctgataacgccagcctttttgcccgttctgcagcttccatgcgggagtatggttacagttctgaggaggtactgaaagtcaccgaggcgatctccacgggcctgaaattatccggtgccagtacagcagaagccagttcggtgatcacgcagttcagtcaggcactggcgcagggagtgctgcgcggtgaagagtttaactcggtgaatgagaacggcgatcgtgttattcgtgcgctggctgcgggaatgggggttgcccgtaaggatctgaaggccatggcggataacggaaagttgaccgccgataaggttgttcctgcactgattagtcagcttggggcattacgtgatgaatatgcggcaatgcctgatacggtttcatcctctgcaaccaaagttgaaaacgcctttatggcctgggttggtggtgcgaacgaggcaagcggagtgacgaagacgctctccggtgtgctgaatggtattgcaggcaatattgacactgtggcaaccgctgccggtgctctggttgccgtcggggtagcccgatattttggcaatatggcgtcttctgctggatctgcaactgccggattaattactgcagccagaaacgaagtggctcttgcggaagcgcagctccgggggacacagatagcaacagccagggcgcgtgcggcggtttatcgtgcgcaacaggcggttgttgctgctcgcggtaccgaaaggcaggcagccgcagaagcgaaactggctgctgcccaggcatcacttacccgtaatattgcggccagaacagcagcacagacaacgctgaatactgtcacgtcagtgggaagtcgtctgttaagtggagcactgggactggttggtggggtgccggggcttgtcatgctgggggccgcggcctggtacacgatgtatcagaatcaggagcaggccagagaatctgcacgccagtatgccgcaacaatcgacgaaattcgccagaaaacgtcggcaatgtcgcttcctgaagcgtcagataatgaggaaaagacgcggcaggcacttgatgagcaaaacaggttaattgacgagcagaaaagtaagattaaatccttacaggaaaaaattgctggctatcagtatgtgctggcaaacccgggctggacaaccgataacggttttatgattaaccacatgacgtcggtaaaaacagtcacagaagggcttgcagaagcaacaaatcaactggcagttgaacagtcccgtctcacacaaatgcagggcaaagcgcaatccattcaggatgtgcttgccgggctggaggagcggcgggttgcgttgatccgtcaacaggcggcggaacaaaacaaagcgtatcagtccctgttgatcatgaatgggcagcataccgagtttaatcgccttcttgggcttggtaatgaattacttcagcagcgacaggggctggtgaatgtaccgttacggctaccacaggcaaccctggatgataaacagcagaccgcactgaataacagcaagcgcgaactggctctgtcccgccttaagggggaagcgcgtgagcgtgcccgactgggctatgctgcggatgatctcggctttgtgggagaggcgtatcagacagccagacagaattatatcaataactcactggatgcctggcgaaataaccaggcaaataaacccaaagcgcataaaaagaccgaagcggaaaaaacagaagatatttataaacggctgattaaacagcaaaaagaacagatagcactggcagggcagaatactgaactggctaagatgaaatatcaggtcagtcagggcgaattatcaaccctgtcagaagcgcagaaaaaaacgcttttgcagaatgcagcactcatcgaccagaaaaagattcgtgagcagcttgctgcgtatgaaagcagcctggcggacagtaatgccagtacccgggcgtctaacgacgcgcagttactgggatatggtgaaggctcacggatgcgtgaacgactccaggaaatgtggagtatccggcatgagtttgagcagaaaaataacgagctgctgagacagtatcaggccggagaaattgaagaagccctgtggaaacaggagaaagaactgaataaaaaatatctggaagagcgtctcagcgatcagcaggattattatgcaaaggccgatgctttacgtaataactggaatgcaggactccaggaggggctgaccaactgggcagacagtgccaccgattatgcttcgcaggcggcagatgctgtcgtttccactatggacgggctggtatcaaatatttccgatgcgctggccggaaatgttgtggactggagaaactgggggagttcaattctccaggaagtttcaaaaattctgatgaatgcggccattgttaacggactgaagtcactctccggtgccggagggtggcttggtacggtcggcggatggatttcgggggcggtggcaaacgcaaaaggtggtgtttacacatcggcaaatctgagtgcttacagtaacactattgtggatacaccgacgtattttgcttttgcgaaaggtgccgggctgatgggcgaggccgggcctgaagctatcatgccactgacacgggcagcggacggctctcttggggtcagagccattggcaatgtgaatagtggcgggggggttgtttattctcccgtgtatcacatcagcattcagaatcaagggagcaatggcgagatagatgcgcgctcagccaggggactggtggatctgatcgacagcagggttgtgtcaattatgcagtcatcgcgtcgggatggaggattgtacagtgcctgagcctgaagtttttaactggatcccccgtgaggggatggagacgacacgaaagccatcagttattacggtaaagtttggtgacggatatgaacagagacgggctggtggtctgaatgcggatctgaaaacgtttaaaccggtatttcgtgtcacagatgaatattcccgtgccgcgctggacagttttttatcccgtcatgccgggattcgtgcttttttgtggcgtccgccaaaacacaacaggactgtccgggttgtctgcagggagtggagcatttcggataatgccatgtataccgattttaactgtacctttgaagaggtcactcactgatgcaggatatacagcaggaaacactcaatgagtgcactaaaacggagcaatccgcgctgatcgtgctctgggaaattgatctgacagaggtcggcggagatcgttatttcttctgtaatgagcagaacgaaaaaggtgaaccagtcacctggcagcggcggcagtatcaggcctatcccattcagggaagtggatttgagatgaacggcaaaggagccagtgcaaggccaacgcttaaagtctctaatctgtacggcatggtcaccgggatggcggaagacctgcagagtctggtcggcggaacggtggtcaggcgtaaggtttacgcccgttttctggatgcggtgaacttcgtcaacggaaacagtgacgccgacccggagcaggaggtgatcagccgctggcgcatcgagcagtgcagcgaactgagtgcggtcagtgcttcttttgtactgtccacgccgacggaaacggatggtgcggtttttccggggcgcatcatgctggccaacacctgtacctggacctatcgcggtgatgagtgcggttatagcggtccggctgtcgcggatgaatatgaccagccgacgtccgatatcacgaaagataaatgcagcaaatgcctgagtggctgtaagtttcgcaataacgtcggcaactttggcggctacctttccatcaacaaactttcgcagtaaatcccatgacagagacagaatcagcgattctggcgcacgcccggcgatgtgcgccagcggagtcgtgcggcttcgtggtgagaacgccggagggggaaagatatttcccctgcgtgaatatctccggtgagccggaagattatttccggatgtcgccggaggactggctgcaggccaaaatgcagggtgagattgtggcgctggtccacagtcaccccggtggtctgccctggctgagtgaggctgacaggcggctgcaggtgcagagtgatttgccgtggtggctggtctgccggggggcgattcataagttccgctgtgtgccgcatcttaccgggcggcgctttgagcacggggtgacggactgttacacgctgttccgggatgcttatcatctggcggggattgagatgccggattttcatcgtgaggatgactggtggcgtcacggtcagaatctctatctggataatctggaggccacagggctgtatcaggtgccgttgtcatcagcacaaccgggcgatgtgctgctgtgctgctttggttcatcggtgccgaatcatgccgccatttactgcggcgacggcgagctgctgcaccatattcctgaacaactgagcaaacgagagaggtataccgacaaatggcagcgacgcacacactccctctggcgtcaccgggcatggcacgcatctgcctttacggggatttgcaacgatttggccaccgcatcgaccttcgtgtgaaaacgggagccgaagctatccgggcgctggccacgcagctcccggcgtttcgtcagaaactgaatgagggctggtatcaggtgcgcattgccgggcgtgatgcaggcgaaaacgaattatctgcccgtcttaatgagccgctggcaaatggtgccgtgatccacatcgtaccgcgtctggcgggtgccaaaagtggcggtgtttttcaggcagtgctgggggctgcgctgattgcggtggcatggtggaaccctgtgggctggctgggtgccgcggctgtatcgggtatgtatgcggcaggggccagtatgatcctgggcggtgtggcgcagatgctggcaccgaaagccagaactccccgcacacagacaacggataacggcaaacagaacacgtatttctcctcactggataacatggttgcccaggggaatgttctgcccgttctgtacggtgaaatgcgcgtggggtcacgcgtggtatctcaggagatcagcacggcagacgaaggggatggtggtcaggttgtgatgattggtcgatgatgcaaaatattttatgtgaaaccgcctccgggcggttttgtcgtttatggagcatgacgaatgggtaaaggcagcagtaaggggcataccccgcgcgaagcgaaggacaatctgaagtccacgcagttgctgagtgtgatcgatgccatcagtgaagggccggttgaaggtccggtggatggcttaaaaagcgtgctgctgaacagtacaccggtgctggacagtgaggggaataccaacatctccggcgtaacggtggtgttccgggcaggtgagcaggagcagactccgccggagggatttgaatcctccggctccgagacggtgctgggtacggaagtgaaatatgacacgccgatcacccggaccatcacgtcggcaaacattgaccgtctgcgctttaccttcggtgtgcaggcactggtggaaaccacctcaaagggggaccggaatccgtcggaagtccgyctgctggttcagatacagcgtaayggtggctgggtgacggaaaaagacatcaccattaagggcaaaaccacctcgcagtatctggcctcgggtggtggtggggtaacctgccgccgcgcccgttcaatatmcggatgcgcaggatgacgccgggacagcaccacagaccagctgcagaacaaaacgctctggtcgtcatacaccgaaatcatcgatgtgaaacagtgctacccgaacacggcactggtcggcgtgcagtggactcggagcagtcggcagccagcaggtgagccgtaattatcatcttcgcgggcgcattctgcaggtgccgtcgaactataacccgcagacgcggcaatacagcggtatctgggacggaacgtttaagccagcatacagcaacaacatggcctggtgtctgtgggatatgctgacccatccgcgctacggcatggggaaacgtcttggtgcggcggatgtggataaatgggcgctgtatgtcatcggccagaattgcgaccagtcggtgccggatggctttggtggcacggagccgcgcatcacctgtaatgcctggctgaccacacagcgcaaggcgtgggatgtgctcagtgatttctgctcggcgatgcgctgtatgccggtatggaacgggcagacgctgacgttcgtgcaggaccgaccgtcggataaggtgtggacctataaccgcagtaatgtggtgatgccggatgatggcgcgccgttccgctacagcttcagcgcccctgaaggaccgccataatgccgttgaggtgaactggattgacccggataacggctgggagacggcgacagagcttgttgaagatacgcaggccattgcccgttacggtcgtaacgtcacgaagatggatgcctttggctgtaccagccgggggcaggcgcaccgcgccgggctgtggctgattaaaacggaactgctggaaacgcagaccgtggacttcagcgtgggtgccgaagggcttcgccatgtaccgggcgatgtcattgaaatctgcgatgatgactatgccggtatcagcaccggcgggcgcgtgctggcggtaaacagccagacccggacgctgacgctcgaccgtgaaatcacgctgccatcctccggcaccacgctgataagcctggttgacgggcagggtaatccggtgagcgtggaggtccagtccgtcaccgacggtgtgaaggtgaaagtgagccgtgttcctgacggcgttgccggatacagcgtgtgggggctgaagctgccgacgctgcgccagcgcctgttccgctgtgtgagtatccgtgagaatgacgacggtacgtatgccatcaccgccgtacagcatgtaccggcaaaagaggccatcgtggataacggggcgcactttgacggcgaccagagcggcacggtgaatggtgtcacgccgccagcggtgcagcacctgaccgccgaagttaccgcagacagcggggaatatcaggtgctggcgcgctgggacacgccgaaggtggtgaagggcgtgagctttatgcttcgcctgaccgtggcagcggatgacggcagtgagcggctggtcagcacggcccggacgacggaaaccacataccgcttcacgcaactggcgctggggcggtacacgctgacagtccgggcagtaaatgcgtgggggcagcagggcgatccggcatcggtatcgttccggattgccgcaccggcagcgccgtctcggattgagctgacgccggggtattttcagataacggcggtcccgcgtcttgcggtgtatgacccgacggtacagtttgaattctggttctcagaaaaacgcatcacgaacacagcacaggtggaaaaatctgcccgttatctggggaccggcagtcagtggactgtccaggggagccggattaagccggggacggatttctggttttacgtgcgcagcgtcaacctggtggggaaatctgcttttgtggaagccagcgggcagcccagcaatgatggtgaagggtatctggaaattttccgggggctgatagatgagacgcttctgggtcaggcactgaaagagcgcattgatgcttcagcgctgcgtacggaggtcacgcaactggaagaagatatccgtcagcggatggacacggatatcgcagaagtgacccggaaaatcgggaaggcggaaaacagcctcacgcagctggttgcgaaaaagaatgaggaccagacactggccatcgcgcaggtgagccagaaagtggaccgggtgagcagtgaaatctcacagactgtcagccaggggcagtcagaaaacgcccgacagatagcacaggtccgccagtacgtggataaaaaagggagtgaaattacctcgaccacggataaaaagctgggtgaccaggccgtgaccatacagcaaatccagcgggttcagtcagacacgcgcaatgagctgaatgccatgtatatgctgaaggtgcagaaaacaaaaaacggtattccctatgtggccgggattggcgcggggattgaggatgttgatgatcagaccctgagtaacattctgctgcaggccgatcgcattgcgatgattaccccggagaacggcaacaccacgccgctgtttgtggcgcaggggaatcagctgttcatgaacgacgtgttcctgaagcgactgtttgcggtgagcatcacgtcatccggcaatcctccgacgttttccctgacgccggatggcaggctgacagcccgcaatgcggatatcagtggagccatcacggcgaataccggcacgctcaataatgtcaccattaacgagaactgtgtcatcagagggaaactgtctgcaaaccagattgaaggcgatctcgttaaaacagtgggtaaggctttcccccgtgactcccgtgcaccgaagcgttggccatcaggaaccattaccgtcagggtttatgacgatcagccgtttaaccggcagattgttattccggcggtggctttcagcggtgccagacatgagcgggagaacagcgatacttattcgtcatgccgcctgatagtgaagaaaaacggtgctgaaatttataaccgtaccgcgctggataatacgctggtttacagtggtgttattgatatgcctgctggtcgcggtcacatgacgctggagttttctgtatcagcatggtgggtaaatggctggtatcccacagcaagtatcagcgatttgctggttgttgtgatgaagaaagccactgcaggcatcacgattagctgaattttataaccccaatacgggcgccagaaatggtgccttttttattgcagaaaagcgagaggtaattatgcgtaaagtttgtgcagccattttgtccgcagccatctgtctgtccgtatccggtgcgcctgcatgggcgtctgaacatcagtccacactgagcacagggtatcttcatgcccgtacgaacgctcccggcagcgataatctgaacgggattaacgtgaaataccgttatgagtttacggacacgctggggctgattacgtccttcagttatgccaatgctgaagatgagaaaaaaacgcactacagcgatacccgctggcatgaggattctgtgcgtaaccgctggttcagcgtgatggcggggccatctgtgcgcgtgaatgaatggttcagcgcgtatgtgatcgctggtgtgacttacagccgtgtgtcgactttttccggggattatctccgtgtaactgacagcaaggggaaaacgcacgatgtgctgaccggaagtgatgacgatcgccacagcaacacgtctctggcgtggggagctggcgtgcagtttaacccgaccgaatccgtggccattgaccttgcttatgaaggttccggcagtggtgactggcgcactgacggtttcatcgtgggtgtcggttataaattctgattagccaggtaacacagtgttatgacagcccgccggttcaggcgggcttttttgtggagtggatatggcagcagtaaaaatctcaggtgtgctgaaagatggtgcgggaaaaccaatacagaactgcactattcagttgaaggcaaagcgtaacagcaccacggtactggtgaacacggtggcctctgaaaatccggatgaagccgggcgttacagcatggatgttgagtatggccagtacagcgtcatcctgctggttgaaggttttccgccttcacatgccgggaccattaccgtctatgaaggttccagaccaggtacgctgaatgattttctcggtgccatgacggaggatgatgttcgtccggaggcactgcgccgttttgagctgatggtgaatgaagtggcacgtcatgccggagcgtcatcacagagtgcagcggcggcaaagaaatccgaaacggcagcagcctcatcgaagaatgcggcgaaaacctcagaaacgaatgcagctaacagcgcacaggcggcagcggcctcgcagactgcatcggcaaactccgcgacagcagccaaaaaatcagaaaccaacgcgaaaaatagcgagacagccacaaaggccagcgaaaaaaacgcaaaatccagccagacggcagcgaaaaccagtgagacgaatgccaaagacagtgaagccaacgcaaaggtgagcgaaacagcggcggcgaactcggcgaaagcatcggcagcaagccagacggcagcaaaagcaagtgaagatgctgccagagaatacgcaaaccagacagcagagccgtacagatatgttttacagccgctgccggatgtgtggataccctttaatgattcgctggatatgattacgggctattctccgggttataaaaaagtgaagattggtgataatgtggttcaggttgccagtgataaacaggttaatttcagtcgcgcatcaacggcaacatatatcaacaaatctggcgaactgaaaacggcggaaattaatgagccacgatttgaaaaagaaggtttattgattgaaggtcagcgaaccaactacatgttgaattcagcaactccagcttcttggggtaaatctgcaaatatgaatgtcgctgaggttggaactgatagttttggttttacttatggaaagtttgtttgtaacgattctctgattgggcaaacgtcagccattaatatggcatcaattgctgctacaaagtcagttgatgtttcaggcgataacaagtacgtgacaacctcatgtcgttttaaaacagaacgacaggtaaggttgcgtatccgctttgataaatatgacggtagtgcaacaacttttcttggtgatgcatatattgatacacaaacgcttgaaattaatatgacaggtggcgcggcctcaaggattacagcgagagtcagaaaggacgaagctaccggatggatttttgcagaggcaacaatcctggcaattgatgatgagttaaaaataggatctcagatacagtattctcctaatcagggcggagcaaccgtatctggagactatatttatctggccacccctcaggttgaggatggttcgtgtgcatcatcttttattatctcaggaacgacggcggctacccgcgcaagcgatatagttacagttccaattaataataatctttataatcttccttttacggttctttgtgaggtacataagaactggtataaaacgccaaatgcagcgccacgtgtttttgataccggcggtcatcaaaccggagcggctattattcttggcttcggatcttcggcagatgggccagacggatttccttattgcgatattggtggatcaaataggcgtgttaacgaaaacgcatcgttgaaaaaaatggttatggggatgcgtgtaaagtcagatcagtctacatgtgcagtaagtaacgggcgtatatccagcgaaacaaaaaccacatgggaatatatccggagtacagcaaccattcgcattggtggacaaactacagcaggattacgccatttatttgggcatgtgaggaattttcgtctctggcataaagagctaacagatgcgcagcttggggaggttgtggagtgagagatttcacgttgcgtttcagtgataaagcagatttcagggcatttctcaggaaacttaactgggaagaggacgaagagctgcagaatgccgttctggttgatgagattggttttacgttcagggagacagatgttcctgatgacggagaaccagaatacacgcgaaacgaagggtactttgttaatatccgtcttcttgacgatggatttgatgattccgtgttccgtgagtgggtggttacaccagagcgcccgctcagggagtggttttaaggatagcagatggatatcacgtcgatacttcatgcgctttgtgccgtagcggtgcaggtactggctggtctttttaccggaaactgggcttacggggcgatagccggttgtacgttcttcattgcgcgtgaacacacccaggcagaatatcgctggattgaaatgttcgggcatggcaagcgtatgaatatgccgtggtggggtggttttgacccgcgcgtgtgggatatggcaagtctgatggattttgctgtgccggtggtggcgtgtctgctgatctggctgttggttaatcggtaaagtcatcatgtcaggggaacacagcaggagttggttttacataaaaaagcccaccagtgaggtgggcaacaggaatgattaattatctcaaagagaaacatcatatttctctttgcaacttctaacataaaaatgtggagaaataatggattttatattaattggtgattatgcaaccaacttcttatgcaaaacaatatagtcatttatatctggctggtcttatgcatacacctaaacaggtgtattacgtaaggaaacagacaggcgagtatctaccgaaccgtatacgttatggtcatgttgcatagtgtttgggaatataaagaattatataggagtttgctgtttgtaacctaaaaaacaataacaaatgttatagtgaacttgtttgttgtgctgctttcacattttctcagtaatcttaccagtaatatttttgttgctttgttgtttctttttttttataaaaaagaggtggtgcagaggaggaaatacagtggataaaaaactaattgcatttttgtgcacacttataattactggttgctcgaatgggatcggggattcaccttcccctccgggaaaaaatgtagaattggttggaatccctggacaaggtattgcagtgacttcaaacggtgcaactccaacacttggagccaacaacactgagtttcctgaagtttcaataatgagcactggtggggcgctgcttactatttgggccagacctgttcgtaactggctttgggggtatactccttttgattcagtaaattttggtgagaatcggaactggaaggttgtggatggaaaagatgccggcacagtgaaatttgttaatgttgcccaggggacttgcatggaggcctttaaaaacggggtgatacataatacctgtgatgataactcgttatctcaggagtttcagttactgccttctactaatggtaatgtgcttataagaagtagtgccttgcagacgtgtataagagcagactatttaagcagaactatactgtcaccgtttgcttttacaatcacccttgagaaatgccctggtgcaaaagaagaaacgcaagaaatgctatgggcaataagtccacctgtcagagcggcaaaaccaaatctgattaagccagagttaagaccattcagaccattgccaattccacctcatgacaaacctgatggaatggagggagtatgaaaaaattattattcctgttaatgattttgccgggtatttcttttgcagatttaagcgattttaaagttgcaacctggaatttgcaggggtcaaatgcaccgacagaaaataaatggaacacacatgtccgacaacttgttacgggaagtggtgctgttgatatcgtgatggttcaggaggcaggggcagtaccagcttctgcaacgttgactgagcgagaatttagcactcccggtattccgatgaatgagtatatctggaataccggaaccaatagtcgtccacaggagttgtttatatatttctcacgtgttgatgcattcgctaacagagtaaatcttgcgattgtttcaaacagaagagctgatgaggtgattgtattacctcctccaactgttgtatcacgaccgatcatcggcattagaattggtaatgatgttttcttctcaacccatgcattggcgaatcgaggcgtggattcaggagcaattgtaaatagtgtttttgagttcttcaacagacaaacggatcctataagacaggccgctaactggatgattgcaggagattttaaccgttcaccggctacactattttcaactcttgaaccagggattcgtaatcatgtaaatattattgctccaccagatccaacgcaagccagtggtggtgttcttgattatgcggtagttggaaattcagtgagctttgtacttcctctgttgagggcctcgttgttattcggattattaagagggcaaattgcctctgatcactttccagttggctttattcctggaagaggagcaagaagatgaaaacagttatagtactttttgttttactgctgacaggttgtgctgctgaacctgcaaatcagcgtaatcttcttactcagtttgtcggcaacaatgcccctgtagaccctgaacccagtccagtattggttaatatcagaaacgttcttacaggggggataatccgaaatcctgttggcagtgactttaatgtaaataattgggttatatctgaagtaaagactaatgatttggatttgatatcggcaccgggagggcatgttcagattaaaaatcctgatggcaatgaatgctttgctattctaaacgggcaattggcagtggctaagcagtgctctgaaagtgaccgtaacgcattgtttacatttataaccagtgatactggggctgtgcaaatcaagtcaataggaagcggtcaatgcctagggaatggagagagcattacagatttcagattaaaaaaatgtgttgatgatcttgggcgtccttttgatacggtgccgccggggttactctggatgctgaatccaccattatctccggcaataatgtctccattaacgagctgatctggaaaacgcggcacgttgtatgcaacttgccgcggttggctggtaaacttttcgatagtgcgagtattgaatgatttccagccgttaccgattttatataactgcagtggaattattcaacacacaggcaaaacggaataagctgagaaaaaagcgtgctttcccaatcaggggcaaatcacgtctgaatgacgcctgaaaacaggtggtggcctcaagaaggcttggaatattcttctttaatgttatgtaatttattgatttttcgtgtacgattttaaggcatttattccaagaaaaatttttaactctttgatttttcgactctgtatcatcggtctcgaaaaccggagtaggggcaactctaccgggggttcaaatccccctctctccgccactttatcaatgacttatctcccgacttcccgccttgcttttcctaaacagaacaatcgtagaatattcttgaagggttagatcgtcactgttttctgttcgatactgtgacattcagcacttgattcgctatgggtctgacaggaaggtttcgagcgaaaatctacagttattcagtcgttttcttatcggtcaccattattcttttagacattgatcctatgaaactgccgcaaagttgctggcgggaactgaagttgcgtagagaaggggtcaataattgagccaaaaaaggaacgcggccgtcagattaaagccgcgggacaaagtccataatttccaagagttgttgaatttcccagcttttttgaaagcctttgtatcatactaacaagtaaaaaaggtttaaataccaaaattaacctatatttctggttagctttaccatgacagatgacttgctcctggagacattggcgcagccagtctgtattggtgagttgtgtatttattgttcgccgttttctcagtttttttctacagacataataaaaaagacacgtctcaagcatgagcgtgtctgagtttgtcttatttatttgtcttggtaaattattgtcgttactaccaggcactgttctgttaaataattgaagtcagcgcaaaaaaatcaatgagacatcatctcctcgaccacttctttgctactcaactgatatggataatacgttggccagttttccatttcattcaataaagactgttgggtatcattacccataaaaatgtgaaaatgagatgattttcgtggtgcaattatatgatcgctaaattgaatatatttaggggctttgctttcaggatctttacattcgaataagtaacgaacgcctttcttgcctgatttataggtgagtattttgtatccatcgtaatcatatttacaggatgttgtttcattatgtctatggaattcaacaatgccgtcctcaatgccaatcatctcgatatctgtcacataacctttgcgataataatctttaatttcagcaaatgttttggttttatctgcatccgctttcttctgaaagacggggtcaagtttgccactttgcagtaaaggataaacggattgccagactccatcccagtcactgagtgttcggttttgtacattggtatcatcaaaaacaccattagcagctttttgttcgacctctgttaagggtttgccgtgtgagtgatgaccatgcgaaaaggcaggagcgctaacaataaagacgcctaaagcaacagccagtttatgaagacgaatcgccaaaacagtttcctccagagttaatgtacatgatgtgtaatgttatattgtaacatatggcgaaatgcaataactcttaggaaacgagagcatagttttctcaggtgtattttcctatcttattgaaataaaataaattattctggtgatgaaaggttgatgacaaacgaagcataacttgatgcgatctgtgtgggccggatagggcgctcgcgccgcatccggccgggataacgcgtactttgttggcaatatgaagttatagagataatttgttgtgaacctgcttgcgtaactggttgaaaagggaaagcaacttcttataccgtaaggctaaaagcagtaccgccagcccagcgtagatgagtggctgcggtgaaataatcttcactgaccacaaataatgtattggggccaggatcgcgacaagatagacgaagttatgcaactgttgccagtgtttgccgagttttcgctgcatcgcctgggttgaagtgaacgctaacgcaagcaaaattacccagctgataatacctaacgttaaataaggccgggtaattaactccttacctaataacgccagattattcacgcccagctccagcaatgcgtaactggttaaatgcagtgtcgcccaggcaaagcaccataagcctaacaggcggcgagtgcgtatcaataacggctgttttgcgtagcgtgccagaggtgtgattaacaaggtcgccagcaaaaatttcagtgcagtgcgaccggtaaaatgctgaatatctttcaccggatcggcacccagtccaccgtgattgatcgcccaggccagccagagaaacggcaacaatccggcaagatgcaggcaaactttcagccatgtcacctgttttgctgtcagacgcatttagaaattctcccgcaaatccaggccacgatacagcgatgccacctgctcggcgtaaccattaaacagtagcgttggctggcgctgtacattgaggatgccgcctgaaccaataaatcgttcggtagcctgtgaccagcgcgggtgatcaacatgcggattaacgttggcgtaaaaaccgtattcgtcaggcgctgccagattccaggtggttggcggacgctcgcgggtcagcttaatactgactatcgatttaatccctttaaagccatatttccacggcacaatcagtcgcaccggcgcgccattttgcggtggtaacgccttgccataaacacctacggtcatcagtgtgagcggatgcattgcttcgtcgagacgcaatccttcgacataaggatatttcagcccgccgccgataaagcggtcctgctggcctggcatctgttccggtgcataaattgtttcgaaagcgacatacttcgcattgctggtgggttcggcaagcgccagcaatttgtgcagcggaaaaccaatccacggcaccaccatcgaccatgcttctacgcagcgcatacgataaatacgctcttccagcgggaagcgacgggttaaatcatcgtgatcgagggtcaatggttttgccacttcgccgctgattttcagtgtccatggatcggttttcaggctaccagcattagcggcgggatcggctttatccaacccgaattcatagaagttgttataaccggaaactttatctgctggcgtcagtggcaggttattttgccaggctgcaggcttgctgaactccagcgcttttccggcgggggcgggtgggcgatcgttccctttaaaccagctaagcagatcggcatgcgcagcgtgaggcaaagaaagtgcagccgcgctgatgcccagtgcttttaacacctgccgacgcttcataaagaataccgactcggccgtaacatctgattcttttaaaaattgattctttttcataagccatcacacttttttgtcgttagccaacaagagccgtttactgttaatctgtcagggagtcacctccctaacagtagcagagatcagcttttacatatttacgcattaactgccacgataggttgaatacccatattggctgagtaacaaaggcacatgataatgctcgttcactttattaatatgaaattcaacggggatctcagggaagaaactttcaagattttgtttcttgaaatagtccccggttttaaatacgacacggtaatcgccagtagtcgcagtttgctcgggccacagtgccttaattcgtccatccttatctgttttggcggtattaagttgtaaccagccgttatccgctttcttttcaagagtgactgtcacgtcggcagcgggttttcctgtttgctggttcaaaatgtgcacgctaagaatgttttgttgtgcagcatagaccaaagaaggtaatgaaaatgcagccgttactacggagagtactaaataacgctttaacatgtttatatccttgtcatgtgaatgagttttgaggatagcgaaaaaacgtccagggtaaccttacagcagcattacaattttgtaatgaaccaggctgtttctataacatatgatttatggcatattattttcatgaagattctacttattgaagataatcaaaggacccaggaatgggtaacgcaggggctttccgaagcgggttatgtcattgatgccgtttcagatggcagagatgggctttatcttgcgctgaaggatgattatgcattgatcattctggatattatgcttccgggtatggatggctggcagatcttacaaacgttaagaacagcaaagcaaacccctgttatttgccttactgcaagggattctgtcgatgacagagtcagagggctggacagtggggcaaatgattatctggtaaaacctttttcattttctgagttgctggcaagggttcgggcacaattaaggcaacatcacgctctgaattcatcattagaaatcagcggcttaagaatggactctgtcagtcaaagtgtgagcagggacaatatcagtattacactgacgcgcaaggagtttcagttactttggctactggcctccagagctggcgagattatccccagaacggttattgcgagtgaaatttggggaatcaactttgatagtgataccaatacggtggacgtcgccattcgcaggctccgcgcaaaagttgatgatccttttcctgaaaagctaatctccacaatccgggggatgggctattcattcgtagcggtaaaaaaataatgaaaagattatctataaccgtccgtttaaccttgctttttatattgctgctgtttgttgctggcgctggaattgtctggactctctataatggcctggcaagtgagttgaaatggcgcgatgatacaacactcattaaccggacagcgcagatcaagcagttgttaattgatggggtaaatccagatacgttacctgtgtactttaaccggatgatggatgttagtcaggatatcttgatcattcatggtgatggcatcaataaaattgttaaccggacaaatgtcagtaatggcatgttaaataacatacctgctagtgagacaatcagcgcagctggcatttacagaagcattattaatgacacagagatagatgctttacgaattaatattgatgaagtttcgccatcattaacggttactgtggctaaattggcttcagccagacataacatgcttgaacagtataaaattaatagcattataatttgcattgtcgccattatactgtgctcagtattaagtccgttgttaatcagaacggggttacgagagatcaaaaagttgagtggtgtaacggaagcgctgaattataacgatagccgagagcctgttgaggttagcgcattaccgagagaactaaaacctcttgggcaggcgttgaataaaatgcaccaagctttagtcaaagattttgaacgtctaagtcagtttgctgacgatctcgctcatgaacttagaacgccaattaatgcattactgggtcagaatcaggttacgctcagtcaaaccagaagtatcgctgaatatcaaaaaacaattgccggaaacattgaagagctggaaaatatttcgcgattaacagagaacatactgtttcttgccagggcagataaaaataatgttttggtgaaactggactcgctttctctcaataatgaagtcgaaaatttgttggactatcttgaatacctttcagacgagaaagagatttgctttaaggtcgagtgcaatcagcacatctttgcggataaaattttactacaacgaatgttatcgaatcttattgttaacgctattcgatattcgccagaaaaatcgcgtattcagataaccagttttcttgataccaacggttctcttaatattgatatcgccagtcctggaacgaaaattcatgagcctgaaaaactcttccgtagattttggcggggagataattcgcgtcattccgtaggtcagggacttggtctttctttagtcaaagcgattgccgaattacatgggggaagtgctacgtatcactatctcagtaagcataatgtgttccggattacgttaccgcaaagaaattaacatagggcttcagtacgccataaattaaccgtgaaaaacgcagccacgtcgtgagtactaacgcggctgcgattgattatgcgcttacattcaaacgtaacagggattaacccgcgtaagctgccagcatttcctgtgccgccagtttacccaacgcattcgctgcgaaaggactgtcgccggtgagaactttacggtccttatgtactcgcccggtgatgtcgtcattaatgatgttcatgcccattttcttcagctcttcgccgaagtaccaggtgagatgacccggcatatagcctatctctggcgtttgtttgtctgcggcgtccgggaatgcacaaatggaataaccgttcagtgggttatcgccgtggcgaagcgccagaaaagcagccggaccatggcatagggagataacaaaacggtcattttcaatagcccactgcagagcggcggctacgtcttcactttctggcaaaccgatgagtgcaccatgaccaccgggaacaaagatcgctgcatattcgctgtctgcgttcaggctggcgacaacatccgctaatttcttcggattgcggaacaacgatttatgctgctcaaagaatggcattactttttcatctttgtgcggcatagcccagtattcaaacttggtcatcagaccggaaatggtcgccacttcgaattcgaaacctgcagcatggagatgatacaacggcagcaacgtttcaatcggatgattgcccgttgagaagagtttgccgttatcagtcggcaaatagcgttcatcagcggcgatcaccagaattttatgtttaccgcgatacggttttggatagtccacgccatcaagatcagagacgggactcgtatattggctaagcgaatattctgaagggaagaatgcattatcttcagcaatatcgacctgtggatttttacttttttgaacagtcatagtgtattccttattgttgcttagttagggtagtcactatatttgcgactgagctggccgctatttttaaccaggctggaaaattgagtcaatatatcgaaagcggtagtcggcgggcgtaagtatgtaatgatgatgctgcactggtgttgaatattattcacgccaaattttccttattgagcaacgccgtcgcaagtggcctcaatgattttagaccattatcagaggtacggggcggcagggagagatttagttatgtggaatattatggtgctgatgaatatttatatcccggattggtagggaaaaagcttttttaatgcactatttttgcaaatatttctatatgggaagcggttttgttacagattaaatttataaagaaatgcatttgggtgttggctggaagagacgctggtagattttattgagccaggggggggggcggggtaaggtgctgtatcgatatgctttggcaattgcgtgtgccgcagatcgagatgaaatgccaataaaaaagcctgagttcgatgagggacgaactcaggctagtgttaagttttacagtaacacgccgcggcgcgttggctgattagaactggtagacgataccaactgcaaactggtcatcagctgctgcgccagtaatggcggcgtcatctttatccagcatgttgaatttgtatgcagtataaacgttcatgttcttattgaagtagtaccaggtaccaacttcaatgtagttcacacggtcagcgtcaacatatctatgtccaggtacacctttgatatctttacctttagaatacacataacctaaggacggacgcagaccaaagtcgaattgatactgaacaaccgcttcaaagttctgggtttcattgataagttgatcacgcattattgtattgccttctcgatcggcaacacctgtatcaatagaacccggagtcatattacgagtttcaccgtacattacaactgcgtagacattgttcgcgtcatactttgcagccaatgaccacagttcagcatttgaaccgtttccatcggcaacttgatcgttggtgcgatcagatttgctatatgcaccaacgataccaaaaccattgatgttatagtctacagacaacgcatagccgtcaccattttgtttcttagtgctacggttgctgtttttgccttggtactgaatcgcaaaatcaagaccatcaaccaggccaaagaaatcatagttacggtaggttgcaacaccgttggtacgaccattcatgaagttgtcagcggaagcccaggaatcgccaccccattcaactaacatatcggtataagctgcggcatcataagcaacaccgtagttacggccatagtcaaatgatcctaactcgttatatttcaaaccggcgaaggttaaacgggttttttcctggttttcaccttcaggtttgctggcgtcgaggttgtattcaaactgaccgaaaccagtcagttcgctggtgatttgggtttcacctttaacaccgaaacgagcataggaggtatcttcgttttcgctgttattatcatcagtatttgaccagatgcgttcgccaaccatcttgccgtagaaatcaactttattgccatctttattataaatttcagccgcatttgctgcgccagcaactaataacgccgggaccagcattgccagaacttttcttttcattatgtattcccttgtgattataatcttcatgaatatatcaataagtgccgttatccaaaaaaaagcacatttggatactattctatgaagttcattttattttaaagattacatgtaacaaatgtatttaaaagatttcaaaatgtttctaatctatttaatataattcatagttatgaattccgaatataaatattcatgaatattatgtatgtatatcaatatgttatgagttgattgaaaagatagggagtgtcaatgattgttgcgctaaacggctggcgtgatctcgcgcacattaatgaaggcataaaaaaagccggcatcatgccggcccaaaaaatataaacaagacgataaaaggctaataacggaagcatcatgacacagaataataaaaaggtataattgtaatcagtgctaatatattgattaaatgaattaataaagccgatatcaaagataaataaaatcgctcaaaacgatttttcctgtattcactgccgttgcgcaaaatttatctatttgttcaaaaaatgattgagtcttgactggctcatccaatgtggaaaaatgtgatttttatcacataatggttctaagtctgaattttccgggttatctcaaaatggaatacggttcgacaaagatggaagagagactctctcgcagccctggcggcaaattggctttgtgggcattctatacatggtgtggctatttcgtctgggcaatggcgcgttacatctgggtgatgagtcggatccctgatgccccggtgtcgggatttgaaagcgatttaggatctaccgcgggaaagtggttaggggcactggtcggatttttatttatggctctggtcggggcattgttaggcagcatagcctggtacacccgacctcgtcccgcacgcagcagacgctatgaataaaaactgctaaggttgcgactctttggcaacggagcgcgtatggacttacaacactggcaggcacagttcgaaaactggttaaaaaaccatcaccagcaccaggacgcggcccatgacgtatgtcattttcgccgcgtctgggctacggcacagaagctggcggcagatgacgatgtcgatatgctggtgattttaaccgcctgttattttcacgatattgtgagcctggcgaaagatcatccacaacggcagcgttcttcaatcctggcggcagaagagacgcgtcgcctgctccgtgaagagttcgtgcaatttccggcggagaaaatcgaggccgtttgtcatgccattgccgctcacagtttcagcgcgcaaatcgcccccttaacaacggaagctaaaatcgtccaggatgcggatcggctggaagccctgggggcgattggcctggcgcgcgtgtttgccgtttcaggggcattgggcgtggcgctgtttgatggtgaagatccgttcgcacagcatcgtccgcttgatgataaacgctacgcgctggatcatttccagactaagttgctgaagctaccgcaaaccatgcaaaccgcaagaggcaagcagctggcgcagcacaacgcgcaatttttagtcgagtttatggcgaagctcagtgccgaactggcgggggagaatgaaggtgtcgatcacaaggtgatagatgcgttttcacccgcgggctgagcgcgtggccctaaatggctgtaattatgttaacctgtcggccatctcagatggccggttaaatctatgcaggaaaatatatcagtaaccgattcatacagcaccgggaatgccgcacaggcaatgctggagaaactgctgcaaatttatgatgttaaaacgctggtggcgcagcttaatggtgtgggtgagaatcactggagcgcggcaattttaaaacgtgcgctggcgaatgactcggtatggcaccgtttaagtgagaaagagttcgcccatctgcaaacgttgttacccaaaccaccggcacatcatccgcattatgcgtttcgctttatcgatctatttgccggaattggcggcatccgtcgcggttttgaatcgattggcggacagtgcgtgtttaccagcgaatggaacaaacatgcggtacgcacttataaagccaatcattattgcgacccggcgacgcatcattttaatgaagatatccgcgacatcaccctcagccataaagaaggcgtgagtgatgaggcggcggcggaacatattcgtcaacacattcctgaacacgatgtattactggcgggttttccttgtcagccattttcgctggctggcgtatcgaaaaagaactcgctcgggcgggcgcacggttttgcctgcgatacccagggcacgctgttctttgatgtggtgcgcattatcgacgcgcgtcgtccggcgatgtttgtgctcgaaaacgtcaaaaacctgaaaagtcacgaccagggtaaaacgttccgcatcatcatgcagacgctggacgaactgggctatgacgtggctgatgcagaagataacgggccggacgatccgaaaatcatcgatggcaaacatttcctgccgcagcaccgtgaacgcatcgtgctggtgggttttcgtcgcgatctgaatctgaaagccgattttactctgcgtgatatcagcgaatgtttccctgcacagcgagtgacgctggcgcagctgctggacccgatggttgaggcgaaatatatcctgacgccggtgctgtggaagtacctctatcgatatgcgaaaaaacatcaggcgcgcggtaacggcttcggttatggaatggtttatccgaacaatccgcaaagcgtcacccgtacgctgtctgctcgttattacaaggatggcgcggaaattttaatcgaccgcggctgggatatggccacgggtgagaaagactttgacgatccgctgaatcagcaacatcgtccacgtcggttaacacctcgtgaatgcgcgcgcttaatgggttttgaagcgccgggagaagcgaaattccgcattccggtttcggacactcaggcctatcgccagttcggtaactcggtggtcgtgccggtctttgccgcggtggcaaaactgcttgagccaaaaatcaaacaggcggtggcgttgcgtcagcaagaggcacaacatggtcgacgttcacgataaggccacccgcagcaaaaatatgcgcgcgattgccacgcgtgatacggcgattgagaagcgcctcgccagtttgttaaccgggcagggccttgcgtttcgcgttcaggacgccagtctgcccggacgcccggattttgtcgttgatgaatatcgctgcgtgatatttacccacggctgcttctggcatcatcatcactgctatctgtttaaagtgcctgcgacccgaaccgagttctggctggagaagataggtaaaaatgttgaacgcgatcgccgcgatatcagtcgcttgcaggagctcggctggcgcgtactgattgtctgggagtgtgcgttacgtgggcgcgagaagctgacggatgcggcgcttaccgagcgtctggaagagtggatctgcggcgaaggtgccagcgcgcagatcgacacgcaggggattcatttactcgcttgatgcatcctgaataactggcgcgacaacgggtttggccgggaagagatattttcccaacgtgaccagtaccaccgcgaaaacaattacgccgagcgccagccattcaattttcgacagcgtttcgccacccagtcccgtacccagcaagaccgcgaccaccgggttaacgtaggcgtagctggtggcgagagccggactgacattacggattaaatacatataagcgttaatggcgataatcgaaccaaacagcgccagatagccgaccgcaaggaagcctgacagggaagggagcgccgtcagtttttcacccgcaatcatcgatgcgatcattaacaccacgcctgccgccagcatctcaatcgcacccgccatcatccctacaggtaaggtaatgcgcgagccataaactgagccaaacgcccagctaatcgagccgattaaaatcagaatcgcgccccacggattgccgcttaaatttccaccgctattgagcatgatgattccggcaagcccaatggcgatacccacccattccagtttgcgcgttttaatgccaaacaggcggctgaagcacagggtaaagaggggcacggttgcaaccactacggcggcgatgccggaaggaacattttgatgttcggcaaccgtcaccatgccattaccgacagccagcaataacaggccaatcagcgcggcattgagcagcggacgtagcgggggaagtttgtgtccgcgcagtagcaaaaatgccagcaataaaataccggctgccaggaatcgaacgcccgccatcattaacggaggccagctttccacgccaatccgaatgacaaaataggttgagccccaaatgatatacaacgcaaacagcgcgccaaaaagcggtaacaactggcggaaacgcataatccctcacggcggaaataaaaaggtggttcatagtaaacgtgaaaatcattctgctggcgagagatataattgcacttgattgttaaataaatgttgacctgtgaagcaagtatcagagctgccgtttttgcttcatacttacacccttcaacaataaaaatgagagggaatgcttttggccgggagtagtttactgacgttgctcgatgatatcgccacactgctggacgatatctccgtgatgggcaaactggcggcgaagaaaaccgccggtgtattaggggatgatttatcgctcaatgcgcaacaagtttcaggcgtgcgggccaaccgggaacttcccgtggtctggggcgtggcgaaaggatcgctgatcaataaagtgattctggtgccgctggcgttgatcatcagtgcgtttatcccgtgggcgattacgccactgttgatgattggtggcgcgtttctctgctttgaaggggtagagaaagtgctgcatatgctggaggcgcgtaaacataaagaagatccagcgcagagccagcagcgtctggagaagctggcggcgcaggatccgctgaagtttgaaaaggacaaaattaaaggggcgattcgtaccgattttattttgtctgcggaaatcgtcgccatcacgctggggattgtggcagaggcgccgttgcttaatcaggtgctggtgctttcaggcatcgcgctggtagtgaccgtgggcgtctacggtctggtaggggttatcgttaagattgatgacctggggtattggctggcggaaaaatccagcgcgctgatgcaggcattaggtaaagggttattgattatcgcgccctggctgatgaaagcattatcgattgtcggcacgctggcgatgttcctcgtcggcggcgggattgtggtacatggtattgcgccgctgcatcacgccattgaacatttcgccgggcagcaaagtgcagtggtggcgatgatattaccgactgttttaaatctgattcttggatttatcatcggcggcatcgtggtgctgggagtgaaagcagtagcgaaaatgcgcggtcaggcacattaatactcgcactggctattatgcaaaatttgccatcttcaactaaggtgaacaagtttcactcgaaaaaaggaggcgagtatgagctttatggttagtgaggaagttacggttaaagagggcggcccgcggatgattgtcactggatactccagcggtatggttgagtgtcgttgatatgacggttacggggtcaagcgggaagcttttcatgaaaccgatcttgttccgggggaggggagtcgttctgcggaagaagtttgaaagggtatcattaacaccaggccggatcacatccggcctggtgtcccaatgcctgcaatgaatgatagtcgcgtcttatcatgccaccattataaaattatcgctgttttgcggtacgctatcgccgggttatgccagaatcataaaaaagcaggttgggagtcgtcagggtgcagcacgagacaaaaatggaaaaccagagctggttgaaaaaactcgcacgccgcctggggcctggtcatatcgttaatctctgctttatcgtggtattgcttttttccaccttgctcacctggcgtgaagtggtggtgctggaagatgcggaagatgcctatatctccagccagcgtaatcatctggaaaacgtagccaacgcgctcgataagcatttgcagtataacgtcgacaaactgatctttttgcgtaatggcatgcgcgaaagctctcgtggcgccactggatttcacctctctgcgtaatgccgtaaccgagttcgaacagcatcgcgacgagcacgcctggcaaatcgaactcaaccgacggcgcaccctgccagtcaatggcgtatcggatgcattagtcagcgaggggaatctcctgtctcgcgaaaatgaaagcctcgacaatgaaattaccgctgcactggaagttggttacttgctgcgactggcgcacaactcctcgtcgatggttgaacaggcgatgtatgtctcgcgtgctggattttacgtttcgacgcagccgaccttgtttacgcgcaatgtaccaacgcgttattacggctatgtcacccaaccctggtttatcggccattcgcaacgagaaaatcgtcaccgcgcggtacgctggttcacttcgcaaccggaacacgccagcaatactgaaccgcaggttaccgtcagtgttccggtagacagtaataactactggtatggcgtgctggggatgagtattcccgtgcgtactatgcagcaatttttaagaaacgccatcgataaaaacctcgatggtgagtatcagctctatgacagtaagctgagatttttgacctcttccaatcctgaccatccaacagggaatatttttgatcctcgtgaactggccttgctggcgcaggcaatggaacatgacacgcggggcggcattcgtatgaacagtcgttatgttagctgggaacgtctggaccatttcgacggtgtgctggtgcgcgtccatacgctaagcgaaggcgtgcgtggtgatttcggcagtatcagcattgcattaactctgctgtgggcgctctttaccaccatgttactcatctcctggtatgtgattcgccggatggttagcaacatgtatgttttgcaaagctcgttgcagtggcaggcgtggcacgacaccttaacgcgtttatataaccgtggcgcactgttcgaaaaagcccgtccgctcgctaaattgtgtcagacgcaccaacatcctttttctgtcattcaggtcgaccttgaccattttaaagcgattaatgaccgctttggtcatcaggcgggcgaccgtgttctttctcatgctgccggattaattagcagttccttgcgtgcgcaggacgttgccgggcgggtcggtggtgaggagttttgtgtgattctgcccggcgcgagtctgacgcaggctgcggaggttgcagaacgtattcgcctgaagctaaatgaaaaagagatgttgatcgccaagagtacgacgatacgcattagtgcctcgctgggggtaagcagcagcgaggaaaccggtgattatgattttgaacaactccagtcactggccgaccgtcggctttatctcgctaaacaggccgggcgcaatcgggtatgcgcgagcgataacgcttaacgggcggagaaaaaatggtccagcccttcacgccagccttccggtccttcacgctgcgttcgccagacgcgggtcggatcctcatcatgcagatgcaccccttcacggtttaaccctttcacaatcaccgcgtaatccattacctccagtaagggcgcatcgtttggcccatcgcccaggccaagtgtggttgggcgtttgcctgacgattgttgataggtcgcgataatccagttggcagcctgatcttttccggcagaggcatccaggacgtgccagaagcgcgcaccctgcataaactgcaagcccagttcgttcagacgagcggtaaattgtgccatacgctcgtcactgtcgcgccagattagcgttaccgacgcctcatgtagctgcgtcagcgccgcctggctacggcttaatcccgtccattcggcgatggttgcatcgtcgacatcatcaaaagtcgtgaatttaaaatgttctttctcgcgtagcgtatttaaaacctggctgatttcgccatggctaatacctgagatgatgcgtggaaaaccgtctatatcctgccattgctcagcaagctggatcactgcgccattttcggcaatcagcggtaaaccttgtagccccaacgttttttgcaagtacagcatttcggctgatgtcttactgctacagagaatgacgggaacattcgcttcgcgtaaacggctgagccagggggcagctggttgccagtcataactatgactgtccagcagggtgccatcaagatcgctaaaaaccagtagtggttgttgaattgaaagcatggttgcgcagtactccccttaccaggatgattctcaaaacagcacaaattatcaaagatgattttttcgggagcgatcccgttgacgccagagccaccaaggggtgacgcgcgtcacatttctattcataagtagcgttaatcattcatatcacgaatattttcttgtcagcgaaaaaaattgcggataaggtgatgaacacatcagatttcctggtgtaacgaattttttaagtgcttcttgcttaagcaagtttcatcccgaccccctcagggtcgggatttttttattgtgcattcaacgattcacttcagagacgctgaagtcatgaatatccagttcgaaggcatccgccaattcacgccatgtatgatattcacgtccatcgacgctaacgtgttcagaatcgttctggctgcgatgaacttcgctttcgctaatttcattgatcgccgccagcagggcatcgacatcgacgctgacctcacgttttgcggtatcgctgtactcttttgcggttttcatcatctttcctcgcaaccgttactctgttgttgccgccagtcgttaagtccgcctggcatcttttaagtatagaccgtcgagaaaatcaacactcgcgcgcgcctggcgctgccagaaaaacgaaattgttctacactggcacaaagccacaggaggaaaacgatgaaggtgaatgatcgggtaacagtcaaaacggatggcggtccgcgtcgtcctggcgtggtactggcagttgaggagtttagtgaaggcacaatgtacctggtttcgctggaagactacccgctcggcatctggttctttaatgaagcagggcatcaggacggtatctttgtggagaaagcagagtaatctaattcagcctgactggtgggaaaccaccagtcagaatgtgttagcgcatgttgacaaaaataccattagtcacattatccgtcagtcggacgacatggtagataacctgtttattatgcgttttgatcttacgtttaatattacctttatgcgatgaaacggtcttggctttgatattcatttggtcagagatttgaatggttccctgacctgccatccacattcgcaacatactcgattcggttcggctcaatgataacgtcggcatatttaaaaacgaggttatcgttgtctcttttttcagaatatcgccaaggatatcgtcgagagattccggtttaatcgatttagaactgatcaataaattttttctgaccaatagatattcatcaaaatgaacattggcaattgccataaaaacgataaataacgtattgggatgttgattaatgatgagcttgatacgctgactgttagaagcatcgtggatgaaacagtcctcattaataaacaccactgaagggcgctgtgaatcacaagctatggcaaggtcatcaacggtttcaatgtcgttgatttctctttttttaacccctctactcaacagatacccggttaaacctagtcgggtgtaactacataaatccataataatcgttgacatggcataccctcactcaatgcgtaacgataattccccttacctgaatatttcatcatgactaaacggaacaacatgggtcacctaatgcgccactctcgcgatttttcaggcggacttactatcccgtaaagtgttgtataatttgcctggaattgtcttaaagtaaagtaaatgttgcgatatgtgagtgagcttaaaacaaatatttcgccgcaggagtatcctggaagatgttcgtaggtattatttttcggataatccttaggataacatgataaacgttacggaattatattaatggcaattcactaataatatcagccagcaaattaaacatctcactgaataaatgttcgcaaaaaggcgcaattaacggcattaatgccgccattaaagagataccgacagtcagagttaatggaaatccaataacaaaaatggataattgtggggccatacgattaagtaagcctaatgccagattcagggtcagcagcagagtaatgagcggtaatgccagcatcagcccgttaaggaaaatcaaactccctgctttggtgagtgccagaaacgcattgctgttcaacggttcgccaccaattggcagggtgtgaaaggtatcgaccagcagtgaaatcaaccataaatgaccgttaaatgtcaggaacagcagtaacgccagcatatccatgatacgcgctaaaacgggcatattgagatggctggccggatcgacaaacgtcgcaaatgacagccccatttgcagaccgataatttcaccagcggttcgcacagcggcaaaggcaaattgcatggtaaaaccaagcgcaatgccgatcaggatctgctgcacggccagccacagagcaaagaacgaaaaaacaggaacatcgttggcaggtaatgatggggcaatagcgaacgtgatcatcattgccagacccagttttacccgtttcggcacgctgcgttcgctcagaattggtgcggtagaaatgagcgccagcacgcgcagtaacggccagaagtacaggcttaaccaggaaagccattgatcgcttgttacctgcatcattgtacggcctacccgatgatatacggcaggttagtgaacaaggtgcggacgtaatccagcaacagattgagcatccacggtccggcaataataatggcgataaatacggcgatgattttcggaataaacgacaacgtcatttcgttaatctgggtggcggcctgcaaaatactgatgataagacccgtgaccagcgccaccagcaacagtggggcagccagtgccagcgcgactttcatcgcttcagtccccatcatcatgaccgattcaggtgtcattttgcctcactagctgtaaaagctctgcgccagcgaaccgaccagcaattgccagccatccaccagtacaaacagcatcagtttaaagggcagagcaattgtggctgggggaaccatcatcatccccaatgccatcaacacgctggcaatcaccaggtcgataatcaaaaaaggaatgaaaatcgtgaagcctatctgaaatgcggttttcaactcgctggtcacgtaggccgggagcaaaatgcgcatcggcacagcttcaggtccctgcaacgggccagtattcgccagtctggcaaacaaccctaaatccgcctcacgggtctgacgcagcataaactcacgcagcggctgctcccctttttccagcgcctcctgcattgatattttctcttcgttgaatggctggtacgcatcgacataaattttatcgatcaccggcgacataataaaaaaggtcaaaaacagcgccagtcccagcaatannnnncattccattcattaattaattaatgaatgaatgnnnnnctttcgtgatagcaaggtttgaccacttgataatttccggccaggtcttcgttcgtagctggttgtcggtgttggcggtcaccacgaccttacaatcctcgcaagtggacatgccccagttgatcagcattgagatgaatgcggatttaccaataccgtgaccagaagcacgtgccagcataagcggctgatatcgcgtctctggattctgcaggtgatcacgtatctctcggaacgcatcggcctgccactgacgtggaccggtggcatgtgccagttcagtaccctcttccccccacgggaacgcatagagggcatagccaagcggatcgtgagtgaaccctgcaatatcctcgattaactgctcttcaggagataacgctgtatctgtcactgattgccatcctggcgttctttcagtctcttcctggctgccgctatgcgatcagcaattgtcacattcacattaacatccaggcgttctttgaatgcgttgacgtcgacgtgcttaccaatcagttcgaggttcttcaccttgtcaggccatttaatttttttgaggattgtctctatcgaatcctcgttcatgttcatgatggtcgatgacagatcaaagccactaagcgtagtgcgccagattttcggccactcgcggattggcttaaggctcccatcgtcgttgaggatgtcgatcacgtccatctggtcgatctccaccaggcgcatgagaacgtaatcagcactgacgcgcattcgtttgttgcgctcttccatcagctcggcaatccgtttttgaatgcgttcatcgcgcatcatgagactggctttaactgccgctgtatttggggagaatcctgcgttaatcgctgcctgagtctggttttcaggcgttttgatgtatgactggcaataagcctcctgcattgctgttagtggcttaaattgcgttgatttgcgtttataggctttaggttcagcaggcatcataaccaccgtggtaatagttaccgttgtggtaatagtaccatgcaaaataaagccgccatagttggcggcagtattcaaaaccatcaaattcatcatgcataacccactcgtgacatgtcacaatattaatttcgtttcatgccagcctttggtcacccagcattgcgagtcaccattacacgggcatgaattcacaggaactctctcgccgcacttaccgcaacgttttctgctgatcgattttatacgcccgtgcacgcgagcatcatcctggcggataagtaacgcaatatactcaccaaattcgtaaggcgcacgcccggggcgacgcgtggcacagttacgctccagcatttcaatttcctgagcatcaagcacaatctccagtttacgcacaccagatgcagcttgtctggctctctgagcggctttgcgctctgctgctgatttagccatcaatattcacctttatcgcgaacacctttaccggtttatcaccgaagtggggatgtgtgattgtcttgatttcatatccgtcatacgggacgtcaattctgcggctggaatcgtcgcgcttcggatatccctttgtgataatcaggcggtcatactcgcggaacataattcgcttattccagtagtcattacacaggcgatactcttccgttttctctccgcgaatcatggcatcgaagtattcacctttaacggcaagttgcaggttagccacgaccttcctccnnnnncattccattcattaattaattaatgaatgaatgnnnnntcccaaggggatgatatgggcttgtagccacatatcagagcgacttggtttctgtttccatttaacgccagaaaagttaactatttttttacaataaagtactttatcaacttctacttggcttggctgataatcatctatttttgccaatgtttaccgccctgtaaattgtagataaaagtggtttcatcacccaaacgtctcttcaggccattggctggcgataactttccccacaacggaacaactctcattgcatgggatcattgggtattgtgggtttagtggctgtagaaacacctgaccgctatccctgatcagtttcttgaaggtaaattcatcaccaccaagtctggctatgcagaaatcgccgggctcaacagcttgctcagggtcaaccagaattaacatcccgtcaggaaagctgggtttggaacctgttggtgcggtcattgagttaccttcaacctcaagccagaatgcagagtcactggcttttttggttgtgcttaccaatctctccgcatcgcctttggtaaaggttctgagttctggagagaacatcccagcctgaacatgagaaaaaacagggtactcatattgttttttaactggggccgatgagtattcgccaacaggtgaaaatgtcccgtcgtggttgaatgatatgttatcaataccaaggtatttaaacaccacaccaatatcactaagagatggatgacgagatccgcgcaaccagtgtccaatcccaccctgcgtcatacctagctcttcggctaacttctcttgagttatgccgagctctttcattctggatctagccagttcataccatttcattttcatgtccttattattacgctctgtactggaaccatccatgcacaatgtgtatttttacttgtattcgcaaagtacatattgtatttttttattcgtgtttactatggagggcatatgagcaacctacgaaaatatcgagagtcactgaatatctctcaaacaacacttgctaaggcagttggatgcacacagggagctatcggacattgggaatctggtcgtcgcttcccagaccttaaaacatgccgtgctcttgttgcgtgcctaaacaagttaggcgcaaaagtcagtcttgatgacgtgttcccgccggaacacaaagccgcttaataagcggatccgctctttgtaacaacggacattcgtcctacgtcgctgaaaagcgagttccaagatatctgaccaactaaggccatatgcgtttccacgcatacctttcaactaactattcactattggaaatcttaagaaatggaaagaacaagttacagcaaactatcacagcgtgacgttgatcgcgcagaaacagatttacttatcaatctgtcagctattacccagcgcggtctggcaaagatgattggctgtcatgaatcgaagataagcagaacggactggagatttattgcttcggtcttgtgtgctttcggaatggcatcagacatcagtccgattagcagggcttttaagtatgcgcttgatggactcaccaataaaaaacgcccggcggcaaccgagcgttctgaacaaatccagatggaattctgaggtcattactggatcaatccacaggagtcattatgacaaatacagcaaaaatactcaacttctgcagaggtaactttgccaaacaggagcgtaatgtggcagatctcgatgatggttacgccagactatcaaatatgctgcttgaggcttattcaggcgcagatctgaccaagcgacagtttaaagtgctgcttgccattctgcgtaaaacctatggatggaataaaccaatggacagaatcaccgattctcaacttagcgagattacaaagttacccgtcaaacggtgcaatgaagccaagttagaactcgtcagaatgaatattatcaagcagcaaggcggcatgtttggaccaaataaaaacatctcagaatggtgtatccctcaaaacgagggaaaatcccctaaaacgagggataaaacatccctcaaattgggggattgctatccctcaaaacagggggacacaaaagacactattacaaaagaaaaaagaaaagattattcgtcagagaattctggcgaatcctctgaccagccagaaaacgacctttctgtggtgaaaccggatgctgcaattcagagcggcagcaagtgggggacagcagaagacctgaccgccgcagaatggatgtttgacatggtgaagaccatcgcgccatcagccagaaaaccgaattttgcagggtgggctaacgatatccgcctgatgcgtgaacgtgacggacgtaaccatcgcgacatgtgtgtactgttccgctgggcatgccaggacaacttctggtccggtaacgtgctgagcccggccaaactccgcgacaagtggacccagctcgaaatcaaccgtaacaagcaacaggcaggtgtgacagcctgcaaaccaaaactcgacctgacaaacactgactggatttacggggtggatttatgaaaaacatcgccgcacagatggttaattttgaccgtgagcagatgcgtcgggatcgccaacaacatgccggaacagtacgacgaaaagccgcaggtacagcaggtagcgcagatcatcaacggtgtgttcagccagttactggcaactttcccggcgagtctggctaaccgtgaccagaacgaactgaacgaaatccgccgccagtgggttctgggctttccgggaaaacgggatcaccacaatggaacagttaacnnnnncattccattcattaattaattaatgaatgaatgnnnnngcaaggttactgcctgtacaaaatgggctgcaaagggcctaccacctataacgcctgttcctccacacgctggaacgatggcgtttccttcccgatccagtcaggtcacggctgcctgggttgtgcggaaaatggtttctgggatcgcggttcgttctacagccgcgtggtcgatattccacaaatgggtacccattccaccgccgacaccgtcggtttaaccgcgcttggcgtggtggcagcggctgttggtgtgcacgcagccgccagcgccgttgaccagcgcagacgtcataaccagcaacctacagaaaccgaacatcagccaggcaatgaggataaacaggcatgagcactcagtacgaaactcagggatacaccatcaacaatgccggacgccgcctggtggtcgacccgattacgcgcattgaaggccacatgcgctgcgaagtgaatattaacgatcagaatgtgatcaccaatgccgtctcctgcggcaccatgtttcgcgggctggagatcatcctgcaagggcgtgacccgcgcgatgcgtgggcgttcgttgaacgtatctgcggcgtctgtactggcgtacacgccctggcttcggtttacgccatcgaagatgccatcggtattaaagtgccggacaacgccaatatcatccgcaacattatgctggcaacgctctggtgccacgatcatctggtgcacttctatcagcttgccgggatggactggatcgatgtgttagatgcgctgaaagccgacccgcggaaaacctccgaactggcgcaaagcctctcctcatggccgaaatcatcccctggctatttcttcgacgtacaaaaccgcctgaagaaattcgttgaaggcgggcagttggggatcttccgcaatggctactgggggcacccgcagtacaaactgccgccagaagccaacctgatgggctttgcccactatctcgaagctctcgatttccagcgtgaaattgtcaaaatccacgcggtctttggtggtaaaaacccgcatccaaactggattgtcggcgggatgccttgcgccattaacattgacgaaagcggcgcagtcggggcggtcaatatggaacgcctgaacctggtgcagtcgatcattacccgtacggcggacttcattaacaacgtgatgatccccgacgccttagccatcggccagttcaacaaaccgtggagcgaaatcggcacgggtctttctgataaatgtgtcctcagctacggcgcattcccggatattgccaacgactttagtgagaaaagtctgctgatgcctggcggcgcggtgattaacggcgacttcaacaatgtgctgccagtggatttggttgatccgcagcaggtgcaggagtttgtcgaccacgcctggtatcgttatcccaacgatcaggtggggcgtcatccgttcgatggcattaccgacccgtggtacaaccccggcgatgtcaaaggcagcgataccaacattcagcagctgaatgaacaggaacgctactcgtggatcaaagcgccacgctggcgcggtaacgcgatggaagtggggccgctggcacgcacgttaatcgcttatcacaaaggcgatgctgcgaccgttgagtcggtcgatcgtatgatgtcggcgttgaaactgccgctttccggcatccagtcaacgttgggccgcattttgtgtcgcgcgcacgaagcgcagtgggccgcaggtaagttgcagtatttcttcgataaactgatgaccaacctgaaaaacggcaatcttgccaccgcttccacggaaaaatgggaaccagcaacctggccgacagagtgccgtggtgtcggttttaccgaagcaccgcgcggggcgttaggccactgggctgccattcgcgatggcaagattgatctctatcagtgcgtggtgccgaccacctggaacgccagcccgcgcgatcccaaagggcagattggcgcttatgaagcggcgctgatgaacaccaaaatggcgatccccgagcaaccgctggagatcctgcgtactctgcacagctttgacccgtgcctcgcctgttcaacacacgtgctgggcgacgacggtagcgagcttatctccgtgcaggtgcgttaacagcgaaggagaatcatcatgcaacagaaaagcgacaacgttgtcagtcactatgtctttgaagcacccgtgcggatatggcactggctgacagtgttatgcatggcggtgttgatggtcaccggttactttatcggcaagccgctaccttccgtcagcggcgaggcgacgtatctgttctatatgggctacatcaggttaattcacttcagcgccgggatgatttttaccgtggtcttgctgatgcggatctactgggcttttgttggcaatcattactcccgcgagctgtttatcgtgccggtatggcgtaaaagctggtggcagggcgtgtggtatgaaatccgctggtatctgtttctggcaaaacgtccgagtgccgatataggccataaccccatcgcccaggcggcgatgttcggctatttcctgatgtcagtttttatgatcatcaccggctttgcgctgtacagcgaacacagccagtacgctatttttgcgccgttccgttatgtggtggaatttttctactggacgggcggcaactcaatggacattcacagctggcatcggctggggatgtggctgattggcgcgtttgtgatcggtcatgtctacatggcgctgcgtgaagacatcatgtccgacgacacggtgatctccactatggtcaacggctaccgtagccacaaatttggcaaaataagtaacaaggagcgttcatgagcgagcaacgcgtggtggtaatggggctgggcaacctgctgtgggccgatgaaggcttcggcgtgcgggtggcggaacggctgtatgcccattaccactggcccgaggatgtggagattgtcgatggcggcacccaaggactgaacttgctggggtatgtcgaaagcgccggtcatctgttgattctcgatgccattgattacgggctggaacccggaacgctacgaacgtatgccggagaacgcattccggcttatctcagcgcgaagaaaatgagcctgcaccagaacagtttctccgaagtgctggcgctggcagatatccgcggacatctgccagcacatattgccctcgtcggtctgcaacccgcgatgctcgacgactacggcggcagcctgagcgaactggcgcgggagcaactgcccgctgcggaacaggcggcgctggcgcagctggctgcgtggggaattgtgccgcaaccggctaatgaatcgcgctgtctcaattatgactgtctgtcgatggaaaattacgaaggcgttcgcttgcgtcagtacaggatgaggctggaggaacagggatgagcaacgacacaccatttaatgcgttgtggcaacgaatgctggcacgtggctggacgccggtcagtgaatgccgtcttgacgactggcttacgcaagcgccagacggcgtggtgttattaagcagtgacccgaaacgcacgccagaagtcagcgataacccggtaatgattggcgaattactgcgcgaatttcccgactatacatggcaggtagcgattgctgatcttgagcagagcgaagccatcggcgatcgctttggcgtctttcgctttcccgccacattagtgtttaccggcggaaactatcgcggcgtgctgaatggtattcacccgtgggcggaactgataaacctgatgcgcgggcttgtcgaaccgcaacaggagcgtgcttcatgagcgaaacttttttccatctgctggggccaggaacgcaaccgaacgatgacagtttcagcatgaatccactgccgatcacctgtcgggtgaatggtgaaccgagtatggcggccctggagcaatgtgctcacagcccgcaggtgattgcgctgttaaacgagttacaacatcaactaagcgaacgccagccgccgctgggtgaggtactggcagtcgatctgttaaatctcaacgccgacgatcgtcactttatcaatacgcttctcggggaaggggaagtgtcagtgcgcattcagcaggctgacgacagtgaaagtgaaattcaggaggcgatcttctgcggattatggcgggtacgcagacgtcacggcgaacagttgctggaagacaaactggaggctggctgcgcaccgctggcgttgtggcaggcggcaacgcaaaacgtcttgccgacagattcgctgttaccgccgcccattgatggcctgatgaatggcctaccgttggcccatgaattactggcacatgtacgtaaccccgacgcgcagccgcacagcattaatatgacgcaattacccatcagcgaagctgaccggctttttctctcacgtctctgtgggccgggaaatattcagattcgtaccattggctatggcgagagctatatcaacgccacggggttacgccatgtctggcatttacgctgtacggacaccttaaaaggcccgttactggaaagttatgaaatctgcccaataccggaagtggtgctggcagcgccagaagatttggtcgactctgcgcagcggcttagcgaggtatgccagtggctggcggagggggcaccgacgtaaaaagacggtaagtatcgctttcaggcttatgaatatcgcaatcggcgaatacctctggtcgtagagtttcaggataaagagggagatctaccattaacgggttatttttctctcttcgcctacaggagtgcgcatgtgggatgtcattgatttatcgcgctggcagtttgctctgaccgcgctgtatcactttttatttgtaccccttaccttggggctgatttttttgctggctatcatggaaaccatttacgtggtcaccggcaaaacaatctaccgcgatatgacgcgcttctggggtaagctcttcggtatcaactttgctcttggcgtggctaccggcctgaccatggagtttcagtttggtactaactggtcattctattccaactatgtgggcgatatttttggcgcaccgctggcgatggaagcattaatggccttcttcctcgaatccacctttgtcgggctgttcttcttcggctggcagcggctgaataaataccagcacctgctggtgacgtggctggtggcgttcggttcaaatctctctgcgttgtggatattgaatgccaacggttggatgcaatacccgaccggtgcgcattttgatatcgacaccctgcgtatggagatgaccagtttcagcgagctggtctttaacccggtcagccaggtgaaatttgtgcacaccgtaatggcgggatacgtgaccggggctatgtttattatggcgatcagcgcctggtatttactgcgcggacgggagcgcgatgtcgcattacgctcgtttgccatcggttccgtcttcggtactctggcgattatcagtacgctgcaactcggagacagttctgcgtatgaagtcgcgcaagtacaaccggtaaaactggcggcgatggaaggggagtggcaaacagaacctgcacctgcaccgttccatgtggttgcctggccggaacaggatcaagagcgtaacgcctttgccatcaaaattcccgcgctgctagggatcctcgccactcactcattagataaacccgtgccgggtctgaagaatttgatggctgaaacctacccacgcttgcaacgcggacgtatggcgtggctgttaatgcaggaaatatcgcaaggcaatcgtgagccgcatgtgttgcaggcattccgggagctggaaggcgacctgggttacggcatgttgctctcccgctatgcaccggatatgaatcatgtcacagccgcacagtaccaggcggcgatgcgtggcgcgatacctcaggttgcgccggtattctggagtttccgcatcatggtgggctgtggttccctgctgctactggtgatgctgattgcgcttgttcagacgctgcgtggcaaaatcgaccagcatcgctgggtgctgaaaatggcgctctggagtttgccgctgccgtggattgcgattgaagccggatggtttatgaccgagtttggtcgtcagccgtgggcgatacaagacatcttaccgacatactccgcgcactccgccttaaccacaggacaactggctttctcactgatcatgatcgtagggctttacaccctgttcttaatcgccgaagtctacctgatgcagaaatatgcccgtctggggccgagcgcgatgcagagtgaacaaccgacgcagcaacaggggtaaaggagaaaatcatgtttgattatgaaacattgcgcttcatctggtggctgctgattggcgtgatcctggtggtctttatgatctccgacggatttgacatggggatcggctgtctgctgccgctggtggcgcgtaatgatgatgaacgtcggatagtgataaacagcgttggcgcgcactgggaaggcaatcaggtctggttgatcctcgcaggtggggcattatttgccgcctggcccagagtgtatgcagcggcgttttccggcttttatgtggcgatgattctggtgctgtgctcgctgttcttccgcccgctggcctttgattatcgcggaaaaatcgccgatgcacgctggcgtaaaatgtgggatgccggactggtcatcggcagtctggtgccgccggtagtcttcggtattgcattcggcaacttgctactcggcgtgccgtttgctttcacaccgcaattacgcgtggaatatctcggcagcttctggcaactgctgacgccattccctttattgtgtggattgctcagtcttgggatggtgattttgcaaggtggcgtctggttacaactgaaaactgttggtgtgattcatctgcgttcacagctggcgaccaaacgcgccgcactactggtgatgctgtgctttttgctggcgggttactggctgtgggttggtattgatggctttgtactgctcgcccaggatgctaacggtccttccaatccgttaatgaaactggtggcagtgctacctggtgcctggatgaataatttcgtcgaatcgcccgttttgtggatcttcccgctgctggggttcttctgcccattgctgacggtgatggcgatttatcgtggtcgcccgggttggggatttttgatggcgtcattgatgcaatttggcgtgattttcacggcaggcatcacgctgttcccctttgtcatgccgtcaagcgtgagtccgatctccagcctgacgttgtgggacagcacttccagtcagctgacgctgagcattatgttggtaatcgtgctgatatttttgcccattgtgttgctctacactctctggagctactacaaaatgtgggggcgcatgacgacagaaactctccgccgtaacgaaaacgagctgtactaaggagcaggaacaatgtggtatttactttggttcgtcggcattttgttgatgtgttcgctctccacccttgtgttggtatggctggacccgcgtctgaaaagttaacgaaggtaagcctgatgaggcgcattagcgtcgcatcaggcaatcaataatgtcggatatgaaaagcggaaacatatcgatgaaagcgatcttgatcccattcttatctcttctgattccgttaacaccgaaatttgcattcgctcagagtgagccggagctgaagctggaaagtgtggtgattgtcagtcgtcacggtgtgcgtgcaccaaccaaggccacgcaactgatgcaggatgtcacccctgacgcatggccaacctggccggtaaaactgggttggctgacaccgcgcggtggtgagctaatcgcttatctcggacattaccaacgccagcgtctggtggccgacggattgctggcaaaagagggctgcccgcagccaggtcaggtcgcggttattgctgatgtcgacgaacgtacccgtaaaacaggcgaagccttcgccgccgggctggcacctgactgtgcaataaccgtacatacccaggcagatacgtccagtcccgatccgttatttaatcctctaaaaactggcgtttgccaactggataacgcgaatgtgactgacgcgatcctcagcagggcaggagggtcaattgctgactttaccgggcatcggcaaacggcgtttcgcgaactggaacgggtgcttaatttcccgcaatcaaacttgtgccttaaccgtaagaaacaggacgaaagctgttcattaacgcaggcattaccatcggaactcaaggtgagcgccgacaatgtctcattaaccggtgcggtaagcctcgcatcaatgctgacggagatatttctcctgcaacaagcacagggaatgccggagccggggtggggaaggatcaccgattcacaccagtggaacaccttgctaagtctacataacgcgcagttttatttgctgcaacgcacaccagaggttgcccgcagtcgcgccaccccgttattggatttgatcatgacagcgttggcgccccatccaccgcaaaaacaggtgtatggtgtgacattacccacttcagtgctgtttatcgccggacacgatactaatctggcaaatctcggcggcgcactggagctcaactggacgcttccaggtcagccggataacacgccgccaggtggtgaactagtgtttgaacgctggcgtcggctcagcgataacagccagtggattcaggtttcgctggtcttccagactttacagcagatgcgtgataaaacgccgctgtcattaaatacgccgcccggagaggtgaaactgaccctggcaggatgtgaagagcgaaatgcgcggggcatgtgttcgttggccggttttacgcaaatcgtgaatgaagcacgcataccagcgtgcgctctccatcaagacaaataaacatttgccgctgttggtccacgcaggccatttacgcggcaaaattccacgcgtaatcctggtataagcacttctgcgtcgcggggagtgaatgcggaaatatggacctggacttctttacgaccgtcggaggggataatgaatcctttgccgcttttgcgatcaaaggttttgacaattcctgtcattttacgggacaaacaaattccttactgaaaatactgcgctgcactatacggggttaataaaataaagccagcgatatttaagaccgccggacggctaaaataaaatttgcttaatctcaattatcatgcgttaatagctgcgtcggtttgaaagacagacagcatacaaagtagtttactaaagcagttctcattatcaggcattatccccttcttttgagtctctctcctgaacactaagtagtttctgtattaaagccctgtttgccgaaaggcccaaaatgaaggaagtaaaatatgtctaataaaatgactggtttagtaaaatggtttaacgcagataaaggttttggctttatcactcctgatgatggcagcaaagacgttttcgtccatttcactgccatccagagcaatgaattccgcacgctgaacgaaaatcagaaagttgaattttctattgagcaggggcaacgtggtcccgcggcagcgaacgttgttacgctctaaggttgccgttattactcaacatctccatttccgctgtccatgttgccatggttcacagtaccgcacatcggcattcgatgtgacggagcgaaatcctttaggagcaaagtgcattttttgtaaatcgacgatgatcacctttgataacgtcgcgctgcaaatacgcactgaccatgcgccgctggatttcacaaaataatatcaggctccctcgtggagccttttttatatctgccttatttttcttcaatgctgtatgtatagtaagcgataacctgttgattattgaatctttcggggagatggcttataacatttcttacctgaccagggtaccgggaaccaacaccttactggcgtgttgctgtcttttaagaccagaagaggttaacagtgaatattgaagagttaaaaaaacaagccgaaacggaaatcgccgactttatcgcgcaaaaaatcgccgagctgaacaagaatacagggaaagaagtctctgaaattcgcttcaccgcacgagaaaaaatgaccgggcttgaaagttatgatgtcaaaatcaaaataatgtgattttgtgaacatcaccccgtgcgaggtgatgttccgcttgttgctaatttagtgaccaatcattggcgattgcggaattaagcgttggtacaattcctccggcaccgggctttgccatactcccgcatacattgcgtaaccagttgccgcaaacataatccccataaccagtagcgtcattaaccagccagacaacgcaaaggcttttttatttgccgcaggtttttgcagtgaaaaggtcaatgttgaggctaccggacatgactctacgcaagtcatacagccggtacattccactgttcgtacctgagttaatttatcgaccgggatccgtgatgggcaactttttgcgcatttgccacaatcgatacaactttcggcattgcgacgaatcttaaacggcgataatagcgaaaccacgctcatcagcgcgccatatgggcaaagataacgacaccaggcatggcgaataaacaggctggcaatcagcaaaacgatcatgctgattaatgtcgcggtccccatatgacgaaagaaatcgagcattttaacgtccatcaccacgctgtagggcgacaacataaaatagtgaatcgcctgagcgggcatcaataacgcgatatagagaaaaaaactcaacagcaaatatttcacgccgcgcagaggaatatccagccagcggggaaggacaaattgccgaccaaacagtttgttaccgagatcgccgattaattccgaaagcgtaccaaccgggcataaccatgaacaaaaggcctttttgagtaatagactgatgacgataaaagcgaccaataacagcatcgcggcggcgtggacggacggtaactgacctgttgcaaggctatatttcagattcatcagaccggcaatcggtagccagccttcgatacctcccggtctggtgacaaatgtcgtactacctgccgtttcgtaatagcgcacccaataccagaacgtgatggcaatataaatattaattgccaacagtaataattgcgtcgctttacgccaggtcgtggcattgcgccagtcattccacggtaatttgccgcccgtcgtgcctggccgccgctgccagcgggttctttttttctctgccatgattttgccagtccgttaagttgcataccaaatgccactattctagttgttcttaactggctgatattgattcaaatcgcgttcaggtctttcttattaaccatgcttccagagcggcaacactgcgtgtaatttcttcgtgtggaaggggggcagataatggctgctgctccagttgtgcgcattgctggctggcgctacgcattcccagactcgagcaactgctttttagctgatgtgcggcacgctttattttctcgttatcctgactggcgcgggcaatgtcgatttcatcgagaagcggcagggcatgttgtttaaataatatcagccattcgtggatcttctccgcccccattaaatgagcatcttcattgagttgcgatacatccagtggttgatcgttattgacttgcagttggagatagtgcgccagtaattgaccgagcacttcacgcggcaccggtttagggataatcccgcgaaatagcgagctggtacgctgtcgcagtgtttcgtcaatgacatgggcgctaaagccaatcaaaaccagtgacggatattgctgtgccagttgccgggcaagggtaatgccgtcgatatccggcagatcaaaatccaccagtgcggcagcaaacggttcgctattttgcaatgcctctattgcctgcgcggcatttcctactgcaacgacctgcgcaccactggtgttcagcatttcgacagtaattcgctgggtgagcgggttatcttcaattaacagcaaacgcaaatcgtccagacgtaccgcctgattgactgttttgggcacgggtgcagtggcaatacgtaacggcaagcgtaaacaaaaacagcttccaacctccggcgtgctggtggcgctcagttcgccgcccatcgcctgggccagacggctactgatagtcagccccagcccggttccgccgcgtttgctgcttacctgaacaaatggctggaagatttctgccagtttcgcgggatcaataccgcaaccgctgtcttccacttcgaccagccattgttcgccatcagtgcgactacgcaggataatgtgcccttcgtcggtgaaacgcagggcgttgctcaacaggttggtgatgacctgacgaatacgccgcggatcgcccattaacgcagtcggtacatcgtcggcaatttctgttgccaggcgaatcgggcgacctttcacccttccgctcattaattgcagggtactttccagcagcgggcgcggttcaaagggttcatcgctgaccgaaacattcttgccgcctgcttcgatagccgaataatcgagaatatcgttgaggatggtcagcaacgattcaccagagtcggtaatcgcccgcaaatcatcgcgctgggcgttaagtgcggggttatctgccagcagctgtgcggtgccgagaataccgtacagcggtgtgcggatctcatggctcatcgccgccagaaacgccgattttgcctggctggctttttctgcttccgcccgtgcctgtcggtgttctatcaccagttcctgcaattcagctgtacgcgctttgacctgcgccgccagctgttcgcggtggcgattcagtgcatgaacactgctgcgaaacgcatccatcagccgcccgatggtatccagttcccgtacgccagcggtttccgggaaaggggagtcgatatcaccatccagcaagcgttgcagcgcctgcgtttgttctgcaagagggcgcgtgactgagcgataaaccacgcgccagaggatcagaatcagtgcgcaaagagaaactaatcccagcaataacaggctgtattgcccgcgtgcactggctttttccagatgtgccagcccgtgctgattacgcagctcaatggtgtcgaccagctgactgacttcgctactaaactgcgcgaactgggcgatgttattttgggcgagagtttgcaggtgattgctgatttcactgtcctgctgatacagcgccagcaaatcgctatattggctaacggtagttaacgttgttgctacctgagtacgaacacccggatcttcaatgcgtatttgccgacgttgcagaattttcaccgcattattgagctgcttttccagcgttggcgcatttttctggatctgttccagccccagattcatcaccatttgctgcacccgcagggcgctaaggcgcagttcattcatctggttaacatactcaagatcgatatcaatcagccgatcgagtgcactttctgcggcctgacgctgatgttgttcgatcaaatcgtaaatcccggcctgggtcgctccggcggaggttgccgcattattcgcctgaccttgcgccaggcgtgcgatctcatcggcggcggcgactatctgctgactgagttgctgttgttgctggcgcagttgcaaacgctgccccaccagttccccttgctgacgtaacgaacgggagatctcctgctcctgttgttcaatagcggtggtgtcaaaaccttgttcccgtaacgcttgcagcaacgcattaatcttcaggctttgtgcggtgagcattcgcccctgcgcctgccacatcttttcgttatcggcactggtcaggttctgcgcggcgaaaagttcccaggcgctggcttcgctcaactggcgcgccatattcatggtaggaatcaatgcctgagtgttgtctttttccacctggctgataaagcgcaggttgtaccatcccaccagggtactggtcagggttaacagcgccatcagggcaaagcccatccagagtcttcgggtcagggttaaattcacggtcggtgcactttaggtgaaaaaggttgagtcgcaaagcagaatgcatctagcataaagccttattattgatgaggctatcatgcgcgtactgctatttttacttctttcccttttcatgttatcggcattttcggctgataacctgttgcgctggcatgatgcacagcattacacggtgcaagcctctacgccgctaaaagccaaacgcgcatggaaactgtgcgcgctttatcccagtttgaaagattcatactggttatcgttgaactatggtatgcaggaggctgctcgccgctacggtgtggatttaaaagtgctggaggcaggcggctacagccagttggctacccagcaagcacaaatcgaccagtgtaaacagtggggcgcagaggccattttgctcggtagtagcacgacgtcatttcccgatctgcaaaagcaggtagcaaatctgccggtgatcgaactggtgaatgctattgatgctccccaggtgaaaagccgcgttggtgtgccctggtttcagatgggctatcaaccagggcgatatctggtgcaatgggcgcacggtaaaccactgaacgtgctgttgatgcccggccccgataacgccgggggcagtaaggagatggtagagggttttcgcgcagccattgccggaagcccggtacgtattgttgatattgcgctcggtgataacgatattgaaatccagcgtaacctgctgcaggagatgctggaacgccatccagaaatcgacgtcgttgccggaacggccattgcggcagaggcggcaatgggggaagggcgcaacctgaaaacgccgcttaccgtggtgtcgttttatctttcacatcaggtgtatcgcgggttgaagcggggaagagtgattatggcagccagcgatcaaatggtctggcagggggaactggcggttgagcaggctatcaggcaattacaggggcaatcggtgtctgataatgtcagcccaccgattttagtcatgacgccgaaaaatgccgaccgcgaacatatccgccgctcgctgtcaccagggggatttcgtccggtttatttttatcagcacacatcagcggctaagaaataaccttcgccatgttgtgtcaccagtaaatccgcactgagtttatggcgtaaacgacgaattaacacatcgacggtgcgcaggtcagggttttccacccgacgcgcagagagcatacgcagcagacgttcacggctgagaatttcgcccggattagtcacaaatgccaccagcatttcatactctgcgcgggtcagtttaatcggctcgccatcccgctccagcgtatggcgcgacacattcaggcaataaccggcaaagcgatagcagttgtcctgagtgtgcggttgcgcctgtcgcgcgaggtcgattcgccagagcaaatttttcactcgtaccaccagttcgcgcagctccagcggtttggtgacgtaatcgtctgcgcccatttccagcccaacaatacggtcaatccgatcgctgcgtccggtaaccagaataatccccaccgttgagcgttctcgcagggcgcgggttaacatcaggccattttcatcgggcaaattgatatccagcagaatcaaatccaccggctgattctgcataatttcccgcagcccggcaccgctcgccgtaacggaaacggtatacccctcctgagtgaagtaagattgtaatcgcgcctgggtaaccggctcatcttcaacaataacaatgtgatgtggcatcagagggttttactcattctgttcatatctgttcatattctgccgtaagctgttcatcctgaccagtgccgctgttcatatttgctcattaagatcgcttcactaaaccataattttacaggggctattatgcggaaactctggaacgcgctacgccgacccagtgctcgttggtcggtactggcgctggtcgctactgggattgtgattggcattgcgctgattgtattgccacacgttgggatcaaagtcaccagcacaaccgaattttgtgtcagttgccacagtatgcaaccggtgtatgaagaatataaacagtcggtgcatttccagaacgcctccggcgtgcgagctgaatgccatgactgtcatatcccgccggatattccaggcatggtgaagcgcaaactggaagcgagcaacgacatttaccagacctttattgcccactccattgatacacctgagaaatttgaagccaaacgcgcggaacttgccgagcgtgaatgggcgcgaatgaaagaaaacaactcggcaacctgccgctcctgccataactacgatgcgatggatcatgcgaagcagcatcctgaagcggcgcgtcagatgaaggtggcagcgaaagataatcaatcctgcatcgactgtcataaaggtattgcccaccagttaccggatatgagtagtggcttccgtaagcagttcgatgagctgcgcgccagtgctaatgatagtggtgacacgctgtactccattgatattaagccgatttatgcggcgaaaggcgataaagaagcgtctggttctctgctgcctgcttcggaagtgaaagtccttaaacgtgacggcgactggctgcaaattgaaatcactggctggacggaaagtgcaggacgtcagcgtgtactcacccaattcccaggtaaacgcatctttgttgcctcgattcgtggtgatgtgcagcagcaggtgaaaacactggagaaaaccaccgttgccgacaccaataccgagtggagcaagttgcaggccactgcgtggatgaagaaaggcgacatggtgaacgatatcaaaccgatctgggcttatgcggattcgctgtacaacggcacctgtaaccagtgccacggcgcaccggaaatatcccactttgacgctaacggttggatcggcacgctcaacggcatgattggctttaccagcctcgataaacgtgaagaacgcaccttgttgaaatatctgcaaatgaatgcgtctgacaccgcaggtaaagctcacggcgataagaaggaagaaaaataatgaacaataacgatctctttcaggcatcacgtcggcgttttctggcacaactcggcggcttaaccgtcgccgggatgctggggccgtcattgttaacgccgcgccgtgcgactgcgacgcaagcggcgactgaggctgtcatctcgaaagagggcattcttaccgggtcgcactggggggctatccgcgcgacggtgaaggatggtcgctttgtggcagcaaaaccgttcgaactggataaatatccgtcgaaaatgatcgccggattgccggatcatgtacacaacgcggcgcgtattcgttacccgatggtacgcgtggactggctgcgtaagcgccatctgagcgacacctcccaacgcggtgataaccgttttgtgcgcgtgagctgggatgaagccctcgacatgttctatgaagaactggaacgcgtacagaaaactcacgggccgagtgccttgctgaccgccagtggttggcaatcgacagggatgttccataacgcttcggggatgctggcgaaagctattgccttacatggtaatagcgtgggtacgggcggagattactctaccggggctgcgcaggtgatcctgccgcgcgtggtaggttcgatggaagtgtatgaacagcaaacctcctggccgctggtattgcagaacagcaaaactattgtgctgtggggctccgatttgttgaaaaaccagcaagcgaactggtggtgcccggatcacgatgtttatgaatattacgagcagctaaaagcgaaagtcgccgccggtgaaattgaggtcatcagcatcgatccggttgtcacatccacccatgagtatctggggcgcgagcatgtgaagcacattgcggttaacccgcaaactgacgtgccgctgcaactggcgctggcgtatacgctgtacagtgaaaacctgtacgacaaaaacttcctcgctaactactgtgtaggttttgagcagttcctgccgtatctgctgggtgagaaagacggtcagccgaaagatgccgcatgggctgaaaaactgaccggcattgatgccgaaaccattcgtgggctggcacggcagatggcggcgaacagaacgcagattattgctggctggtgcgtacagcgtatgcagcacggtgaacagtgggcgtggatgattgtcgttctggcggcgatgctggggcaaattggcctgccaggtggtggttttggttttggctggcactataacggcgcaggcacgccggggcgtaaaggcgttattttgagtggtttctccggctctacgtcgattccgcctgttcacgacaacagtgactacaaaggctacagcagcaccattccgattgcccgttttatcgatgcgatcctcgaaccggggaaagtgatcaactggaacggtaaatcggtaaaactgccgccgctgaaaatgtgtatttttgccggaactaacccgttccatcgccatcagcagatcaaccgcattattgaaggctggcgcaagctggaaacggttatcgccatagataaccagtggacctcaacctgccgctttgccgatatcgtgctgcctgcgaccacgcagtttgagcgtaacgatctcgaccagtacggcaaccactccaatcgtggcatcatcgccatgaaacaggtcgtgccgccgcagttcgaggcgcgcaacgactttgatattttccgcgagctgtgccgccgctttaatcgcgaagaagcctttaccgaagggctggacgagatgggctggctgaaacgcatctggcaggaaggtgtacaacaaggcaaaggacgcggcgttcatctgccagcgtttgatgacttctggaataacaaagagtacgtcgagtttgaccatccgcagatgtttgttcgccaccaggcattccgcgaagatccggatctcgaaccgctgggcacgccgagtggcctgattgagatctactcaaaaaccatcgccgacatgaactacgacgattgtcaggggcatccgatgtggtttgagaaaatcgaacgctcccacggtgggcctggctcgcagaagtatccgttgcatctgcaatctgtgcatccggatttccgacttcactcgcagttatgtgagtcggaaactctgcgtcagcaatataccgtagcgggtaaagagccagtatttattagcccgcaggatgccagcgcgcgcggtattcgtcacggtgatgtggtacgcgtctttaacgttcgtggtcaggtgttggctggagcagtggtttctgaccgttatgcacccggcgtggcgcgaattcacgaaggggcatggtacgatccggacaaaggcggcgagccaggggcgctgtgcaaatacggtaaccccaacgtgttgaccatcgacatcggtacttcgcagctggcgcaggcgaccagtgcgcacactacgctggtggaaattgagaagtacaacggaacagtggagcaggtgacggcgtttaacggccccgtggagatggtggcgcagtgcgaatatattcccgcgtcgcaggtgaaatcatgaccacgctgacagtacaacagattgcctgtgtttacgcctggctggcgcagttgttctcccgtgaactggacgatgaacaactgacgcaaatcgccagtgcgcagatggctgaatggttttcgttgctgaaaagcgaacctccgctcactgcggcggtgaatgggctggaaaacagtattgccactctgacagtacgtgacgatgcccgtctggaactggccgctgacttttgcggcctgtttctgatgaccgacaaacaagcggcgctgccgtatgcatcggcctacaaacaggacgagcaagagattaaacgcttgttagttgaggcagggatggagaccagcggcaatttcaacgaaccggcagatcatctggcgatctatctcgagttgttgagtcatctgcatttttcgctgggagaggggaccgttcctgcgcgaagaatcgacggtttgcggcaaaaaacactgacggcgctgcgggaatggttaccagagtttgctgcgcgttgtcgacagtatgacagctttggtttttacgcggcactaagccagttattgctggtgttagtggagtgtgactaccaaaaaagataatgccgtttgtaggcctgataagacgcggcaggcgtcgcatcaggcattagtgcgcagttgccggatgcggcgagaacgccttatccggcctacgggaacagtgctttttgtgggcctgataagatgcgttaagcgtcgcatcaggcattagtgcgcagttgccggatgcggcgagaacgccttatccggcctacgggaacagtgctttttgtgggcctgataagatgcgttaagcgtcgcatcaggcattatggcgcagttgccggatgcggcgagaacgccttatccggcctacgggaacagcgctttttgtgggcctgataagacgcgttaagcgtcgcatcaggcaacaaactcacgggtgagccacaaaccgggaaagccgctggcgcagcaggcggttttcctgcttcaggtgcgcaatatcatccattaacgtcagcgccaccgcgatccccggccagtccagagccagttcatgacgcaggcgtaccgcgcgttgcaccacaatggcggcatggtcgtcaaatacccaggttgtctcctggatctcactcggttcaaccacccccaaaccgacaatttcattcaactcctcttcagagatgccggtatgcaggcaaaattcggtaatagtaaaagtcaccgtaacattagccattatgctttcccccaatctttacgtggatcaaaagacgactgggcgtctgccagttgctgccacagcgcggcagtgttttcatccggtttcggcggcatcacgattttcagtaccgcatacagatcgccggtctgttttttgctcaccagacctttgcctttaacgcgcaatcgttgcccggcctggctgccaggcgggatagtcagcaaaatgctttctttcagtgttggaacggtgactttagtacccagcgccgcttcccacgggctaaccggcaccactatttccagatcctggccgacaatatcaaacagcggatgtggcgcaatgtgaatcaccagccacaggtcgccatttggaccgccgttttcgcccggcgtcccctgacctttcaggcggatgcgttgaccattgccgacgcccgccgggatcttcacattcagcgttttcgggatttcctgttcgatcatgccaaaggcgttataaaccggcaggttatagctgatggtacgcttatgctcagtaagcgtttcttcgaggaataccgccacttcgatttcaatatcgtggccgcgtgtggcggggcgttgacggctctggcgggcatgctgaccgaaaattgacgagaagatatcgtcaaaatcttcggcgttaaaactctgaccgtcgccatgatggaactgacggttaaattgcggatcgttgcgatgttgccacatctgatcatactcagcgcgacgttgttcatcacttaacacttcccaggcttcagcgacctctttgaagcgggcttcggcatccggttctttgctgacatcaggatggtatttgcgggccagtcgacgataggcggtcttgattgtcttgagatcgtccgtcggtttcacgcccatgatggcgtaataatcctttaattccatagcgttatctcgcgtaaatcaacacaaattgaaggaacccctgtaaggtaactcctataagtgtagggtaatcctcaaaatttcatatgccaacacagaatatgttattgaaatcatcgcggaggggaggtcgcctcaaggtgggaggaacatattttatttacctcactcctgaacttttggctcatgcttacaagttaaacaataaggaaaggaatgcacaactcgactatttaaatcgttatgcaatttaatgataaagacatgtgctaaaaaccattgctattagtctcacattctttttttattggtaatggtaacgccgctgattttctttatagctactgatgtaatcattagcggcgtaaacgaggccggggctaatcaggcatagtttgcgtcaaaacttgcctgtttttaaaggggaatatagaaaaacaggcgttcaacgagccattttgcgaacctgttcccggaaaaatgacatatttctgtcacactctttaattattgataacaaaagaggtgtgaggaatgaacaaaacgctaatcgccgcaactgtggcagggatagttttactcgcttcaaatgctcaggcacaaaccgtaccggaaggctatcagctacagcaagtccttatgatgagccgtcataacttacgtgcgccgctggcgaacaatggcagtgtgctggagcagtcgacgccgaataaatggcctgaatgggacgtccccggtgggcagctcaccactaaagggggcgtgctcgaagtgtatatgggccattatatgcgtgaatggctggcagaacaggggatggtgaaatcaggggaatgcccgccaccggacaccgtttatgcctatgccaatagtctgcaacgcaccgtcgcgaccgcgcagttctttattactggcgcattccctgggtgtgatattcatgttcatcaccaggaaaaaatgggcactatggaccccacctttaacccagtgatcaccgatgattccgccgcattcagtgaacaggcggtggcggcaatggagaaagagctcagcaaactccagcttaccgacagctacaagctactggaacaaatcgttaactataaagattcccctgcctgtaaagagaagcaacaatgttcgcttgtagatggcaaaaatacctttagcgcgaagtatcaacaagaaccgggcgtttccgggccgctgaaagttggcaactcgctggtagatgcgtttactttgcaatactacgaaggttttccgatggatcaggtggcctggggagaaattaaatctgaccagcagtggaaggtgttgtcgaagctgaaaaacggttaccaggacagcctgtttacctcaccggaagtggcgcgcaatgttgcgaaaccgctggtcagttatatcgacaaagccctggtcaccgatcgcaccagtgcaccgaaaatcacggtattagttgggcacgactccaacattgcctctctgttaacggcgctggatttcaaaccgtatcagttgcatgaccagaacgaacgcacgccgattggcggcaaaatcgttttccagcgttggcatgacagcaaagccaatcgcgacctgatgaaaattgaatatgtgtaccagagtgcggaacagttacgtaatgccgatgcgttaaccctgcaggcacctgcgcagcgcgtgacgctggaattaagcggttgcccgatagatgccaacggtttttgcccaatggataagtttgatagcgtattgaatgaagcggtgaaataacagaaaactcccccgcgtgaagcgggggagtcgctggttaaacgtttttacgttcgatggtctgttcgccccaaaaaagcgaatctttatcggtcttagcaaaggctttgactaacacttcatcgctaccttcttcccaaatcttttccgccattttttcgtcgtacccggcgacttcgaaaatggcctcggctatttccggcgacgtattgcgcagagatgcccattcaccgacgtgatgagctttcgcttcttgagttggcatgcgtatcctcctgttgaagattagccgttaagtttaactgccagacctgcgacatattccccttgataacgagcaatagacagttcttcctggctgggctggcgtgaaccgtcaccgcctgcgatggtggttgcgccgtacggcgtaccgccgcgaacctgtgaaacgtcaaataattcctgcgctgcgtagccaatggggacaatcaccatgccgtgatgcgcaagggtcgtccaggtggatgtgatggtttgttcctgaccgccgccagtaccggtggaactaaagacgctcgccagttttccgtatagtgcgccggaagcccacaggccgcccgtctggtcgaggaaggtacgcatttgaccggacatgttaccaaagcgggtaggtgtaccaaaaataatggcgtcgtaatcggccagttcttgcggggttgcaaccggtgcagtttgcgttttaccgcctgctttttcaaataattgcggcggcatggtttccggtacacgcttaacgacaacttctgcgccatccactttgcttgcaccctcagcaactgcgcgtgccatcgtttcaatatgtccgtacatggaataataaagcaccagaactttagccatttctaaccactcctcgtgttatctctattccgtagcgattcgctaccacttatttaaagataagacgtccttttcagagtgcaaatttcacaaccacttatttgatttataacaactttcacaagcacgtaattttgtcgcaaaatgacacatttttatctcatcgcgtttttttaatcataagagcggcttatggataattattggagatgatatctattctcgctaagaagctgttgcaggatattaccaaacgcgggtctgcccgcgtcagttcactaagcttagtcccacgtagcgaaaatatggcagccgccatacgccgcgttaattctatgcaatatgatgtctatacccagacggaggtcagtaatggcaaaccatcgaggcggttccggcaattttgcagaagaccgcgaaagagcatcagaagcaggtaaaaaaggtggacagcacagcgggggtaatttcaaaaatgacccgcagcgcgcatctgaagcaggtaaaaaaggtggcaagagcagtcacggtaaaagcgacaactagccgggctaatcaatgacgcatgcatttttgtctgtagctcgtcaaaaagccatcaccgccggttaccccggcggttttctgtttatggcttctgatgaacaacttctggcggtggaacgtcaaccaaccttctgcttaacaacgcattgagtaaaatcgcgccaaaagttgctgtaccgatccctcccaacgtaaaaccgcccagcgtgagagcaaaatcacccgcacccagcactaaggttactgcgaccataatcaaattaccgttctggcttaaatccacactgttttgtacccagatccgtgcgcctgcgacggcaatcagcccgaacacaacaattgatgcaccaccaatcaccgcggccggaatagtatggatcagcgcgccaaatttcggcgaaaagcccaacagcatggcgatgacggcagcggcaacaaacaccagcgtcgagtagacttttgtcacggccatcacaccaatattctcggcgtaggtggttacgccgctaccgccgacagagccagaaagcatcgtcgccagcccatcgcctacgaatgcccgccccatatacgggtccatattgcgtccggtcatcccggcgaccgccttgagatgacctaagttttccgccaccagaatcaccgccacgggcgcaatcagcatcattgcctgaccattaaaagcaggagtggaaaaatgtggcagaccgaaccaggcagcatggctgacgagagtaaaatcgacggcttttcccagccctaaaacgttggtcatcacgccatccagctatcaaaggccgaagccgatacatttttcactgcgataggcgctaagttcaggccaatcgccatcactaccgcacccgtcacaaccggcggcattagtcgttcaatccagcgcgtaccgattttcatcaccaccaggccaatgacggtataaaccagcccacaggcgataatcccgcccagcgcgatgctgatattcggattaattccctgaccattaaagcccgtcgcggcaatcaccacgccgacaaaagccgcgctggaaccgagataactgggcacgcgcccgccggtaataaagaaaaacagtaacgtgccgatccccgacattaaaatggaaagattgggatccagccccatcagaattggcattaacaccgtcgcgccaaacatcgccaccgcgtgttgaacgcccattactgccgtttgagcaaacggcaatcgttcatccggcgcgaccacgccgctctctgtagaggtcgattttaactgccagtgaggaaaaccgaacattgccatcagctgtctccttaaggaggttaacaagcagggcgcatcagcgcgtgataactgcgatcgaaccacaccagcccgtagggtgtggcgtgacgatgaatcgcttcgatggcgcaaaacaaaatgtcgtgggtgccgacgctcaccacctggctgatacggcagtcaaacgaaaccagtgcctcttccagttgcgggcatccggtcacaccagtctgccagcgggcggcggcaaagcggagttccatgggcgttttgccgccaaaaaggtttgaaagcggctcctgcccggcgctaagtgtatttacacacagcgttcgattttcattgaataccggccagacggacgccccacgattcaggcacaccagtaatgtgggcggcgtgtcagtcacgctgcagacggcgctggcggtgaacccggcgcgcccggctggaccgtcagtagtgatgatattgaccgccgcgcccatacaggacatcgcatcgcgaaaggtttgttgatcgacaatgttcattgtttgctccttacaacagcccgcaggcttcttcaaaggacagacgtggcaggcgcgcaaaaagtttgctggaatcgccatagccgatattaatcagcagattgctcttcagcgtgctgcccgcaaaaaaggcgtcgtcaacgtattgacggtcaaagcccgacatcgggccggtatccagccccagcgcacggcaggcgaagatcagataggccgcctgcatggaactgttgcgaaacgctgtttcttcggcaagttgtgggctggaggtaaaccaactgcgggcatcgccgtgaggaaacagctgtggtaaccgttcataaaattcactgtcccaggcgacgatagcggtgacgggcgcggtcagggttttttgcagattgccgctggaaagcgccgggcgcagacgttcttttccttctgcagtgcggataaacacgatccgtgccggagaacagttagcagatgtcggcccccatttcatcagggcataaatctcccgtaacgtctcatcgctgacgggtgtctcccgccagccgttgtgagtgcgggcatcggtgaacagggtgctaagcgcacctgggctaacggcttcgttcatagcaattccttacagagcggcttcacggtgatgtaacaggctggcaagcccgttgagtaacagagcattaaacgtttcgggatcggtcacgttgcaggcgtgtccgccatagcgcatcaccattttctggctatcgggcagggcggcgtgaagttcactggaacatgctgttggcaccagcagatcatcactggcgcagatgatttgcaccgggcagcggatacgatccgcatggtgactaaagtcagcgcgtttgagggcgttaagtcgacgcagtaaattatttttgccttgaaaatgcgccagtgccagcgcatcttctgcctcaaggcgaggtgcgcgggccgccatccagtcggcgggatagaggaacaacggctgcgcttccacccatgcctgcgcgccgccgctatgtagtaactgttcgcgaacctgaaaacagcggcgcgtatgggcgtttattcgtagccagccgttaacgctgaccagcacagttaccgacgcgggataatccagcgccagctgcattcccaccagcgcaccgagcgcatggccgaccaccgcgtaacgctcaatccctgcggctaccagcgcctgatgcagttccgctgccatctgggcgatactgtaatcttctgccagcgtgtcgggattattgccggtgccgcgctggtcgtaacagactacctgatactcctgaaccagcaccgccagttgcggtaaccagtaactgccgctaccgccaagacccgaaatcaacaccactacgggcgcatcagcataagggggaggtgagagtgaaagtttcatcgcggcctcacttggcgatatgcgcaattgtggcgatttccactagcgcgtcaggttttaccagtccgcactgaatgcagaatcgcgccggtttgtcacccgggaaaaattcggcgtagatttcgttaatcgcggcgtaatttttccagtcggtaataaagatgctgttgaaagtcacatccgccattgtgccacccgccgtctcgatgaccttgcggatggtttccagaacgtggcgggtttgcgcctttgggtcatcggcaaacagcacgttgttatgttgatcaaaagccagcgtaccggagacatacaccacgccatcagccagcgtgccgggaacgaagggggccagcggtgcgctgctgccagcaggaataattacggattttggcatcgttaaactccttaagcgatacgagcaaaggacgtggaagaaagcgcgtcgcagaacgtttcgacgtcgctgacccagccaaaaaaggtttcgatattgaacaacgcggctttctgtgcaaattccggccccgcctggtgtgttgcgtcttccagcaccacgccgaaatactccagaaaaaagccgtcgcgtagcgtcgattctacgcagacgttggtagcgatgccggtgaaaaccagatggcgtattccgcggctgcgcaaaatgctgtccagcggcgtattgaagaaaccgctgtagcgcggcttcggcagcactatatcgccaggctgcggcaccagctcatccaccagttgataatcccaggagcctttcgccagcaatttcccctgcagcagcggctgattacgcatggttttcagggcgttcgatttatgataattcggtgagccggggccgccagcctcgacatactgttcatcccagccattttgaaaccagatgatcagcatccctgccgttcgcgctgcggtcacggcggtttgaatgttggcaatgaccgggcgagtggttgagacatcaaacccggcgagatctaagtagccgcctggcgtggcataggcattttgcatatccaccacgatcagcgcagtttgctgcggatcgaaggtaatggcttccggtcgtgcggttaaggtcgtcatcatgccacctcctgagtcagcgcagggagatgggcgcggcactgcatcagtggttgaatgcgctcgccgaagttttcgattcccgacagaaaatcatcgaaggtcaacagcacgccttcggcaccaggcacgcttgcgacttcatctaacatgcgcgcgacactggcgtaagaaccgactaacgtccccatattgatgtttaccgccgaagtgggatcggccatctgacggacgttggtgtcagtacctgagcgggtatctttctgactttgttcagttagccagcttaacgcctcttcatccgcgcccgctttgtagtgttcccattttgcacgagcggcatcgtcggtttcgtcggcaatcaccataaacaacacataagagccaacgtcgcgtccggtttgctctgcggcctgtttcatccgcgcagcggtcggggcgaaagccgtgggtgtatttacgcctttgccgaaacagaagttaaaatcggcataccgggcggagaacgccatgccagcgtcgctttgcccggcgcagatcactttcatggggacactcggttgcggactgacgcgacaatcatccatagtgaaaaaatcgcctttaaaatcgcttttccccgagccccacaggtcgcgcagcacctgaacatattcggtgagatagtcgtaacgacgggagaaatagtcatcgccaggccagatccccatctgctcatactcgggcttctgccagccagtcacgaggttgacgccaaaacgcccgccagagatggagtcgatggttgcggccatacgggcgacgattgccggaggtaacgttaaggtggcagctgtcgcgtatatctgaatgcgtgaggtgacggctgccagccccgccatcaaggtgaacgactcaaggttgtgatcccagaactcagttttgccgccaaagccacgcagtttgatcatcgacagggcgaaatcgaaatggtagtgctccgctttttgcacaatggctttattcagttcaaatgtcggcatgtactgcggcgcgtgggtcgaaatgagccagccgttgttgccaataggtacgaatacgccaattttcatcatcaacctctcttcgtctcgtaaagtgaaagtcagacggggcgctgcatcctgcatatccttttcagccgcgtaatggcttgtttgcaaagcggatgccagtttttaaaaagtgaatgttattaatgtgttaatgttaagttgtctaaaatgcctgaaaaaagtggactaaacggtcaaaacagttgcacataaaacatgcattcgtgcgcgatgagagtgcataaggtcgaggccgggcgggggttttgctatcctgttgccaatcaacaagaggggagagcgcatgacgcaaggcgcagtgaaaacaacgggtaagcgttcgcgcgcagtaagcgcgaagaaaaaagcgattcttagcgcagcactggacactttttcacaattcggttttcacggcacaaggctggagcagatcgcggaattggcgggtgtttcaaaaaccaatctgctgtattactttccgtcaaaagaggcgctgtatatagccgtactgcggcagattctcgatatctggctggcaccgttaaaagcgtttcgagaagatttcgccccgctggcggcgatcaaagaatacatccgtctgaagctggaagtttcccgcgattatccgcaggcttcgcgcctgttctgtatggagatgctggcaggtgcaccgctgttaatggatgaactgacgggcgatttgaaggcattaattgatgagaaatcggcgctcattgccggttgggttaaaagcggcaaactcgcgccgattgacccgcagcatttgatttttatgatttgggcttccactcaacattacgccgattttgcccctcaggtggaggcggtgacaggcgtgacgttgcgcgatgaggtgtttttcaatcaaacggttgaaaacgtgcagcggattattattgaggggattcgaccacgttaaagatgccggaggaggttgtaacatcctccggctacctgtttaaccgatcgtcattaaactggcgttaccgccagcagcagcggtattcacactcagcgaacgctcgatatacagccgttccagaaggatattgctttcgccacgggcaaaaccctgcaccgaaacaattgcaccatcccgcgcggcaacggcttcacacaatgcgcgaagctgatccgaatcaccgtggaagatcaccgcatcaaagggttgagcggttatattttccgctttcgccagttgaatacgttcgctgactgccgatggcaatgccttcactaactgacgatgcagcgcatcatccggccacagcatctggctacccaccgccagcacggcggcgagctgagtcagcgcatcctgttcatcatccgcaatacacaacacgcgctcacgcggcagcagcgtccaggtgttgcgttcacccgtcggccctggcaacaatcgttgtgttcctgcctgcgccaactcgccatattgcgtacataacgcctgcaattctggacggtttgccgcccattcccgcagtgcatttagcggctgagtcaatgcggctttcaactgcgcatcgaccggatactccgcatcctgacgcgcgagcgtcaccgccagcgcactttccgggcgattcgccagcagacggtagagatagagcggaccgcctgctttcggcccggtaccggacaacccttcgccgccgaacggttgcaccccaaccaccgcgcccaccatattacggttaacgtacagattaccgacctgcgccgagccagtgacctgggcaatggtttcatcaatacgcgtatgaacgccaagcgtcagaccatagccggaagcgttaatctgctcgatcagctctgggagctggttacggttgtaacgcaccacatgcagcaccggaccaaagacctctttttgtaattcggcaaagtcatccagttcgatcagcgtcggagcgacaaaggtgccgctttgccattcacgggcatcttcgctgttttcccgcaccgcctggaacacctgacggcctttactacgcatggtctgaatatgacgctcgatattggctttcgcttcgctatcaatcaccggaccgatatcggtggtcaggcgacccggattacccatccggcattcggccattgcgccgcgcagcattttcagcgtgtggtcggcaatctcatcttgcaggcacagcacgcgcagtgccgaacaacgctgacctgcactgtcgaacgccgaggccagcacatctattacgacttgttcggtcagtgctgaagaatcgacaatcatcgcgttcatgccgccggtttcagcgatgagcggaatagggcgaccctgagcgtccaggcggctggcgatattgcgctgcagtaacgtagcgacttcggttgaaccggtaaacatcaccccgcgcacgcgatcatcacccgtcagttgcgcgcccacggtttcaccccgacctggcagcaattgcaccacgcctggcggtacacccgcttccagcaaaatggcgatcccttgcgcggcaatcagcggcgtttgttctgccggttttgccagcacgctgttacctgccgccagtgcggcagcgatctgcccggtgaaaatagccagcgggaagttccacggactgatacataccacaggccctaatggacggtgggtttcgttagcgaaatcatcccgcacctgtccggcatagtagtggagaaaatcgaccgcttcgcgcacttcagcaatggcgttactgaaggtttttccggcttcacgcaccagaataccaatcagttgctgcatctggctttccattagcacggcagcgcgatgcaaaatcgccgcgcgttcagccggaggagtggcaaaccagattggcgcgttattaaccgcactttccagcgcctgttctacttcacgcggcgtggcttcacgcacatagcccacaatatctttcggttccgcagggttaataacgggcgacatctcaccagccgcgaccgattgttccagcattggcaaggactgccatttttgcagtgcactattgagcagggctgaagagagcgaggccagacggtgttcgttagcgagatccagccctgccgagttgtcgcgcccgtgaccgtaaagatcgcgcggcaggggaattttcggatgcggtaatccagtttgcccttcctgttgcgccagtttttctacagcagtgactggatcggcgaccagttcatccagtggcaaagaggtgtcggcaatacggttaacaaacgaggtgttagcaccgttttccagcaggcggcgcaccagatatgccagcagcgtttcatgtgtaccgaccggagcataaatacgacacggacggttaagtttgccgtcggcaactttcccggtgacctgctcatacagtggctcgcccataccatgcaggcactggaactcgtactgacctgggtagtagttttgacccgccagttgataaattgccgccagcgtatgggcgttgtgcgtcgcgaactgcgggtagattagatttggcaccgccagcagctttttcgcacaggcaagataagaaacgtcggtatacaccttgcgggtataaaccggataaccttcaaggccgtccatctgtgcacgcttgatttcactatcccagtacgcgcctttcaccaggcgaatcatcagacggcgacggcttcgggtggcgagatcaatcaggtaatcgatcaccaacgggcagcgtttttgataagcctgaataacaaaaccgatgccgttccagcctgccagttcaggctcgaaacagagtttttccagcagatcgagggagatctccaggcgatcggcctcttcggcatcgatgttaataccaatatcgtactgacgcgccagcagggtgagtgatttcagacgcgggtaaagctcttccattacccggtcatactgggcgcggctataacgcggatgtagcgccgacagcttgattgaaatgcccggaccttcatagatgccacgaccgttagacgctttaccaatggcgtgaatcgcctgctgataggaaaccatatacgcttgtgcatctgcggcagtcagtgcggcttcgcccagcatatcgtaagagtaacggaaacctttctcttccagtttgcgggcattggctaacgcttccgcgatggtttcgcccgtgacgaactgctcgcccatcaggcgcatcgccatatccacacctttgcggatcagcggttcaccgctcttaccgataatgcggttcagcgagcgggagaggctggcttcgttatgggtggaaaccagtttgccggtaaacagcagcccccaggtagcggcattaacaaacagggacgggctacgaccaatgtgtgactgccagttaccgttactgattttgtcgcgaattaacgcgtcacgggtggctttgtcgggaatacgcaacaacgcttccgccagacacatcagcgccacgccttcctgcgatgacaacgaaaactcctgcaataacccctgaaccatacctgcgcgaccactggcgtttttttgattacgcagtttatcggccagttgatacgccagtttgtgcgcctgttcagcaactggctgcggcaggcgagcttgttccagcagcatagaaaccgcttcggtttccgggcggcgataggccgcggtgatcgcggcgcgggaaaccgactggggcaatatttgctcggcaaagtcgaggaaaggctggtgtggttcctctgccggagtcggtgcttcatcgctctcattggccgcgccagaaagcagcgcaggtagctccgggagagtatcgctgttttccagttgttcaagataagaaaaaatcgcctgtttaattaaccagtgtggtgtgcgatcgatacgtgtcgcggcagacttaatacgctcacgcgtcgcgtcgtccagcttaacccccatggtggtggttcccatgccattactcctgttgttctgaaaggtgcaacttaacgttatcgtgaaatatctatgatgttgcaactttgtgcaaccgtgttaaatgtgacctgcgtagcaagcttaaaaatgaatgaaatgttaataaacgaaatcgatatgacagggattaaaaaaataactcagactttttctctgcggcagttaacatttttgaaaggtgcaaccgcaaaaaatgtgagagagtgcaacctgatgaaaaatagtgtcgctgagcactaaaatttaatgtaaatggtgtgttaaatcgattgtgaataaccagcgcttccggcaggatacggtcgccctggtaaaacataaactctgttaccccgttccggtggcagatataacggcaagtttcgacattgccgataataattttttggagactttagatggctattagcacaccgatgttggtgacattttgtgtctatatctttggcatgatattgattgggtttatcgcctggcgatcaacgaaaaacttcgacgactatattctgggcggtcgtagtcttgggccattcgtgacggcattatcggcgggtgcgtcggatatgagcggctggctgttaatggggttgccaggcgctgtttttctttccgggatttccgaaagctggatcgccattggtctgacattaggcgcgtggatcaactggaagctggtggccgggcggttgcgtgtgcataccgaatacaacaataacgccttaacattgccggattatttcaccgggcgctttgaagataaaagccgcattttgcgcattatctccgcgctggttattttgctgttcttcaccatttattgcgcttcaggcattgtggcaggcgcgcgtctgtttgaaagtacctttggcatgagctacgaaacggctctgtgggcgggggctgcggcgacgatcctttacacctttattggcggtttcctcgcggtgagctggactgacactgtacaggccagtctgatgattttttccctgatcctgacgccagttatcgtcattatcagtgtcggtggctttggtgactcgctggaagtaatcaaacaaaagagcattgaaaacgtggatatgctcaaagggttgaattttgtcgccattatctcgctgatgggttgggggctgggttacttcgggcagccgcacatcctggcgcgttttatggcggcagattctcaccacagcattgtccatgcgcgtcgtattagtatgacctggatgatcctctgcctggcaggggcggtggctgtcggcttctttggtatcgcttactttaacgagcacccggcggtagcaggtgcggtaaaccagaacgccgagcgcgtgtttattgaactggcacaaattctgtttaacccgtggattgccgggattttgctgtcggcgattctggcggcggtaatgtcaacgttaagttgccagctgctggtatgttccagtgcgattaccgaagatttatacaaagcgtttctgcgtaaacaggccagccagaaagagctggtgtgggtagggcgagtgatggtgctggtggtggcgctggtggcgattgcgctggcggcaaacccggaaaaccgcgtgctgggcttagtgagctacgcgtgggcaggctttggcgcagcgtttggtccggtggtgctgttctcggtgatgtggtcacgcatgacgcgcaacggtgcgctggcggggatgatcatcggtgcgctgacggttatcgtctggaaacagttcggctggctgggtctgtacgaaattattccgggctttatcttcggcagtatcgggattgtagtgtttagtttgctgggtaaagcgccatcagcggcgatgcaaaaacgctttgccgaggccgatgcgcactatcattcggctccgccgtcacggttgcaggaagggtaagggaaggcgttttaccgaaaatttcacgtcataaccggaagcaggcagagggcaatcagttattgccctctgcgttttttctcaaaatatttttacatcttctcatcattatcactacattccacttgtatttttcttcatcgtaatgataatcgctatcactgcgatttacttttctttgcatagattgactcagaaaaacgtttaagggtgggtggcatgtttgttccgtttctcattatgttgcgcgaaggacttgaagccgcgctgattgtcagtttgattgccagctatcttaagcgtacccagcgaggccgatggattggtgtaatgtggattggcgtgttgcttgccgctgcgttgtgtctgggcttgggtatcttcattaacgaaaccaccggcgaatttccgcaaaaagaacaggaactgtttgaaggcattgtggcggtgatcgccgtggtgatccttacctggatggttttctggatgcgcaaagtgtcgcgcaacgtcaaagtacaactggagcaggcggtcgatagcgcattgcagcgtggaaatcatcatggctgggcgctggtgatgatggtcttttttgccgttgcaagggaagggctggagtcggtctttttcctgctggcggcatttcaacaagatgtcgggatctggccgccgctgggtgcaatgcttggtcttgctacagccgtggtgcttggcttcctgctctactggggcggtattcgcctcaatcttggtgcattttttaaatggaccagtctgtttattctcttcgtcgccgcagggctggcagctggtgccattcgcgcatttcatgaagccggattgtggaaccactttcaggaaatcgccttcgatatgagcgcggtgctctcaactcactcgctgtttggcacactgatggaagggatttttggctatcaggaagcaccgagcgtcagcgaagtcgccgtctggtttatttatctcatcccggcgctggtggcatttgttctgccaccacgcgcaggggcgactgcgtcccgctccgtgtagcaaatacgacgcaaactcttgcttagttacaacatactttaaagggatagtctcgtcatgaccattaacttccgccgtaacgcattgcagttgagcgtggctgcgctgttctcttctgcttttatggctaacgccgctgatattccgcaagtcaaagtgaccgtgacggataagcagtgcgagccgatgaccattacggttaacgccgggaaaacacagttcattattcagaaccacagccagaaggcgctggagtgggagatcctcaaaggcgtgatggtggtggaagagcgggaaaatatcgcccctggttttagccagaaaatgacggcgaatttacagcctggcgaatacgatatgacctgcggtctgctgactaacccgaaagggaagttgatcgtcaaaggtgaagcaacggcggatgcggcgcaaagtgatgcgctgttaagtcttggtggtgcaattactgcatataaagcgtatgtcatggcggaaaccacgcaactggtgaccgacaccaaagcctttaccgacgctattaaagcaggcgatatcgaaaaagcgaaagcactgtatgcgccgacgcgccagcactatgagcgcattgaaccgattgctgaactgttctccgatctggatggcagcattgacgcccgtgaagatgattacgagcaaaaagccgccgatccaaaattcaccggtttccaccgtctggaaaaagcattgtttggcgataacaccaccaaagggatggataagtatgctgaccagctttataccgatgtggtcgatttgcaaaaacgcatcagtgaactggctttccctccttcaaaagtggtcggcggtgcagccggactgattgaggaagtggcggccagcaaaatcagcggtgaagaagatcgctacagccacaccgatctgtgggatttccaggctaacgttgaaggctcgcagaaaattgtcgatctgctgcgtccacaactacaaaaagcgaatccggaactgctggcaaaagtcgatgccaacttcaaaaaggtcgataccattctggcgaaataccgtactaaagacggttttgaaaattacgacaaactgaccgatgctgaccggaatgcactgaaaggaccgattactgcgctggcggaagatctggcgcaacttcgcggtgtgctggggctggactaagcgttatgcagtatgaagatgaaaacggcgtgaatgaaccgtcacgccgacgtttactgaaagggattggtgcgctggcgctggcgggaagttgtccggtcgctcatgcacaaaaaacgcaaagtgcgccgggtacgctttcaccggatgcacgcaatgagaaacagccgttttatggtgagcatcaggcagggatcctgacaccacaacaggctgcaatgatgctggtggcgtttgatgtgcttgccagcgataaagccgatcttgaacggttgtttcgcttgttgactcagcgttttgcttttctgactcagggcggagcggcaccagaaacgccaaatccgcgcctgccaccactcgattccggcattcttggcggctacattgcgcccgataatctcaccatcacgttatcggtgggtcactcattgtttgatgagcgctttggccttgcgccacagatgccaaaaaagttgcagaagatgacgcgtttccctaacgactcgctggatgcggcgttatgtcatggtgatgtgttgctacaaatttgcgccaacacccaggacacggtgatccatgtgctgcgcgatatcatcaaacacacgccggatttgctcagcgtgcgctggaagcgggaagggtttatttccgaccacgcagcgcgtagtaaaggcaaagagacgccgataaatttgctgggctttaaagacggcaccgccaatcccgatagccagaatgataagttgatgcaaaaagtggtgtgggtgacggcagatcagcaggagcctgcgtggacaatcggtggcagctatcaggcagtacgcttgattcagtttcgagtggaattttgggacagaacgccgctgaaagagcagcagacgatatttggtcgtgataagcaaaccggtgcgccgctgggcatgctgcatgagcatgatgttcccgattacgctagcgatccggaagggaaggtgattgcgctggacagccatatccggctggcgaatccccgcacggcggagagcgagtccagcctgatgctgcgtcgtggctacagttattcgttgggcgtcaccaattccgggcaactcgatatggggctactgtttgtctgctaccaacacgatctggaaaagggcttcctgacagtacaaaaaaggttgaatggcgaggcgctggaggaatatgtcaaacctatcggtggcggctatttctttgcgctgccgggtgtgaaggacgcgaacgattatctcggaagcgcattattgcgggtttaatgtttttaggcggataaggcgtttacgccgcaccaggcgttcgtacactgatgcgacgcttgcgcgtcttatcatgcctacaatcggtgcgggtcggtaggccggataaggcgttcacgccgcatccggcaagcttttaccagtactgcgaatcctgctgaaagcacacagcttctttcatcactgtcatcactctgtcatctttccagtagaaactaatgtcactgaaatggtgttttatagttaaatataagtgaatatattgttgcaatgaatgcgagatctgttgtaattattaagtagcagcggaagttcccggcagtgatagtcagtcactatggagatcgcggatggtaacgtcctgttctggacaatgttttgttaagcaacgctccaccacttgcggagatttctcctccggtagcaacttcgtcactctgtatttttctcacttcctctctttactcgtgttaccgacgccgcaaacggtgtgcgtagccgtttttcggcattttatccaaaagcaaactatggcttacaaggaagccaaccctctgatgttcgtgcgcataatcgcgctgccaacggcgcgtgtgatgaatacaaacaactcaaggtgctctccatgggaagacaaaaagcagtgatcaaagctcgtcgcgaggcaaaacgtgtgctgagacgggattcgcgcagccataagcagcgtgaagaagaatcggtcacctcgcttgtgcagatgagcggcgtagaagccattggtatggcccgcgacagtcgcgatacctcgcccatcctcgcgcgaaatgaagcgcaattgcactatctgaaggctattgagagtaagcagctgatattcgccacgggcgaagccgggtgcggaaaaacctggatcagcgcagcaaaagcggcagaggccctgatacataaggatgtcgacaggattatcgtcacccgtccagttctgcaagccgatgaagatcttggcttcttacctggagatatcgcagaaaagtttgctccctattttcgtccggtctacgacgtgctggtccggcgcttaggggcttcctttatgcagtactgcctgcgaccggaaatagggaaggtggaaattgcgccgttcgcctatatgcgtggacgtacctttgaaaatgcagtcgtcattcttgacgaggcgcagaatgtgactgccgcgcaaatgaaaatgtttttaacccgcctcggggagaacgtgacggttatcgtcaacggtgatatcacgcaatgcgatttgcctcgcggcgtgcgctccggattaagtgacgcgctggaacgtttcgaagaagatgaaatggtcgggatcgtccgattcggtaaagaggattgcgtacgttcggcactttgccaacgtacgctacatgcatacagttaagtgtattatcggcgcagagcccgggcgaaccgggctttgttttgggtgtttacgcccggactagcgctttttctgaaaccaccatttttatttgcccctggctggtgaagtgtacgctcatcctgtggcttttttgtagttgctgatagagctcatcaggtattgctaagctctcagcatattcttgcggcgtatattggtaggctgcatgatgctgctgtttttgaaaacgtagcttattgtacagcgcccagacaattaacacgacggcattcgccactgccagcaaaaaatagaactgaagtcggcttctggcctcgctttgccagtaataacccgtcagcagatccattgcgaataagaatatgaacaaagcaaataatgtccataagatggttgtggcaacataatcaaccattaaacgtactggcgattgtcgggtcgtaataattaaattgttcatattaacctctcagaatcccgcgatcgggacttacccaacgggcgcgttgctttttaggcatcaacatgactcgtgtaaatgataccaatgtcgttgccagactcagcatccagaaaataaccgggaaccaaataatccagaaaagcgatgaagtcagattatgctcatagcgattctcgatcatcaggctgacaataaattgcagtaaacataacgtacacaataatattccggcagtatgtgtcgcagcgatatgtgtcaattcaatatttaacggtacaccggcaagttggactgcgtaaataatgaaaccgaccaggcaagtgaaggcccatattgtcgtcaggcagtattcaaaaaacagcggccacattcgaaagttttctttgcgccacaaccttgtcatatttttgaggaatacttctgcaccgccctgagcccagcgcaggcgctgtttccacagcccttttaacgtttcaggcattaatatccagcacagcgcccgtggctcgtaaaaaatcgcccactgattcaactgcagcttccagctaatatcaatatcttcggtgatcatatcgtcactccagtaacccacttctgccagggcgctgcgacgaaatgcggcaataacaccggaaacggtaaatacgtttccatagatacgctgggttcgcttgatcaaaccaataattgaggaatactcgccaacctgaattttacccaccagggtagaacgtgttcgaatacgaggattaccggttacggcacccacacgcgggttgtacaacatcggttccacaatatatgccgccgcatcgcggtctaataacgcatcgccatcaatgcacaccagatattcacttttcgccgcggcagctccggttttaagcgcaatggctttcccctggttttgcgccagatgaatgacccgcaggtggggaatttgtgcagccatgcgatccaggatggcacgggttttgtctgttgaaccgtcatttacggcaataacttcaatgttctcataacgctgtgctaaagcggcgtgtatggtttcctcaacgtttttctcctcattaaaacagggaatgataatggagatagacggattatctttcaactggggggctggtgcgttttctccccacggccagtggcgttcacgatagacccagaaatagacgccgccaacaatccacataatagacataaaaaacggccagaagaaaacgaacctcatcatcagttcaccagagtgaaagtacgctacgcatagggggatgcataacaccagacataatataaaaaacgatacgatgcgattaatcatttttcggataccaggctgttgaaaactcaggacgaataacgtctatttcaggttggttatgcagaaaattgtcgggataataaccatagtttttccctccattcagttgtaataggctcatccagtgagcgagttgttgcgaagaaatagcctgatgctgaccatttttctgccagttttgtgcctgtaattctaaaatagatttgtctttagcctgagggatgtttttaatttgattggtcaattgtattaaccattggtcagccgatttttctgcgacaccttccatataaggcatagccataatagcggtccagtcatagctttttaggaaatcagcataattctgtgcaaaccacgcttcactttcaggttgtattaccggaagtgcaaaaatatttcgtgcagttataacatgtggaccgcgaatggcttttacgcgcgcactaagttctaaagtgaagtcagttaacgcacgacttttaaagcgggtccactgtttaaattgctccgggttttgtcgaatttcgctcagactcccgctaaagcctgcttgctgataagccgtgatagccggtgcactggcatcttcataatctgaaagcaaagcatcatcgtggaacaatatgccatcaaaagcagcatgtccggcaagatcttcatataacatgccaacttgtgctctgactctgtcatcgaaaggagagagacggcgatattgttcaggatgaatttgtgcttttttctccccagtcggtaagtattttactcgcgttaatgtgggatctaaatcccagcttaataccggcatccacgcatagatgtttacacctgagcgggtacgtaattgccaggcaacccgactaaaaatatctgctttcattggtagcaaacgatttggaaaccagacctctttgaccagcccatcaccatcgggatcagcaaatgcctgcaaatacacggttgatatttgcatatctttcacccgctgaattagcacatcaatattgcgatccatttgctggtggttttcgtcataaacgtaatcaagatcgatatgcattatccgttgtggtgatttttcctgtacggtaataatttgctgggcaaactcttttaatgagggattattggcgattaatactcgcggaatggaatccaattgtgacgcatttgccaaacctgattcaagggtgaagaacatgtcataaccgagtttttttaattcctctatcgctatgccattcgcttcgccataaggccaaacaaaaacgtgtggatttaccttagcctttgtacgcaggtattccgtcatttttacagcatccagacgaattctttcccggtattctgctgcggtttcataccgtgcgtggtcagtaaaatatgcacgatttacatatacaggcaataagctgccggtggcattagcctgaataccgtagtgagaattccatgtatgagaagcgacctcaacgagccgggaacgcgcaacttctcgcacttgttgccacgtggcaaaatattctcgatcgaccatctcatcgccaaattttacttgttcatccgctggcgtatcgacccaactgccgacgggggcccatacagcaggccactggaaggcctgaagaattgggaagacgcgggtataaaaactctggtagccgtcatcaaaagtcagcactactgctttttccggtagcggttttcctcctcgatgtgcttcacgaatttgagcaatactgaccggttgataaccgttctcgcgcagccaggcaaattgttcacgcagtgctgatgtccgcactgacataaaacgctggtcggcagcttcgtcttcaacgttatgccatgaaatcgccacaaaaccattatgcggccacggttgctcggcgagtaaagattcgcgatcctgtggcggtataaatgatgttcttgactggctaatgcacgcagtgagcataattatactcaccagcatcaggatatatttatttccattacgtaacatatttatccttaaaatctgaatgtcatatcgaattcaacgtataagttgtgttctctgtcaccgtcataaggtcgtttttcccagcgtagcgttgcgccagcatcaatcacgtcattccagctaatacgttgcccgtagccgagttgggtgacgacatccgtgccataatgtttttgccaggaggcaccaacacctgcgctgaagatttgctcccagctattttcatagcttcgccataacaaatgacttgcctcaaatgccggaacaatatcgaacgtttttatagggttgtagtatggagtgtcgtgttctgtattttgttcgtaatacagattgggtaggaaatcgacaatcaaatatggtgaagaccagatgcgttcctgaccctcaagtgagacttcctgacgctggttactgtcggaaaaatcagtgaaagcccaggagacaccgtacttacgccgctcattttgataccagcgaacataagcctgagcactgttgcctgtaacaccatttttcattgcccgtaatggaacgcggtgagagaggcgttccagttgcgaaccaatacgccagttatcattaaaatcataccagccagacaggcgcgcgccgggtttatgctcatgattgaaaacgcgttcagcgtactccgcctcgagccagatattacgtgaccgccactcaacacccgccagccagtcgcgaacaatcccttttccttcgctaaattgtccatcggcataaccgaatccagcaaaaccgcgccagttatccttcagcggtggtgaataaacgatggtggttaagtcgacatcatgtttaccactatccgggccttcggcatcaattcctgttgaaccagctatacgaagctctgcaagattatgtacatcaaccgcacgttttaaacgtacaacgccgggatcttgcggttcacgttcgacaacatcgtgcgttaagacagctgcctgctgccattcttgtaacgttaatgctgtccatgcttgttcaacctccagattaatattacgtggctcgatcacttctgctttttttaattcattttctgctgcacgatgccaaccgcgggcttgtaacacactcgcgtaatcaatgcgcagtccctgatttcctggtgcgttataagcaagctctctggctatcatttcagcctgaggaagatcattactatattttgctacggttgagagaaacgaatgcccctgtaaccaggtatcattcgggatgctcgtaggcgtgcccattaaccgaaggaaaggcggcgaagtattaatggtatgttgggtgacagttagcgcgccgggataattttcactctccaggtggctgtaaaagagatccgcaagttcttcatcggataaatccggggcaatggtctccttgtgataaaagagctctgtcattattgactgtgctttttttggctgctgttctttgagataagccgacgcaacccaatattgcgcccagggcggaataatttgcctcgtattttttaaacgctgatagtgagaaataacgtctttataacgatcgcgagttaataacgcgccaagatgatcaacctgaatacgctggtactgggcagtgcggtctgagttatcatgccacagaatttctaatgcagcgtattgggcgagggcgcgatcggcaatggcataacgttcactttcactgcgcgtaggcataaacgacagtctgaccagttcggcatgaatatcagcgcgaatatctggcgttaaattggcatcgtcaatcgcggcagcaagttgattattccgtaatgcctgcacgtattctgtgggatattgttgcgttaaggcattttcaggtaatgaccctgtcatcgcccgtaattcatcctcatgccgccccgccagtttatagatataggcttctgcgagtaaattagctttgtccggtgctccagagttaagctgcttaagtttaaccagcgcagaatcatagtgacccgcatctgccagggttaaaatttgtccccgttgataatccttattttgcgactccagagagagtgccttttgccacagtgtaagcgagttttgccattgttgcaggttacgataagcgacggcgacagctgcataaccacgcgctggtaattgctgatgacggtagcggttgtaaacggtaataacctgtttatcttgcccggcccataaggcaatctgtaaccagtcagcaatttggttattactgagtgctgatttttgtgcaaaccataacaaagctggctgagtatttcccttgcgagcttcgataattaatgcatcataggcgttattaacagcactcttcgccgcgggactcgctgctaaaaatgcggcagtaagaagtttcaaagcccatttggttttcgggcacctttttctgctacttgaatacatcctgtattactccatgtattgccaaaatctctctctatatctaattacaggtaactgaaaagaaagatatttttgcatctcataatccgttattaaacgcggaagagacacgtgaattgttgatgatgagaagaagaaatgatgagcagattgtccatataaaatccttttctcgcccgaaaatccattccaatgatgaggatcttcaggaatacggcataaatcccaatgcctttttcaaaataaattaggattaaaataattaaatcagtaaattccgatgcataatttcggatttttcgaaagtcctgatgaaaggcagcgctactgcactcacgaatttaattgttattcctaatgtatctattaattaatgctttataatgattttattataatcctttataagtatttgcaagcctgccttgcagcaaaaaatatataaagcattaaagtgataataattgcattctgcaactatcatcatcggtattgtttgtgggtggattttcatattgacaacagtacagttcttatatctattaataataaaaagggatctacaacctacaggttggtgtagctttatggaaaaagactatttgggaattagtagtactgtattagtgagcttattgtttgggcttgcattggttttggttaatagttggttcaatcagccaaccgttgaggaagttgttccacgatcaacctatctgatggttatgattgctttattttttatcgatactgttgcatttatttttatgcagttgtatttcatttatgaccgtaggcaattttcaaactgtatacttagtttggcttttctaagttgtttgatttactttattaaaaccgtcattatcattcagcaaattattgaggggcgtttgacaagcagtgttgttcaaaatgacattgcaatctattatttgtttcgtcagatgagtttgtgcatattaatatttctggcattggtgaataaagttagtgaaaacacaaaacagcgcaatttattttccaaaaaaatgactttgtgcataagtttgttttttgttgttggggggccgatagttgctcacatactttctagtcattatgagagctacaatttacacattgccgagttaaccaatgaaaatgatcaggtggtttggaaaacatcatatgttaccataatgattttcatgtggttaaccttgctttcagttaatctatactttaatggtttacgctgtgatatctggaatggagtgacggtgattgctttttgtgccgtactgtacaatgtctctcttttatttatgagcaggtatagcgtgtccatttggtatattagtcgcactattgaagtagtcagtaagttaaccgttatggtaatatttatgtgccatatattcagtgcgctacgagtaacaaaggacattgcacatcgcgattccttaaccaatatatttaacagaaattatttttttaatgaactgacagttcaatcagcatcggccaaaaaaacgccttattgcgtcatgattatggatatcgaccacttcaaaaaagtcaacgacacctgggggcatccggttggcgatcaggtgataaaaacagtggtgagtatcattgggaaaagcatacggccagatgacctttttgcgcgcgtcggcggcgaagagtttggcgtcttgctgacggacatcgatactgaacgtgcgaaagctttagcggaaaggattcgggaaaatgttgagcgtttaactggtgataatcctgaatacgccataccacaaaaagtgacgattagtattggcgctgttgtaacgcagaaaaatgagttaaaccctaaggagatctatcaactggctgataacgcactttacgaggcgaaagagaccgggcgtaataaggtggtagtaaaagaggcagaaattcttatcaaccgcaaggatgatgaatgagtctgtcgctagttgtcgacctccgcctggggcttctcatccccccggtctatgcaatatacgaaaaaaaagctcgtactttcgtacgagctcttctttaaatatggcggtgagggggaccgcctgaaataaatctgacttaatccaggggtgttatataatttcattataaacaatgcattacactttttgttgtccgatgttatctaatgtattcttagtgaagcgagagactaatggcatactggatggcataccagagtgacgggaattagcgtatggcagtattgacggatacgaaagcaagacatatcaaacctgatgacaaaccattgccccatgggggaattaccggactgacccttcatccttcttcagtaaaggggcgggggaaatgggtttttcgttatgtaagtccggtgacacaaaaaagacgtaatgctggattgggaacttacccggaggtcagtattgctgaagctgcacgtactgcccggataatgcgagagcaacttgctgcaggtgatgatcctctggagattaaaaaggctgaatctgagaaagtcgttatcccaacatttgccgatgcagccaggcgtgtacatgcagaactgtctcctggatgggaaaatccaaagcatgtaaggcagtggttatcgacgcttgagaattacgcgtttcctcaactgggagcaaaaacgctggattcgattacggctgcggacgtggcagaaacactgcgtccagtctggttaaccttgtcagaaacggcaagccgggttaaacagcgcattcatgttgttatgcagtggggatgggcgcacggtttttgtgtagcaaatcctgttgatgtggttgaccatttgcttcctcagcagacaagaggacgtgatgaacaccaacccgcaatgccctggaggcagttaccgctttttgtggcgaccagtgtgtataccgatgaaccttataatgttacccgcgcactgttattaatggtgatacttacagcaactcgctcgggcgaagccaggggaatgcgctgggctgaaattgattttcataagcgggtatggactatacctgcagaaagaatgaaagctaggctacagcatcgtgttcctttatcccggcaggctatttacattctggaaaatatacgtggcctgcatgatgaactggtgttcccttcacccagaaagcagcagatcctttccgatatggtgttgacaagttttctgcgtaaaaagaaagccgtcagtgacattccggggcgagttgccacggcacatggttttcgctcaacattcagggactggtgtagcgaacaggggtattcgcgggatctggcggaaagggcgctcgctcatacgctgaaaaataaggttgaggcggcatatcatcgtactgatctactggagcagcgtgtaccgatgatgcaggcatgggcggattatgtgatgtctcaaattgtgaataaataatagtgaaaatgtatattgtacgatcatgatttgatatgtgatcgtagcagtagtaattaagaaaccgcttttatgtcaaatgtattgagctgataattatcagatcgtcaggaaaacgtattttgattaacaggggattacttaacaatcccctttttataaaaaataatttgcctgtttaactcttcactcctgctgagactgaattattcctagtgcgtcataaatcagtcttctgcgtagtttattgtttttatctgcaccatataacataaatatattttcaactttttcttcaggtgttctgagataatggataagaaaggttatcattccaacacaatggaataaagtgaatccatcaaacaggcttatcaggtttccttttttttcccgtgttgtaagtattttttcgcgggtaagaatatttgccagttcatggggggctgatatgtttctgctgtctataatgtcatttattttaccaagggctatatcaacttcctgtaataggttatttatcatagctgagtgaatgttattggtttcatgttcctgacagtttatgaacttataaatcattgagttatacagaaatattactcttcctaataaatatgtgtttgtgtcattttgaagacaggactctgggtattcgtgatccagtgaaataaggttaatggactcgccctgataagtcataaaataattgatgtcatttaataatgctcggatatttacatgatttttactgaattttattttaaatgctatctttagtatagcaaacgcggcaatgataaatccaaaaggtaatttctcatagttcagtttattgatggtgcgatgaacactttcagtctttcctgaagtaagttgtctcaaacagttaacaaattctgtatagccatttaagacataatggcatgaagaatcttttaaagtgttttctatgttttgtaatgtgacgccgttgttcaatgtataaatgtaaccgccaaagacaatgttttcaatctcaacgacacaatttattgttttttgttcaggataaagataaatatcagaaatactatagtctcgtattgcgtcaatggcatcccacgataatgcactgtcaattttcagtgtataaaatggtgagttctcattaggaaagtaatatatgtatttgttcagtatattcattacatctattgggttggttaaatataataactggcattcatattctgaaacttctctttcgcttatcagcattttatataaagttgccagggtgcttgttaatgaagttcgtctttcgaaagccagtaatatagtgagataataacatgcaacctgaattttatctaagtcagaaattattttttccttgtcttcattacttaaataaagcagatgtttacaggtttctttgcatgtgttgatagttgcgataagttttgtttttcctggtgtactgtttttgcgaatattacgaatgaattcatatacgccatcaaagatatctttgaaatgcgcattcgctggtgtgtatccagataaacataacttaacgtaatttcgcagatatgtccttgcagcatgatatatatcatcctcattatccggtatctgagtgagaaaagaatgaatatgatagtaaaatgccatctcattatccgggcgatatgtgttcctgatgtcgagtgcgagaatcattggtacaatgtcattaaaatatttttgttttattatttgatgtgttttgtctgtaaaaacagaatagtgcattagcttaacatagagatcttcatatctcctaaatataacttttcgttgttctgtactcaatacttgttctttatcaataatgtttattaattcatcaaacatgtcgcccagtgaatgttgatgtgaggaaaaatttttaatatttcggatgtcacgggtattctggtttttagccagaacaccaaaacatgaaaaaacatcatacattatagtgataaaattatacataacattctccttttattgcactatataaattttaacattatatcattttgcttttctgttaactggttttcatttttgaatcaatattttctgaacagggtaatagtacacgtattaacagattatgtcagaaggccccggtgatgccttctgacgatagattaatgtggtattctattggtatctggagaccatatggcaacagttacagtacattctccccgctgtaattcctataaagtgtaccattatgatcacagcacctcagatcatgagcgtttccagtgctaatcctgcaaacgtgtgtatttcaactgaattacatctacgaaacccgaaaaccagacattaaagagcaaattgttgaaatggttcataacggagtcggggttcgcgatagctccagaacgctgaaggtggatatcaacaccgtcattctcactttataaaacgctcaccacgcaaagtaaccgcatctccagtcgccagtgccgatgtgacgcttatctgcgaacttgatgaacaatggagttttgtcgaaaacaaagctcgtcagcagtggcactggtatgcgtataacaccaaatctggaggtgtgctggcttacacttttggtcctcgcactgatgaaacatgccgtgagttgccggaattcctgaagccattctccgcaggcatgataaccagagacaaccggagcagttataccagagaaatgccacaggataagcatcttgtcggcaaggtatttacccggcgcattgagcgcaacaatctgacacttcgtactcacatcaaacgacctgcccggaaaacgatttgctttttacgctccttggaaatttacgaaaagccattggttcatttatcgaaaacacatgtactactgactggagtcattaccagggcctcttttgctgtttttttaccaatgaatgataatgagaatcgacagcgataaggggaaagtaaaataacactaatgctgtcgttttctatcatattgatttttaattatttattgtctttttgctcagcccatttttttacgcagacaaatttacccggggaatacaaactgtaacgacagttcaccacactatgggggataaaatgccagatcaatccggatactgctggactccttcacgcatcttacggatgcctgaactgagccaattgttaggtatatctcgttcgacaatttacgaaaaaatgaatccgttatcgaaatactacgatgcaaccttccccaggccggtacgtcttggtagtggttctgtgggctggcgttcatcagctattgacaaatggcttactttacatactgtacctgccagatcagcagtcaaaggtgttaatgacgaagtgcgacatacgctttcttcagatatgaccatgaacagataagtttttgtcatcacgtgatcacctcaggaggaaaaagaagcataagaacaatttagccagaagtttaattgataaacagaatttccagcattcattgttgaaagagcagctattgtcgctattgtagcggtaattgctgctataaccgaaacgtattacgaaaaaggaagcatttatgtcttacatcaaaccggatatgccgtattcagtatatgcgtgaccatcaatgatagggaaggcaataattaaagctcaatacaataaacaagtacctctgactctggttgcaatgtcagtattaacagcgatgtcaattgcctgtcagaatcaggttgacgtatgcagccccagaaatttacgtggggccgttaatatttacactatggttctggagaaagggaaaagaccgggggaaaggtattagtgaaataatttctggaggtattaagaatgagaaatatgaatgatatttcgtggtaaataatacagtctgcactgaattaaccttatcggtttattaaacatcagatctacaaatgctctgtatttctcagagcatcaggtctgaatagcagctattttcgctattgtagcgggagttgctgctattttactaacccattaatgaaaagagaggcttttatgtgcttacttgcaccagaaaatccttatccgatatatgcactaccaccgctggtgagaaatgcaataattgaaactcaaaaaaatacacaggcacctttggctatggtggcaacatccgcattaacagcgacctcaattgcctgtcagaatcaggttgacgtgtgcagacctggaaatttacgtgggcctgttaatctttactctctgattctggctgattccggtgaaaggaaaacgaccgtggataaagtgtttatgaaagcattttatctcagggatgaagccctggcggaagaatacgcgaaactggttgagaattacagtacagaaaaggaaatatgggagcaaaagcaaaaagcactggagtcaaaattgcataaagaaattcgcgccggtaaaggttgtaaggcaacagagtcagagcttaaaagacatctgaataaatgtcctgttccgccgcagatacgccggacaattttcaatgagacaacgatagagggaatgttaaaatattattccgacagcaatcgctcttttgctcttgtatccagtgaaggaggaataatttttgatggccgggcaatgagtaaacttggaatacttaactctttgtgggatggtggttctcttttcatcgacaggaaatcatctcccggaattattttgaaggatccaagactgacggtatcggtgatgattcagcctgatgtttaccagaaaggtttttgtacgcgaaaaaaagaacttgtgaaaacgtcaggacatcatgcaaggtttttgatgtgtcaaccaacatcaacgcaggggacaaggataataaccggagataattattcatcacagtatcaggatttgtttgaacagaggatcaatgagcttattgatgaaagtctggcgatgagtggtgaacgacgttgccttcacttttctcctcaggctgccagaatctggacggattattacaacgatgtggaatcgaagctggggggattggggcctttaagacattgccgggaatatgctgctaaaaatgcagagtatatggcaagactggcaggacttattcaccattcgagcggtgaagagggggacatttccccttacactgcagaaatggcgagagaattagcaatatggtacggtaatgagtatgtgcggttatctaatccgttaacttttgacaaccctgccctgaccgtacctgtgcgactcattccagaggagcttgaacttttcaactggataaaaagctattgcattgagaaggggatcccctgtatgaaaaaaaatgacattttacagcgtggtccgaaccgtttccggaaaaaggataaaatcaactggttactggatttactgtatgaacaaaacagagttgtaccggttattgagggaaaaacgttgtgtgtcgcacctaactttgacctctgaatgacttaatcgttgagtaacatataatctcctctgctacttgcggaggagactaatgcctttaccatgtcagcgttgtattagaaaactctggtacaggtcagtcagtaaatataactggtgtaaccactatttactattggatagagtgttgctcaggatattgtcggctttagtctgaggtgaggtgggaccttcattgttttcgtgttcaataaataatttaggttaattagtattattaatgggagttatgttatctgttatgttgtcttatctctttacatggtaatatcactcctctttatgctgagtattctgtatgtgtgtaatgcgtctatccccatatactacagtgtggtggtgtatggggtttagttatgtgtaaattatgttactacactcatagcgtaatattgagaaagttaatccactgaatgtatgtctggtttgtatttaacactagttacgtaccagaacactattagagtatgctatggctccgttacagtttataagtatgggtaaatataatcttttctgcatgaaataatcttcttattgtgaggttaaatatctgtgggctctctctgcagagtctctgtttttacttaatggtacggcaatactaatagcgatgttgcctgtggctacccggtactgacttttgtgaagatcagattatttcctgtaagtaattgaatggtgctttcttaaactcaattatatgaggtgtgttttttattgtaattcgttctggtcctcagtttaagagagtcttactgtattctgaatcattaccctattactgtaatgaggtaatacgaaacagttttatcaggttgtctgtgctgctggttacctcgtttattaatgccgtggtacgacgtttctgtatcctcagcatttacgtaatttcctcttcctgtgagttttataaagtaaggactataaaatgtataatgctaatcccaattacgaaatggacttcatgattctgaaagacgtgaatgaacacatggaaggtctgtttcaacgtttttctaaactgttacctttcagaattgattttgcctacaggaaagacacgcccagttttggtcattcctgtaggcacagtatgtgtattgaaatgcaccgcttacttagtgaaacccaaacgatgctggcgggatattactgggtaatggaatatacgtcaaacaagggacttcatattcattttatcggctacctggatgggcaacgtcacaagaaatcttatcggatatccaggcaactgggagatatctggaggcggatcacggaaggggagggttattttcacctgtgcagggctaaagacaaatacccggtgcgtatcgatcacgtgattcactatagtgataagtctgcggtagacggtttacgttacgcccttagctacctggctaaacaggatcagaaagaacacggtattattctgaggcgtagcaggctttccgaaaaaagcaaccggggccgaccacgactgaacagcatcctgccagggatatgttctcagctgtaatgttctgaacaacaactacgggctggctcttttttgcccgtcagggcgtcaagctgagccgtgcattattctccaactgggtggacgcatgctgccagttaatggctccgctgaatgatgccctgtaccgttatgtgatgaacacccgcctgggaaccatccacggcatgtcggtcggcgaactgctggcgtggatcaaagaagatgaaaaccctagcaaaggcgagatggtgctgattattgaaggccataaagcccaggatgacgaactgcccgccgatgcgctgcgtacgctggcgctgttgtaggctgaggtgccgttgaagcaagcggcggcgttggcagcagaaatccacggaatgaagaagaatgcgttgtataagtatgcgcaggaacagcagggggactaagcccctgctgccggttttgccgggtggcgcttgcgccttacccggtctgcttattgggacaagcgtttagttaatgggcaccgcctcaaacaccagcgtttccagcggctgcaacgtaatcaccgtcgcgtttttatactcaacgggcactgttttattgctgccgtataccgctttcagactaaactgcgccgcgtttcctgccggtatttcgaaatccttcgccaaatccagatagtaggtctgtggcttatccgatgggttgcgcaaaccgagaatggctttgtctttgctccaggatgcccagccgtacacggcaagcgccgttgggtcgccgccaatccagtgggtatcaaccagcacgctggcattttccttcgaccattttgcagccttcgccagcgtatcccacttcaccttgttcagcatggacggggtaatatacagctcctgcagctgggtgccggtcgcgaagtagctccagacctgatcggcaaagtcgctgtccgtttgcaccttctctaacccgtaataggcattctcggcgctgactatcccgtggtacatcagcgagttcagcgggaacagcgggcctttacgtacaatagagcggtatgtctcggcatcacggtatgttatccactgctgcaccggcgtgccggggccatacaggtttatatcatccccctgacgccagatagaatcagcatagaacaaccaggacgggctggcgttggtgccggtggtcaggttgataaatagattcgggtttgctctgcgcatattgtgcagcagagctattgacgcatcaaaatccgaggcgaacgggctaccctttatatgtgaactggcgttccccattccgtcgagtttaaacgaggtaatgtgttcatttttgataagattaatgatctgctcattgaagtttttaaagtagttcgctcccgaaagcgccagcttgccgtccacggtttcgaacccatactcttttgcatgcgaaacgcgaacgtcgcgcggcttattgtaacccccccacggtgaaagccatagcccaacggagctgtgcaggctatcggctttctctcgtactttgctaaaaccgttgctgaatgccgggccaaataaccagcgtccggtaagatcgtcccagccatcgtccagcagaaaagcgtctaacgccactccgcggccgctaatgaattccttgttccattcgtccatgcgtcccagaacatcctgttcggtgtacggagtgaaaaagccgatatccatccaactgttgtaatgcaaataaggcttgtacggacgtggacgtacggcattaataaactggttcacactgcgtcgcaactggctggtttccgggaaagtaccgaaccaggtggtaaagctaaccggcgtctctggctgaattggagttttcagttctacgttgagattggttgttgcttcataggcgtaggtattcacgatcggtttattcggcaggataaagaacgagtccgcaatgatcggtgagctagtgattgcgccgtctacgtaaggagcctgaaactgttttttggtcgggaagaaggtaatcttggcgacgtctcgtggttgcccaacggcggcaatagtgtagtcgatgctggcatattttcccttcacaaggttcaactgcactgttacgttaaaatctgggcgcgtaaagtcgatgacaatcgcattgtcctgttttttgatgtgcttgattttgaaatctgcggtgtggatttttgtctcatccggtagtgtcagaaagaacaattcctgtggtgtgatcggatggttagttctacggtccttcagcacaatcgtcgagtttgtatcatcaaacgagagggcaatattatcgttattgaacgtatagtttgctgctactgcactatgagacacacacagagccagtagtgagagagtgagcactttcttcattggtgtaagatccttatctgtaatgttactgcattcggttggtggatcgctccagccagtagcgctgagagccaaaattaatctgtaggtagttttcaccgttttgtacatagtggctgccgtcttctatgaccacgcctgcctgccgtgcgaaatgttgggttagctgcgttgcgctactctcatccgcgcttacgtctatccacgccagatacgacgattccggggtcatcatcttccacgccgggaagtaggtctggagggcatccgccagataccgggcgttgccttgcagataaccgttcagcgcgtcgagccagggcagaccgtgttgataggccagaatgattccccataccccgaacaaattgggcgaggtaatggagttcttctcaagctgctggcggaagcgctggcgcagcgagtcgtctggaatcatggagtaggaggttttcagcccgcccagctttaacgctttgttgggcgatgtgagcacgatcaggttgtcctgggcggcacagccagaggtgagacaactgacgaatttgccatccagaatgtgttcagcgtgaacctcatcgaccaccagaatcgtgctgtagcgttgacagagatcggacacctggcgtatttcttcctcgcgccagatcctgccggacgggttatgcggcgagcagaagaaccacagcgttggacggtaggttttgagctgttcttctatcagattaaaatcaagctgatagcggttttcctccacgcgcagcgggttagccagtacctgcacgccctggcgctgtgccgccatcgcaaaaggatcgtagaccggcgtgttcatcatcacgctgtcacccggtttgcagtacgcctgaatcgtgtagtgcagcgtggataccgtgccgtaggtcaacgtgatccacgatttttccacctcaacctgatgacgtttgcgctggaaggcgatgactgcgtcgtagaattcgtcaaagcaccaggtataaccaaaggtgccgtgctccacgatgcgccggaaaccgtcaatcaccgcaggcggtgaggtgaaatccatatcggctatccacagggggataaaggactccgggacgtcaccgaaacgcgagcaaacaaaggcatggtcccatttacggcacttatcactttgacgctcaatgattttgtcgaaatcaaacatcactcctcctgttaaattaaggcttcaatgccggttttgacgctctgtacctgcgctccgatgatcacctgcacgctatgcgcatcaagcatcgatcatcgcgctgcgtacgccggcgtgaaccttacggcgaatgtcatccaacgattcgtgatgatcgagatgcagtgctagcggcatgtcgtaagtgatcgaatacgcactgcacagggcgtagatctcttccagggcaatatgtttgaacgagccgggggggccccgcgaggatcacgggcgagcgcatttcgctgcatacttcgaggatcgcctggatcgtttcggcgttgtggatgttaaacgtcggtacggcgtaggcgttggcctgcgcatcctgcagaagatatttcgttgagataatgctcataaggagagcctcttaagcccgctatggatgaataatcacaccttgcaccacacggttaatcgtgccgctggcagaggggagatctggcgtattgccaacatgaatcgactgagccagcgcaaagacctgggcgtacatcaggaagcagaacgcctgttccatgtcgataaacgaacgggaaggaggcaacaggatatgcgggcccgcttcgatgatggcatccgtttccaccgcaattgcgatcacgcgcattgcctgacgatcgcggcgcagttctgtcagcagacccaggtcgtactggcgcgtgtaagggtggctggagatgtacaccacgataagcgtttcgctatcgaccagcgattttggtcgcagatgatcaccacccagaatcagcgcatcctgcgggaaattcaacgagtcggcgagctgacaaacaaagccgcgaaaatcggcgggcgtcattccggtataaccgctgaactggtccacctgattggaggttgcttcaatcagtaacggcgtttggtttgcactggcgtagcggattgcagcttccagcaccagcggatgtgcggaacaaacggcataaatcccatttgttttgcccgctttgtgctgcctcaccatttctgtcagatgtttcacttgcctctccagttccgattactgcgatattaatctttcgttttgtttcagtttatactgcatcatggtgagataaaaacaaaacgaaagctgctggttttctgatctgattcacaaaagaaacataatgaaagtcactaaaacgagagtagcttgcgccaatgggcagtgtgggcttgcatttgcttaatagaaaggcgttaataggcaaaaagaaatgaaacgaaagttttacgaaaggacttactatgagtaataccgacgcttcaggtgagaagcgagtgacaggcaccagcgagcgacgagaacagatcattcagcgtctgcgacagcaagggagtgtgcaggttaacgatctgtcggcattgtatggcgtatctactgtgacgatccgcaacgatctggcgtttctggaaaagcaggggatcgctgtgcgtgcctatggtggcgcgttgatctgcgatagcacgacgccgtcagtcgcaatctttttacggtgatcaggctgagcaatcgctgcaaaattaccacttcgatatgctgtttcttggtgtagatgcgatcgatctggagtgcggcatcagcacgcataatgaagatgaagcccgtttaaaccgtcggatgtgcgaagttgcggaacggatcatcgtggtcaccgattccagtaagttcaatcgttccagtttacataagatcattgatactcaacgtatcgacatgatcattgttgatgaaggcattcctgcggatagtctggaaggcctgcgaaaggctggggttgaagtgattctggtcggggagctcgcgtcttcgctgtgattcactatgcccgataaacaagcgttatcgggcataatacaacttgatgtatgaagagaatatcagaccaccggtgccgggttaaacactgccagctggttacgcaatccccattgatccgagaaggttttcttcttcccgctggcgacgtcgagaataaagtggaacaacttccagcccacctcttcaatggtctcttcgccggtagcgatagtgcccgcgttaatatccattaaatcaaaccagcggttcgcctgcccggtgcgggtcgccattttaatgacgggtaccgccatcaggccgtacggcgtaccacggccggtcgtaaacacttgcacggtgatacccgaagccacctgttgcgtgccacagataaaatcgctggctggcgtcgcggcgtaaattaatccgcgtttagtcgggtgttgaccgggcgacagcacttcaacaattgcggttttacccgatttagcaatggagccgagtgccttctttaccacgttggcgaggccgccctttttgttgcccggcgaagggttggcgctgcggtcggttttgcccatatcgggatagttatcgtatcaggccatctcttcgagcagacacctgcccacttcttcattgatggcgcgcggcgttaacagatgaatggcgtcgtgtacatcagtgacttcggagaacatcaccgttgcgccgcagcgcaccagcaggtcagaggcgtagccgacagcggggttagcggtaacgccggagaacgcgtcgctgccaccgcagtgcatgcccaccaccagctcggaggccgggcaggtgacgcgctggcctggttgagtttttccagatggtgtgcggcaacctgcaggatatcgtcgaccattgatttaaagccaacgtgctgttcgtcctgtaggcgtacgatgctggctctgtcgaccgggatgctctgcacatcttccgtacctttctgcaggcgctatggctgtagcttttcgcaaccgagacccaccaccatcacttcgccaccgaagtttgggttcagcgcaatattatggatggtgcgaattggcaccacggcggtcggtgcattaatcgctacgccacagccgtagaggtggttcaagtcgaccactccgtcgatgctcgggtatttcggcagcaggttgcgttcgataattttaaccacgtagttcacaacgtctgccatgcagtgcacgctggtggtaatacccaacaggtttttggtgcccacgctgccgtcggcgttgcggtaaccttcaaaggtgtaatcttccagcggcggcagcggctccggcactttggtcgcccgaggcagggggttaagcggcggcgctttcggcagcgtgaccgtggatttgtcgatccagctgcctttggcgacatcgcgtatcgcgtaaccgataacttcgccatagcgaatgatttcaccattctgaggaaggttgttatcccttttctggcgtattcgtcattccattcgtatccccggtaccggatgtttatatcgtactgtgccggtgcttgcgtgctttcctgcaggtctgcaccgatttaacaaacaaaacttaacagagtctgaaggagtagtatttcgtgcaaataaccgaagccttaatttcagagccgggagacatccggcgttttgttcagcaggcggtggaccactggccaaatctgttggcatttcacttcacgctctattcggcagaaggaaacatcaacgggcaacagattcatgcattctgtactgccttttaccgacaggtgcaagaacatattactgagcgtaatcacactgccagtccagcaccgccggtggtattacgctggttgcgggaacaacatggaggagcaacaatacgatgcctgttgctgctcagccaggcgagcatttgccatctgcgggtcagtgccacagttgatgaagaatgttcgcaagtggtggatttactgcagcaggcctggcgggggataaacgctggcggacaatgtcgggtggaaaggtgttttcgggttacccggcctgatacatcagagcaatacgttgcgttaaaaacagctgttcagtctctgatgccactggttattgcaacaattatccggtgatgatcgggagaaatatcaactcttccgttaatttttacagactgataaagttttgtctgctgaatctttatacggaattcttttcagtatgtgtacacgaattgactctatggcggataaatactgttttaccttggcggaattaatcctcacgtcttcgccagcagtggcaggatgtcctggaggagtgtcggcagactgaggcggggcagaagaacggctgcatattgcactgctgaatgtggattacgtcaccagttttgaactgccttttcgtctgcttttaacccggacgtcacagctgattgttacacttcgggaagcatgggatatcagccagaaaaatgtggtgttcaacgataaacggtttggctgcgtgtacagcctgaaagccagtctttctggtgtgccggatatattccggtatcatctgtctcatcgtattcgccggatggttgggagtgaaaatacatcatcgccatggcagcaaattgcccgggaagtgaaagcgccccgtgaacgactgaagtatgcgctggaaacgggattgcaggtgatcgcactgaacggcctgttttggtcagacagtcagcgtctggtggtggatattctgaggctaagcgccaacagacgtgatacaggaaatcgtccgcatccccatttaccgtcttatatcactggcgctgacactgaaagcatggtcgtcagagactctgtctggcaaccaagggagcagaggccggaggtaattgacaggagccttgcgccgggatgcgtatgttctccccggacagacagtctcagttcgtagaatctataaattactgctactgatgctgccggggaaaggcgtaacgaaaaaacagcctccgttaccggatagcaaggaggctgaatggagtttacaggatttgcttttgtataatgtctggccatgcagtaaaaccggacaggctttattatcatgtgaggtattctgacataaaatgctggatttttattttgtgacgaatgctgcaaaattgaatctgcactctgatgtaacttttatctgtttcagtgaagtatgcccacagattgagttattaagttgtggaagaacagctctgtcccgcctgcatctctcctttcagaaaccagtatgttgccatgcctcgccttaatggagagcgctgaaccataccttctttttccagtaataacaggtaatagcgtgcctgataatccgttaccgccagcgcctccgcaatttctgcggttttccctccattatgtctgctcagaaaacccattatttcattctgcatatcatcatcctctctatataagcaaaaggataataagtggctgacttgtttttggcaattcaaatgtgattatcatgtttttatattgtatttggtgtatttacttaatatgcgaaatatattcacgattggatttctatcacattatttttatagttttttcaatggtgaggaacgttgcaaaaaacgattttaacgatcttttatactgaatattcattcttatacagcattaatcactaagacactaatccacttagagatataaccctaaaaataaacagctttacagatcaaaagatcgtcaaaatacatatttacaacataaaaaactaaatatatcttaaggaaccaggccctcctgtatgggggatgaatattaaggcagccctgtaggtggcggggtggggagtatcgaatggcacagcatgaagttattacccggggaggggatgcttttttactaaaattacgtgagagcgcgctgtcatccggctccatgtctgaagaacaattttttttactgataggtatttcttctattcacagtgacagagttattctcgctatgaaggattatctggtcagtggtcattcccgtaaagatgtctgcgagaaataccagatgaataatggatatttcagtacaacgcttgggcgccttaccaggttgaatgtcctcgttgccagacttgctccttattatactgatagtgtatcagctatagctgaaactgcttccctgtaaaatacggacaataaaaaacgccggggcaatacataatacgcgagaaatataagcctgtagtcaaatgagagtacggatgttatcaacgaggtatgctttcagcttctctgcttttgctaaagcattcggtgtggagacaggaacactaacccatagcttatcatccagggaatcttatctatagagaagattcctgtcggttatccggaaaatattatcgggagataatgtcataaatgctgcctgagtgtatttctcacattgcatttatgaagttctcctgaaaaaaagattcccgtagttcgggatattgattgtatctgttgtgatgacagatgcggtgtgcgtagttcgattaaaaacaggaattaaatatgaagttaaaattcatctccatggctgtattttcagccctgaccctgggtgttgcgacaagtgcgtctgccgcacctgctactgtcaatggtggcactgttcattttaagggggaagtggttaatgctgcatgtgctgtaaatatgaactcagtagatcagacagttttgctcggtcaagttcgtacgaaaaagttagctaatcttgatgatgttagtggaccggttggatttaatattcaattagatgagtgtgattccacaacatctggatctgtgaagattcttttttctggcacacctgttgctggaaaaaataacgccttggctatacaaagctcggcatctggagctgcaacaaatgttgggattcagatacttgactcctcagggaatcctgtgacattaaattcggatcaaagcgcagtatatacattgacagacggaactaataatattccgttccaggctcgctatattgctactggtcaatcaacagctggtacagccaacgccgacgccacctttaaagttcagtaccagtaatatcagaacagtgtaacggatatatacccggccagggagggctgtttttatccatgcgggggtgagattaatgaaaatatcgaaaatggcagtaatgttatttttgctgtctcccgctgcactggccggaaaccactggcatgtcatgcttccgggaggaaacatgcgcttccagggaaaaataattgctgaagcatgcagtcttgccctgtcagacaggcagatgactgtggatatggggcaactcagcagcaatcgatttcacgccgccggtgagtatggggaccctgtgggctttgatattcaccttcaggactgcagcactgtcgtcagtcagcgggtggggatttccttttatggcgtatcagatattcacgaaccggagttgctgtcggtggaagaggagaatgatgcctcagacggaatcgctatcgctttatttaatgaaagcggagagctggtaaaacttaatcagcctccggagaactgggtgcatcttacccgcggagatatgaaactgcatatgcaggcgaggtataaggccacacattatcccgtcaccgggggaaaggcaaatggacaggtatggttttctctgacctatctgtaactggcagatataatgccatttaattaaggctgttaataacatgatgaagcacatgcgtatatgggccgttctggcatcatttttagtctttttttatattccgcagagctatgccggggttgctctgggtgccacccgtgtgatttaccctgaagggcaaaaacaggtacaactggcggtaacaaataatgatgataaaagtagttaccttattcaatcatggattgaaaatgttgaaggaaaaaaggatgccaggtttgtaattactcctccgttattttccatgcagggaaagaaagagaataccctgagaattattgatgccacaaacggacagatgccggaagacagggaaagtttgttctgggtgaatgtcaaggccatcccggccatggataaggcgaaaaccggcgagaattatctgcagtttgcaattgtcagcagaattaaactgctctaccgtccacagggactggttattccgccagaacaggcaccaggtaaattagagttcacccgtgaaaacggagggctgactctgtttaatccgacgccgtattatctgacagtgactgacttaaaggccggaaataaaagtcttgaaaacaccatggtacccccacagggaaaggtcactgttaatatccctggaggatacaccggaggagatattacttataaaacaattaacgattatggtgctctgactgaacaggtgaggggtgtggtgaagtaactcagttatttctggtactggttgtgtttggctgctgattttattttttcgctcagtgtgggggctgacatgttttccggagatggcggacaactcctgtctgataaatcactgaccggctctgctggcgggggtaataacagaatgaaatttaatatactgccgctggcattttttatcgggataattgtttctccggcccgggctgagctctattttaacccgcgttttctgtctgatgacccggatgcggttgcggacctgtctgcatttacacaggggcaggagcttccgcccggtgtgtaccgggtggatatttatctgaatgatacgtatatctcaacccgtgacgtgcagtttcagatgagtcaggacgggaagcaacttgccccctgcctgagtccggagcatatgagtgcgatgggggtaaaccgttatgccgtgccgggtatggagagactgccggctgacacctgcacatcactgaattccatgattcagggtgccacattccggtttgatgtcgggcagcagcgattgtacctgaccgttcctcagttatatatgagtaatcaggcccgtggttatattgcgccggaatactgggataacggaattacagcggcattgctgaattatgacttcagtggtaatcgggtgcgcgacagctatggtggcaccagcgattatgcctatctgaatctgaaaacaggactgaatatcgggagctggcgtcttcgggacaacaccagctggagttacagtgccggaaaggggtacagccagaataactggcagcacattaacacctggctggagcgggatatagttcccctgcgctcccgtctgacgatgggggacagttatacccggggggatatttttgacggtgtaaatttcaggggtattcaactggcctctgatgacaatatggttccggacagccagagagggtatgcaccgacaattcacggtatttcccggggaacatcccggattagtatccgccagaacgggtatgaaatttaccagagtacgctacctccaggcccgttcgagataaacgatatttatccggccgggagtggaggtgacttacaggtaaccctgcaggaagctgatggcagtgtacagcgatttaatgtgccatggtcttcggtgcctgtactgcaacgtgaagggcatctgaaatatgctctcagtgccggagagtttcgcagtggcggacatcagcaggataatccccgttttgctgaaggaacgctgaagtatggtctgccggcaggctggacggtgtatggaggagcctggatagctgaacgctaccgtgccttcaatctggggatgggtaaaaacatgggctggctgggcgctgtttcactggatgccacccgtgcgaatgcccggttaccggatgaaagccggcatgacggtcagtcatatcgttttctgtataacaagtcactgacggaaacagggacaaatatccagttaatcggataccgctactccacacggggctatttcagctttgctgataccgcctggaagaaaatgagtggttacagtgttcttacccaggacggagtgatacagatacagccgaagtatacggattactacaatctggcttacaacaagcggggaagggtgcaggtgagtatcagccagcagacgggggaatcgtcaacgttgtatctgagtggcagccaccagagttactggggaacggacaggacggaccgtcagcttaatgctggctttaactcatctgtgaatgacatcagctggtccctaaactacagcctgtcccggaatgcatggcaacatgaaactgaccggatactgtcatttgatgtcagcattccgttcagccactggatgcgttcggacagcacatctgcatggagaaacgccagtgcccgttacagtcagaccctggaggctcacggacaggctgccagtacagcagggctgtatggcacatcgctgggggacaataatctgggatacagcatccagagtggttatacccggggagggtatgaggggagcagtaaaacaggatatgcctctctgaattacagagggggatacggtaatgccagtgcaggatacagtcacagtgggggttaccggcaactgtattatgggctgagtggcggtattctggcacatgccaatggtctgacactgagccagcctctgggagatacgctgattcttgtccgtgcaccaggtgcatctgatacgcgcattgaaaaccagacgggggtgtctacagactggagggggtatgctgtactgccttatgcaacagactatcgtgaaaaccgggtggcactggataccaacacccttgcagataatgttgatatagagaataccgtggtcagcgtcgtgcccacgcatggtgccgttgtgcgggctgactataaaacccgtgtgggtgtgaaagtgctgatgacgctgatgagaaacgggaaagcagttccttttggctctgtcgttacggccagaaatggggggagcagtatcgccggagagaatggtcaggtttatctgagcggaatgcctctgtcaggacaggttagtgtgaaatgggggagtcagaccacggaccagtgtactgcagattataaattaccgaaggaaagcgccggacagatattaagtcatgtcacggttagttgcaggtaaagaggcagggaaatggtgaaggatattattaaaacagtgacattctcctgcatgctggccggcagtatgttcgttacctgtcatgtctgtgcagcgggttctgtggtgaatattacaggcaatgttcaggataacacctgcgatgttgacattaactcccgaaactttgatgtcagtctgggaagttatgacagccgacagtttaccgcagctggtgatatcacacctgcgtcggtatttcatgtcgggttaacctcctgcggcagtgctgtccgtgcagtgaagctgacatttacgggcacaccagataatcaggaggcggggcttattcagattaacagcataaatggagcacggggtgtggggattcagcttcttgataaggataaacatgagctgaaaattaatgtgccgacaacaattgcgttaatgccgggaacacagaccatagcgttttatgcccgtctgaaagccacttatcttccggtaaaggccggtaatgttgatgcggtggttaattttgtacttgactatcagtaaatataacacagaggaaaacagatgaaactgaaagctattatattggccaccggtcttattaactgtattgtattttcagcacaggcagtggatacgacgattactgtgacgggtaatgttttgcaaagaacatgtaatgtaccagggaatgtggatgtttctttgggtaatctgtatgtatcagactttcccaatgcaggaagtggatctccatgggttaattttgatctgtctctcaccggatgccagaatatgaatactgttcgggcaacatttagtggtactgcggatgggcagacatactatgcgaatacagggaatgctggcggtatcaagattgaaattcaggacagggatggaagtaatgcatcatatcacaatggtatgttcaagacgcttaatgtacaaaataataatgcaacctttaatcttaaagcccgtgcagtgagtaaaggccaggttactcctggaaatatcagttctgttataaccgtcacctatacctatgcgtaaatattatcccctctttaagaaaagcaccgtccttaagggcggtgttttattcacacttataatggcatattcccagccatcgtttgcactgttgtgcagaaataaccagaccgggcaagtatttaactccggggatacatcctttcgggttaatgtcagtcctgttgtgcaatatgataaatccatatctgtattggacctttcccaactggtatcatgtcagaatgaggactcgacaggccaaaactatgattatctgaaaatattgaaaggcagtggtttttctcctgctctggataccaaaacatacggacgactcgattttacaagtcgtccaacggggtatgccaggcaattaccacttcagtttgatttgcaggtgacagaggcgttttatcaatatggtgtctggaaaccattccctgctaaattatatctgtaccctgcaccgggtgtatttgggaaggtaattaacaacggagatttactggcaacgttatatgtgaataagttttccacaaaggggcaggaggcaggggagagaaatttcacctggcgtttctatgcaacgaatgatgtccatatccagacaggtacatgcagggtctcatcgaacaatgtcaaagttgaccttccgtcctatcccggagggccggtaacagtccctcttactgtacgttgcgaccagacacagtcggtcagctataccctgtcaggtcctgtaacaggaagtggtaatactgtattcgcaaatacggcagcatcagggtctggcggtgtgggtatacagttgtcggataacgtggggccggttccggccggacaaccgaggtctctgggacaggtaggcagctctcctgtgagtctggggctgaaggcctcttatgctctgaccggtcaggcaagtccgacgcccggtgctgtccagtcagtgataaatgtgacttttagctacaactagaatgcagttgtggcggtaatgatattactgctctttatatccagtttttcatttaatgtatcactgtttgtggtgaaaaatagctgataatagtattgtttccggtgttgtgacggaacgagtctgtcatatggtctttgtcaaagataaacagaaccagtatgagccgtatatctgattctgagcgttgtcagtaatcataaagataatggtaaatctgagggtttaaaaatcaaatcagaagaactgcgcttatccagccagaccttctggtcgggaggggctcatatttccggaggagtaatgtcaggggcagttaacagtatactggaggtgaaatcaggcagaacagaatatatcctctcaccggtttttgagcctgtatgggatcagaccgggaaaatatttgcttttgaaatgctctcggatatccgttcagcaaaagacgggaggaaaatctgcgcatctgtttttttcagaagtgcgtctccggatattcagtacaaaatactcatcagtcagttgaagactgcggaaacgcttcataaatggtgtctgcagaagaaaataatgctgagtgtcaatatttcccgggtggtagccctgtatctgagaaaacatggcatcccggggcggccgggaacacatatcaggcttgaggtcagtgaggactttccggcagtggcgttaaaacccggtgatgaccccctgttacgttttttgtcagaacgtttcaccctctggctggatgatttcggctcaggaaatgcaggcttaatgtggggactgtccgggatgtttgaacgggtaaaaataagtcatgagttttttcattatgccctgaaaaacaggtgtgcaatgccgcttctccatgctgtggcagacactgttgcctgttataaccggggcgtgatacttgaaggtgttgaaaatgaagcgttgttccgtattgccagagacatgaatgtccagggctgtcagggatggctctacaggcgtgtggaagctgatgaattatccgcgattattgagctgcatggataatcctttttcacagacttgtcagcagccagcatttatgttcttttatctgagggaatttatctgtccgctgtgccgggatatctcagttatacagaaatcaggcaggaataaattgtagtggaaagtcgaagtttaccggatgactgatgcgcacttgtacacaggcagtgtgtttcagtaatatggagaataatgaaatgaataacacagacacattagaaaaaataatcagacaccaaaaaaacaaagacccggtatatccctttcgggaacatttgttgatgcaactttgtattcgcgcaaataaaaggatgcaggataatatatctgaatttctgggggcgtatggaataaatcactcagtgtacatggttctcaccacattattcacagcggagagtcattgtctgtcaccttcagagataagccagaaactgcagtttaccagaactaatattacccgcattacagattttttagaaaaaaccggatatgtaaaaaggacggatagcagggaggatcgccgtgctaaaaaaatcagtctgacatctgaaggtatgttttttattcagaggctcactcttgcacaaagcatgtatctgaaagaaatctggggttatctgacccatgatgaacaggaactgtttgaagtcattaataaaaaattactggcgcatcttgatgatgtcagctcataaagtgtgaaatgcctgacttgttgaaagcagtagtgttgcagaaagacctagtgatgctgatcttatatacataagcagcgcccgtgtctgaaatgcaggttagaaacaatgtgaacactatccgttagaaattgtgacaaaattcccgatgatcgacaagcgcaccgattttccagtggcaacatcagtacaaaagatgaacggtactgactttgccggaatgagtcaaaaagaaagctgaactggcactactagcagtgcttcagaaatttatttgactgaagtacaatgaaataaaaaacatatgttatatatcaatttgatatttatgaaaaatcaataaatttatcttgtgagggattgctttttcttttgctaaatgatattgattatcattcttatataaaaacaataatggcagtaagaaatatctggcaaggatgtgagcttaacgatcaaacattttaagttaggcatttattagggaataggaatgagaattaacaaaatcctctggtcgctaactgtgctcctggttgggttgaatagccagatatcagtagccaaatactccgacgatgataatgacgagactctggtggtggaagccaccgctgagcaggtattaaaacagcagccgggcgtgtcggttattaccagcgaggatattaaaaagacccctccggtaaacgacctttcagatattattcgtaaaatgcctggtgtcaatcttaccggcaatagcgcctcgggcacacgcggtaataaccgccagatcgatattcgaggtatggggccggaaaacaccttaattttaattgatggtgtaccggtgacgtcacgtaactccgtgcgttatagctggcgtggggagcgtgatacccgcggtgacaccaactgggtgccaccggaacaggttgagcgtattgaagtgatccgcggccctgcggcggcgcgctacggttcgggggccgccgggggggtggtgaacatcattaccaaacgtcccaccaacgactggcacggttcgctgtcgttatacaccaaccagccggaaagtagcgaagagggcgctacgcgtcgcgccaatttcagccttagtgggcctctggctggtgatgctcttaccacgcgtttgtatggtaacctgaataaaacggatgctgacagttgggatattaattctccggtcggtacgaaaaacgcagccgggcatgaaggggtacgtaacaaagatattaacggcgttatctcgtggaaattaaatccgcagcagattctcgatttcgaagccggatatagccgccaggggaatatctatgcgggcgatacgcagaacagttcttccagtgcagttaccgaaagcctggcaaaatccggcaaagagacgaaccgcctgtaccgacagaattatggcattacgcataatggtatctgggactggggacaaagtcgctttggtgtttattacgagaaaaccaataatacccgcatgaatgaaggattatccggcggtggtgaaggacgtattttagcgggtgaaaagtttacgaccaatcgcctgagttcctggcgaaccagcggtgagcttaatattcctttgaatgtgatggttgatcaaacgctgaccgttggtgcagagtggaaccgcgataagctcgatgatccttcctctaccagcctgacggtgaatgacagagatatcagcggtatttctggttctgctgcggatcgcagcagtaaaaatcattctcaaatcagtgcgctgtatattgaagataacattgagccggttcctggcacgaatatcattcccggcctgcgctttgattatctcagcgactccggcgggaacttcagccccagtctgaatctttcgcaggaattgggcgattatttcaaagtcaaagcaggggttgcccgaacctttaaagccccaaacctgtatcaatccagtgaaggctatctgctctactcgaaaggcaatggctgtccaaaagatattacatcaggcgggtgctacctgatcggtaataaagatctcgatccggaaatcagcgtcaataaagaaattggactggagttcacctgggaagattaccacgcaagtgtgacctacttccgcaatgattaccagaataagatcgtggccggggataacgttatcgggcaaaccgcttcaggcgcatatatcctcaagtggcagaatggcgggaaagctctggtggacggtatcgaagccagtatgtctttcccgctggtgaaagatcgtctgaactggaataccaatgccacatggatgatcacttcggagcaaaaagacaccggtaatcctctgtcggtcatcccgaaatatactatcaataactcgcttaactggaccatcacccaggcgttttctgccagcgtcaactggacgttatatggcagacaaaaaccgcgtactcatgcggaaacccgcagtgaagatactggcggtctgtcaggtaaagagctgggcgcttattcactggtggggacgaacttcaattacgatattaataaaaatctgcgtcttaatgtcggcgtcagtaatatcctcaataaacagatcttccgatcttctgaaggggcgaatacctataacgagccaggccgggcttattatgccggagttaccgcatcattctgatcgtagtgtttcaggcgcactgcccgcgtaaaagcgggcagtgtttagtggcttaactcatgacaacctgctgtgtaatttgcgttttcaccactgatatctaacagtgcctggcgaaaggaggcattgaacatcggcccgtgtcccaggttggggaaatcccataatatggcattgacgcctttatctttcagtatagtgagggtggtatgaattttcgacagcaccccgacagcatgcgtttcccggttatcaccctgtgtcgccgagccttccattatcgccaggtgtttggcgcagaattgcagaggctcaaccgccgtaacgcggcttagcaaagcatcataacctctgcccaacgacgggctggcgctgtagtacgaccggaagtaagaggaggacagccaggaatccagcacgaagaggccgccgtaggagtgcccccataagccgcggcgttgccgatcgatattcagtccctgttccacttttggggcaatacgcgtttccagtaactggcggaagttgttgctgccaccactcttacggctaaaacgccctgagtggagatctgtttttctgctttctgctgctggcgtatagtcgtaagccctgctgttgagatcgaaagggaggttggtctgatacccgacagccacgatcactggcggtgttttttctgataattgtttgagcagttcgtcatccaggcggtccataactgcgttaccgtcaagcatatataaaatcgggtaacccgatgccggtgcggttgtattcggcacggccgtccatacccgataatggcgtgtgccatcgacagagtcgaaagaggtgacgctgaaatggtaaaacacggagcctttatcggctatattcggccccagtggccgcatatccggcttcgcataaacttgcgcactacagataagggtgaggcaagaaagatgaaagaaaatcgctttatacgggcgtgttgagcgatactcgcgggcatacatctgatgattattccttttccgcaggtgacaatttgatttattcaggaagtctgtaccgtttcctgaaagtgtttgtgggtcaactcaaccctgtagtaaaccaatcccgtcaatcagtgcaccgcgccaccatgcgtaatcgtgaccaccggtgtagattgcgcaatggctttcgacgccagcggtaatcagccgctggtgaagttgctgaacgtgaggcactgtcgaaccttccagcgatcccacgcacaggctgatacgcacgccctgcggtggggcagaaagcagatgctcactcacccatgaggtatcggtttcgctgaacaagcctggtcgactggttctttctggcgtccaccacattgaaggagagtggctgagcaccagaccgaacgtttccggtgcgtaacgagcccccattagcgcactgatcccgccgaggctctgcccggccagcactgtgcgcgaacggtctgcccactgacgctgcggttgttcagcgcggatcatcggcagcagatgtcctgcgatatcctttatcagcttgctgcgcccgccgagtatctcagtgcgttcatgttcattaatgttgtcaatgcccagtacagccacgggcacgatgcgcctgttatttatggcggcgtcaattgccgcgcatacgccaaggtgatcaaaccaggtttcaccatcgggcagcacgaccagcccgaggggctgagaaatatcaatgtccggaatatagagccgaacctggcgagatttcccggcgataatgcgcatggaggtaagcagttgtccggtgtggaagccgccgttccattccgacagggcgggagctttatcaagtgtcagcactgattcctttgcgtttccccgaacgttgatctccggcattttgtttagcggatcggcctttccggcgagggtggcaaaacggcctccggacagtgcaatcgtctcagccgtagtgccgggggggatttccagcagcgaataggagccgcagtaacttgcgggtaaacgcagtgtcagtgtccagatatccgtttcgggaagggcgctcatcattcctttttctacgtgctctttatccgtcacccggttcagacgcagataaacgccctgcagaggatgtcgggcgcgccacagaaaggtcacttctcgctcatcttccgctccttcgactggcgtcacaagaggaacattcagcgactcagcttcgcgccagaagtcagtaaggttagcaatgtggcccgctgccagttggttgcgcaggctggcgatagcagagggatgttgttgcatgttcagcattcatactctttaaaaattaaggatgtcagtataaataattaaagcggctattcacggtaccgccgcttctgactgtgtttttaatacattacgtgtccagtaactatcccggggtttcctccttcatgttgtgctggcgatggagcgcagtactgctgacgctgtcatgccataagcgggtatagaggccgcctgcagataacagctgttcgtgggttccgtattccgcaagtaaccccttatcaataacggcaatcagatcgcagcgttgcgcggtggtcagacgatgtgcaacaatcagcgccgagtgcttcccggcatgcacgacatctgttaacgatgacatcagtcgttcttcggatgtgcgatccagacatgacgtggcttcgtcgagcagcaggatgtgagcattcgccagttgcgcgcgggccagcgcaatcaactggcgctgacctgcggacagatcggctccgccgttattcaccggtgtccggaatccctgcggcagattgcacaccatctcatacagccctgcccgctgtgaggcaatttcaacgtcttcattggtggcggatggccgtgaataacgaatgttttctgcaatatcactactaaacagtgctacatcctgatcgacaagcccaatctggcgacgatactcagtgagcgaggcatcatcgagcatttgcacaccgattctgatgttgccgtgcgtggggaaatacaacccggcaatcagcttaatcagcgtcgacttacccgcaccgctgcgaccgacgaccgcgacaaccattccctctgggatcgtcagggtaagtttgttcagagctggctcgtgactgtcgggataactgaacgtgacctcatcaagatgcagtgcaccggtgacagggaggaccgaagaggacccgaggttctcagtgccttctgtcgccagtagttcatcaatatgtttgccgctggctgtcgcctgctgccaggcgtcgacaatccctgataactgctgcactggcccatagaattgccccagcaacaggaagaaagccgccagtaccccggcagtcatttctccagcggcgacctgcgaagctcccactaacagaacagcggcataggaggcctcggtgcagaatgtcaggaacggaaaatagactgcaaggtatttttgtgctcgcacacgggttgcgcggaaacgctccgataacgcgcgcagccgggcgccctccagttcctgctgaccatgcgattgcacgacacgcaggccagagactttttcctgcagggtgctgttgactttgcctatttccagccgtgcctgtgcataagcaggggtactgaggcggcgataaatcatggttgccagtgcggccactggcactgcgcttaatgccgtcagcgccaggaacgggtcgagccagaacatggtggcggcgattgcgaacatcgtcaccagactggtggccgcaccggcaaggccgttttgcagaaagcgggcgagagagtccacatcaacggtcatgcgggtaagacgcgaatcggcatgcttttcatgccaggggagtccaagacgcagcatatggccgaagctgcgcaagcgcaccgaatgctgaactgattccgccgctctggcggcgaagaccgtctgcagagaataactgcaccagcccacaatgaccaggcacagggcgagcagggcacagaggccgatgatcgacatatcgcctgcggcgacaccggagtcaatgccgtgctgcaacagtatcagtacccctacgcctgccgcagaatcgagtgcgatcagcagagcggcgatgacgaacatccacgccacaggcttcagtagtgacgtgactttgcgacctttaccggccagcgcctgctgtactgcattttccggtacgcgggtcatacgggcgacaaaacctttatcccccgtatccgttacatcgtcttgtgtcgctggttcagccggccacaattcgttgtggctattgtgggacgtggccagaaaatcgctgtcgccggtcatcagtgcgcggaacgccggacagcgcgcttcaagttctgccggggttccggtatccaccatacggcccttatccagcaccacaacccggctggctagctgaagtgttgaacgccgtcgggcaatcaccagcagcatatgcccttcgtcagcatagcgacccagcgcggtattaatctccgcttccgtaacagcatcaaccgctgaggtagtatcatccaggattaacacgtccggtgcagtaatgagcgcccgcgccagcgctattcgctgcctctgcccgccggaaagattcgtaccccgttcggttaacaggctatcgaagcctttcggcagggcgttaataaaatcgctggctcctgcagcagctgccgcacggcgaatgtcgtccgccgttgcctgagggtggccataggcgatattttccgccaccgtaccggcaaacagaaaagcatcttcaaatacgatgcctacccggcgacgaagcgcctccagtctgatatcgcgaagattttgtcggccttcgctggtgttgagccatatctttccggagcagggatcataaaaacgcgccagtagcatcaacagggtcgattttcctgaacccgatgcgcccaccaccgccacggtttcaccggcgcgcagggaaaaggagatattgctgaggatatgtctgtcgccatggtggtagtcaaagctcatattctccagttccagtccgacaacctgactgttaatcgactccgtcccgtcctccatctgtgaacgggtgtcgatcagtgcaaacacccgctccacggacgcctgagtgcgctgtgcgataaccagaaacgatgccagtacgcgggttggcccggtcagcatcgcgaggaagctggcgaatgcaacgaaggtaccgagatcgatccgcccgtgcatgaccgaccacccgccgtagcacagcaggacgatttgcccgagcaccggtagcgccagcatggtggccccaggcatcgcctgcgagataaccgcaccgatgcgtacacgcacaatctgccgcgactgcctatcgagccagtgcgtttcacgcatctctgccacacaggattttaccactgagatctgtgccagcacctcgcgtatatgttcggtgagattcgccagttggtccgaggccagcccggtttgcgcgaagaccctacgacgcgcacgaagcgcggtgatcgccaggcataccagtacgcacacgacgataagcgtcatggcaggggacatccacagcatcacggcaatgccggcaatgtaataagtgaacactgccagcggcaccgggcacatctgcagcagggtatgcacctgctgcagatcgctgttggtccgtgaaatcacctgcccggtgcgcagcgcatcctggcctgcgccgtcaagtttctgaatactgtcgaatacccgtcctctgagggtatgctgcacccagagtgagagcatcccggcataaccacggcgcacatagttaccgatgaaatcaaaaaaagcgatcaacagtaacccgcaggccagccacggcaggcgggccggattgcccgccagtgcgtcattcacagcctgtcttgtcagcagtggcgtcagcgcagccagcaaaatagtcgatactgacgctaccaccacgatgacactaagtttcttacgttcccagcacacgcgcgccaggcgaactatccatgactgagccggtgtgggagtgtgattcgcaggcattaagcctcctccgtctgtaaaatacgatccactggccggatcgttccgcaaaaaagccagcacgctccggtcccgcattgttatggatgcatgactcctggatgggtgctggcatatgattatcatgaaggtgtagtggttaccctttctgtaccattgtgatcaggcttttcgccacttcacctgggcagggttgcgccgccatttccgctgctacctcttcagaggctttgcgaagtgagcgattgttgaggaaagcattgatcatgttactcgacaggccgacgtcgccagggataatcccgcagccgcgttcggcaacaacgcgggcatttaccgggcgatcggctccctggccgaagacgatttgtggaataccagcgtgtagcgctgtcagggtattgcctgctccgccatgatgaatgaaaccatctgcgccgttgaggaagacacccatgggtatccagtcaaccaggcgaacatttgacggcagcgagcgcaaatcggaccgcgcattggctgaaatatgcaggatgatctcggcatcgacctcactggcagaatccataacccaggcgattagatcaaggccgtcaaccatcggtttgacagtgccgagactcaccagcagacgtttacgctcgggccttctctcccaccatggttcccacaccgcgccaccgttatacgggacgtactgcatcggaataatgggttcaccgtcgttttccagaatgctcatactcggcggtgttacgtcgatccaggccatatcacgtggtgtggcccccacattgtggcgacgataggcgtccgtgagcgaacgcgttacacccctgatatgccagggggtatggccgaagcctacggtttgcatcacgaccggtatatcatatttggcggcaatcagcggcccgatgactccgagcggagggtagatgatgaggtcaggccgccagtgtccggcaaactccaccagatggtcggccatttcttcgctgaagaatgagaagttgcccatttgggttccgatattactttttttccgctgtgcctcatggtggcggtaaccagcttcggaatccagaccgggtgcggcgtcaaacaccaccaacccggcctctgccgctttttgtgcgaattgtcctccactggcgatcagcacttcatgaccgttaacgcgaaatgcctgcgccagagacagcacaggatacaacagcccatagagaggcgggcctacaaacaaaatacgcatgagaaaatccctctccgcttgacgatctaaatcaggcagtcgacgcactcatatgccagcagcaggacacgacttttcgttaaacctgctttaccagatgctgcgccatttgtgcttcaccagcgttatggacagatcagtcagagacttttccgtgacatacacagatgaacagggagctccgtatccccacttccattaacgcttacgcgccattgtcctgttgaacagcccaaacggcgtcggacagctacgccgggatgttctgacgcatttgtgcagtgttagaccgacaatgaatctggaaggatccgtgattttttagacacacggcttgcatcatcctgatagtctcgccttcgctggcctgtaagtaaaatgaccttgtactggcgatgcttgttccctttcagccttaccagagacaacgttatcgcaaatgccaatgataataattaccaatatcattaaggtattgcaacgataattaaaaacttaatgaaaagggaagcactcagaggactatccgggggtatttaaattgaaacctacgctgctccagaccgtggagaatatttgcctgcaaattctgttcgtgctgttccagttcaccggaacgctgatagacgttgaggtattggtgagctgttcttccgttgccaaaaatgtacagagaactccggccagcagcgtttcatcctctgtctatagcgcaagcgtgtcgagaactgctgctgatattatgctgttgtcgaataatccgctttttgctccgggtcaggtgagttttttcggctgttcgttggcagcgtcaggtattcacgtcaccattactggagtaatgccagtcaattaagcaactgactggctctttttcggggctgtggggtatttctagggcctctcctttaccactctcgggaaggccctttcccttcttgtcggtaatttcacaagttgtcccatacttgcaagatcgcgcatcagctccggtatacgtcccggtgaagcgccctgcaatgtcatcagcattctcatcaccattccgcatgattctgagaaactcagttgattcggccagtaacctttcagatgttccgccattttaatcatctgatatctcaccagattataagccagtaagacaccccacagctcttgctccacaagctccggctttttacttctcagcgtcagcctgctcagttgcatcgtctgttttatctctctgtatccctggtcaggttgacggggcactagtggtttcagcggttaatcgtcgaacaggcgcgagacaatattcgcattcaacaaaataacaaacgcaacactgatcgttttgttgagaggataactctttttcagggttatgggtgaaaggcctgaaaatttgcgattatctttaagagagtcacaaatatactccaaaacccgctctctcattctttagactgaacttagcgtagctcaccatgtcaaaatgtttgaaactgctctggtgtgggaagtgttcgaaaactcgtagattgttatttcaatcagtgcgtaaaagagtgtcttactgaaaaatgaatatagatattcatctggcgatttgagacgaaaagatttctttcatccgcagttatgcgcatggttaagaggtgacgattgaagaagtcctgatcttactgaagttacgcggatagtgggtaatgccgcgagattgatggaactttaaaaattatctcttaacgttttacggatataaaaagtttattttttgttaagagagattacttcaccagacaacttgaactcgctgcagggcgtttttttatgcccgaaaagctgcacagtacgttaaatatgctggtgattgtgcagtgagtttctccaagcctgatgcgatttgactgaatgatatcacatttgtaatgtaaaataaatcaatgtttttaagttgctaggtgcttgtttctatagctggggcacttccttttactatggctttccatggtgggggcggagctggtgttgatgatgtggccagaagcctgttttgctgttacagtcatcgttatattccttattggatggggagcaggtattgttttctttctgggaattaaacaaaaaacaatatgaaggatttgagttttatcagattttttctggcaatattgtggcttcttgttcctcctgctctggagtttccagtaattcatcggcacattacgccaggtgcactgactttatgcgtcattacagccttaataattacgctgcttgccagtttgggcggcaggcttgtctcagttaaatgtatttcggagatttcgtttattcgtcgtcatcggattgagtgcatgatggcgggatttatgatttatttctggacattctctcttattgctggttggtacaagccccagtttaagaaggaatatcagacactccactatgagaatgctgggtattacgttcttgcacgctatgacgggcgtttggttttatcacaatcgtacaggaacgggagtaggaagtttgttataatcaatggcggacatagactttgagattaatgtagtcagagtgcgttaaaattcccttagaaatcgggaatagatagtactagatacgcaggatttaatcagtcgtattgagatggaattgcagagttaaactggcatggattattttgtacccagcccttaagaacaatggtgagagatagtaactcataatcgccaattcactgttttaaatttagtaagggccgctatccgccactggctcatcgggaaagagcatcagccttctaagttgactgtgcgaggttcgagtcctcggtggcggtccagtactgatttagctcagtaggtagggaattgccttgtaatcagtaggtcaccagttcgactcttgctgtctcgccccatattccaataggctcgctttgacggggcttttgtatgtcgcttgcgatatgttacagtaccgttatcagtctgtagaaaatacacacaggagtgaaatgttaaattactcacaactcagagagcggagtgttgtcctgttagtggggaatttgttaaaagaatccagcatggtgaatctccctgtgcggctgtctcttgatcagatctcctgatcaagagacttcatcaccaggtaaccctcaaccatatcctgaagtctgaaccagccatcccacataactacccaaccagggcggcctgtgcgtttgctgtcatgccatcgccccagtttcagacaggcccatttcagtgtcggcgtctgtgacggaagctgttttccttccagcttaacccacagcagtttccactctgtcggcgtcagtattttcttacagctgtcattttgtgtttcttcactgataccttcctgccgcaggcccagcacccgtaccgcgataaacgccttgataaccaccatgcgctcaaggttatctcgggtctgcattcgcagcgattccacacatgtaccaccacttttccacgccttgtggtattcctctatcagccagcgtcgctcgtaatggctgacgatacgtcgcgcatcggcggcactcgccactttttctgatgtcagcagatgccagcaggcaccgtcctctgcctgctcccggcaacagacatacgtgagcgggagcgcctggccgctgttgtcgcgatttttatgctgacttcgctgtacctgatgaacatccgggcctggcgggctgcccgccctcctttttgcatcacattcagcgtgtggcttcccgcggttgccaggacttccggcagttcgaagagcttgccgggtgcttcttccagccggctattctgtgcagcacgcaccacgaagcgctgtccgtggctgactttataatgcaggtaatgccagatatccgcttcccggtcacagacagtgattacccgtttctgtatctcccccagccgttcggccatacgctccgaagcctgctgccagcggtaactttctttttcttcacagggacgttcttttcgctggtgcttaacaccgtaggtgtccgtgacccgactccagcgctgctgttcgataaaaccgactggcagggcgctgtcaggggcgtacatcaggacagagtgagccagcagcccgcgcgtcttcgggttagtggtggtattcccctggtcatcagatgccgtactgtggctgaagttaatggtggtggtgtcttccagtgcgaggagcagcggatgagcctcacatacccttacagtggcggtaaatccggcttcggcaatggcttgcggggacacagacgggttatgtatcaggcggtacgcaccttcaacctgagcagtggactgggatgatttcacaatagaaagacctgcatgctgagcgagagaagaggtcagtgacacaaggcgtcgtgtacgacgcggatcaccgagacgggcatgtccagactgctcgttatcccatgaataacaatcagaaagtaccataacagacccgaagaaaatgaaatataagaaaagatcaacgagtgaagaaaaagttcaaaaaatggctgccggggaggaaggaaagtaccggatggaaagagtcccccctaaagcagactgacagacataacaaatccccggggggatttgtgtataagagacagtacttatctggaggtaattgcaatatctctgtgaacttacacagggtgggcttaccgcatacactgacacttagcggatcgacagaacattattaacagagcatcactgaacgctacataatcagagttgcacaaataaaatgttatgatataacataacaatcacaacatttgttttcgaatgtatatgaatgtaatcagaactgtcatttgtacattaattatacttccggtgggactacaggcagcgaccagtcattcttctatggttaaagatacaatcaccattgtcgcgacaggaaatcagaacacggtatttgaaacgccgtcgatggtcagtgtcgtcacgaatgacactccgtggagtcagaatgcggttacatcggccggcatgctgaaaggtgttgccggtctcagccagactggtgcaggacggaccaatgggcagacctttaatttacgcggctatgacaaaagcggggtacttgttcttgttgacggcgttcgccaactcagtgacatggcaaaaagcagtggcacttatctggatccggcactcgtcaaacgtatcgaagttgtccgcgggccaaactccagtctgtacggcagtggcgggctgggaggtgtagtggacttcagaactgccgatgcagcagattttcttccccccggagagacaaacggtttaagtctgtggggaaatatcgccagtggtgaccacagcacaggctcggggctcacctggtttggtaaaactggaaaaacagatgcgctcctttctgtcattatgcgtaaaagaggtaatatctatcaaagtgatggtgagcgcgcacctaacaaggaaaaacctgcagccctgtttgcgaaaggctctgtcggtataacagacagtaacaaagcaggtgccagcttgcgtctctaccggaataacaccactgaaccgggcaattccactcagacacatggtgacagcggcctgcgtgacagaaaaacagtacaaaatgacgtacagttctggtaccagtacgctcctgtggataacagcctcatcaatgtaaagtcaacgttatatctcagtgatatcactatcaagacaaacggtcacaacaaaacggcagaatggagaaacaacagaacctccggtgttaatgttgtcaacagaagtcatactctgatttttccgggagcccatcagttaagttatggcgctgaatattaccgtcagcagcagaagccagaaggctctgccacactatatccggaaggaaacattgactttacatcgttgtatttccaggatgaaatgacaatgaaaagctacccggttaacattatcgtcggttcccgctatgaccggtacaagagcttcaatccccgtgccggagaactgaaagccgaacgcctgtccccaagggcggcgatttcagtctcaccgacagactggctgatgatgtacggctccatatcctctgcattccgagcgcccacaatggcagaaatgtacagggatgatgtacatttttaccgcaagggtaaacccaattactgggttcctaaccttaatctgaaaccagaaaataacatcacccgtgagattggcgcaggtattcaactggatggcctgcttacagacaatgaccggctgcagttaaaaggcggatatttcggaacggatgccagaaactatattgccacacgcgtggatatgaaacggatgcgttcttattcttataatgtatcccgggcccgtatctggggatgggatatgcagggtaattaccagtctgattatgttgactggatgctttcttataaccggacggaaagtatggatgccagcagcagggaatggctgggctccggcaatcctgacacacttatcagtgacatcagcataccttttggtcatagaggcgtttatgccggatggcgtgctgaactttcagcatcagccacgcatgtgaaaaaaggcgatccccatcaggctggttataccatacattccttttcactgtcttataagcctgtaagtgttaaaggctttgaggcgtcagtaactctggataatgccttcaacaagcttgccatgaatggcaaaggtgtgccgctttcaggcagaactgtcagtctttatacccgttatcagtggtaacctcgcaggaaataaatcatgatgaaaaatacaggctatatcttagctctttgtctgacagcatcggggcatgtcctggcccatgatgtctggattacaggtaaacagtcagagaacaacgttaccgcagagattggttatggtcataatttcccctcaaaggggacaattcctgacagaagggatttctttgaaaatccccggctttataacgggaaagagacaataacactgaagccagcgtccacggattatgtctataaaactgagtctgcaagcaaagataatggttacgttctgtcaacgtatatgaaaccaggatactggtcgagaacctcgtcaggatggaaaccggtcagccgggagggcagaaatgatgtggcttactgtgaatttgtcactaaatatgcaaaatcttttattcttggtgaacagcagatgccagcacaactctatcagtctccaacagggcatgagcttgaaatcattccgttatccgatataagtcgtttcagtgaaaatgtgaagctgaaagttctgtataaaacgtccccgctcgccggagctatcatggagcttgactcggtcagttatctgacatcatcccgtcatactcatgcagttgagcacaaacatcctgttcataaagcagaactcacctttgtaactaatgaggatggtatcgtcacagtaccttctcttcatatcggacagtggctggcgaaagtccaaaataagaaaagttttcaggacaaaagcctgtgtgatgaaactgtcgatgtggcaaccttaagcttctcccgaaattaatgatactattcctgccctgtattttacgggcagggtatatcaaccggaaatagcctactgacatccatgtaaaaaaactcataattattttgttgatgtatcttacctaatacattggtagctccagtttttataccagagcattctcgttgtccctatgtacttgtctgtaatatcactgatatgcaggaataatattcttggcatggagtcagttccccgtcatcttaggtatcactttaactcacaggtgtccagtaaatatgaacaggatcccagtaatcattatcaatggtttccttggcgcaggaaaaaccactcttatgaaaaacctgctcacacaggcaaacaggaatcacttagctgtatctgtcattgtcaatgatatgagcgatctggatgttgatggtgtacttattgcaaatacagaaatcgttaatattgcgaacaataatttcgtgagtatcacatctgatagtatcagcagccagagtgggattaagacggtcgacaaggcaattaaaaatatgctcaggcattatttgcctgacgttatatttgtcgaaacatccggaggtagccacccactgccattaattaagtatctgcagactcatgagcgattacagctaaaatcacttttatcacttgtcgataccgttatgctcaatgatgactataacggagggaaagcactgatacctgcatttcaggagaatcttttccatggcaagcgcagaatagagaatttactggctgagcaaatcatgttttgtagcactttgctgttaaccaaaaaggatcgactgtcattcgacattgtcaccgatgtggcgaaagcaatccatcctctgaatccttacgtaaatgtgatagctgtgtcatgggggaaccttaaactagcagaattactaacccttccggattacgattttaaccgggtcggattacttatcagagaactggaagacacaatcacagtagaagaagcaaaaatttcagcccaaaatggcgaaataatttcgcgagtgattaaagatgacaggccattccacccacaaagattatgggaaacctatcattattttatgggaatgggtatttatcgtagcaaaggctttttctggctaccaggaagacctgacatggctctgctctggaaccaggccgcaggaagtatcaatctggagtttatcagctactggaattccggtgtattggcagaccctgataatcacctgacccacgaagagcgctctgttttgcagaaaaaagtcaataaaactatggggcggtttggagacaggagatgccatttaacgattatagggcgttctgatgaagtccatgattttacctccgccttaattaactgttttctttctgaagaagaaattgtctggtggcaatcaggtggcgttttcgcggatccctggcccgttaatatatcccggctgaactgatgattaacgcgatattgcaaatatggcatatgaatcgatcgtagtttggcattcgaatcgatcatgatttgggtaaacgttcacggagcgccgtattgacgtttatttattgggtgagtacgacgttccatggcaggagttcatcaacacggttagaaggccattccggcaggacgttgaggatatggcgcagatacgcttccggatcgataccgttcagtcggcaggcgccgatcagcccgtacagcagcgcactacgctctccaccgtgatcgttgccgaagaacatgtagatgatatgacctttatatactcactatagcattggtgggatattccagaggaggtcatcatgcattcggaaaatattgcggcttacgtcgggctggatgtgcataaagccccctagcagttgctattgttgcatctgaacggcttggcaaggttcgttattatggtatggtacgattaacaacgaagcccagtctgtacgtcgattatttcagaaattgcagggactttacggaaacattctttcctgctatgaagctggcccctgtggttttgggctatatcatcaactcacagcgatgaatataaaatgctaggttattgcctcttcccagatagtaaaatcaccgatagacaggatcaaaaatgatcatcgggatgcaaccgctaccgtttgcctcgttctggaaataaccttgctgatggggtatggtttggtacgttgtggggatttgtatgtggttttcttcatggaaagacagtggtatgcaaccgggcgttgcatttgtctcaagcatagtcgcaggcatttgctttggtgttctcatggctgtgtaccattagtgtcgaaaggtagttaacaatcttccagactgggacagtctggagtaaagatctttgtagaggctatatactttttaaatggactgggggtgagatgggaaaaataaaatattggctaatagtaggatttattatactttttgcgattttttacattgctattagtgacagggattctacgctttctaggttgaaatcagcaggtgaaaacggagatgtagaagctcagtatgctttggggctcatgtatttgtatggagaaattctggatgttgattatcagcaggcaaagatttggtatgaaaaagccgctgaccaaaatgatccgcgtgcgcaggccaaactcggtgtgatgtatgcaaatggtctcggggtaaatcaggattatcagcaatcaaaattatggtatgaaaaggcggctgcgcaaaatgatgttgatgcgcaatttttgcttggggagatgtatgacgatggtctcggggtaagccaagactaccagcatgcaaagatgtggtatgaaaaagcggctgctcaaaatgatgagcgtgctcaggtcaatctcgctgttctatacgcaaagggtaatggtgttgaacaggattatcgacaggccaaaagctggtatgaaaaggctgcagctcaaaatagtcctgatgcgcagttcgctcttggaattctgtatgccaatgctaatggtgtagagcaggactatcagcaggcaaaagactggtatgagaaggcagcagaacaaaatttcgccaatgctcagtttaatcttggtatgctctattacaaaggtgagggtgttaaacaaaactttcggcaagccagagaatggtttgaaaaagccgcatctcaaaatcagctgaatgcccaatataatttaggtcagatttattactacggtcagggtgtgactcagagctatcgacaggcgaaatactggtttgaaaaagcggcagagaaaggtcatgtcgatgctcaatataatctcggtgtaatatacgaaaatggtgaaggtgtgagtcagaactatcaacaggcaaaggcttggtatgaaaaggcagcctcacaaaatgatgcgcaggcgcagttcgaacttggcgttatgaatgagctgggtcagggtgaaagcatagacctgaaacaagcaagacattactatgagcggtcatgtaataatgggcttaagaaaggttgtgaacggttaaaagagttattagacaaatagatattataatatttattatatgaggttgtgaattaatggcaatccctgaacgtatgagccccgtaaaagtcagcagcaaaaaaataagagaattagcacagaaagctaaagagatacttgcagctattgatagtggagcaagtgaagaagatgcttttttaaaggacatgatcgatgactggaacagtcaggtagtatgtccatgtgagttttcagattttagagattattcctcttggacaaatgcaaatgaatttacacgaatagcttttaatttggaaaagttctacgaggattttacttgggaggaactggttcaaacgataagctgtgtatgtgatccaaagtcaaacgaatcggaaaaaattttgctcttttgttgcttgaaaagaattttcatggaaatccatctgatcttatattctggcccgatgaatggtttcaggatccagatatgttagatgttgaactgagtgttgaagagattgcatgctatttgatggttcgatccggtaggcaactagttgatgcacctgaaatcgacctgaaatatcaaatacccaagtctaacgaataaaaaattaacataagtgtagataaatagttatgagcaattacaggaaaaacaagtgtgaaaaagctgatattgccctgtaaatttaattaattataatgtcccacacttacatggtggagaatatcattgggggcggagtaagaataaaagagttaattctgagcatccatacattttacctatgtcaggtaaaataaactatgggcttgattattcaccattattcatgtttctactaagaaaaacaggtgaaaaatcggattaagtttatagtaaagcgattctacgactcgatctgcctgatccaaccttcttgctagttgctctacacgaaacagaccaaagaaattttgttcggtgcggcaaatccagttattacaatgggctgtatgttgatgagaatggttacttgaaatgttttctccagatttaaaggcatcaggcataccaataattatgtaagtgctgtacttacactctaaacgggaaattattaaatgaataagttgaaatttttctgaccttattaacttaaagaatagatgcatcaattgttttatttcagggcgttaaacacattgcatttataattatgcaaaatttaccaatgttttaacagattcgatagcagctattgttgttttcggagtttggccctgagctgtccatgcctttttagaattatcagtatcaatagatggtaatacctccaattagttgaattaggggtataatagttgcttttaaggttcttccatggtcacagttaaccttcattgtccccgttgccagcccgttcaggtttaccgtccaatagagttatacttagctgaacctagatttttagcttcgggtatgtaaaaataggtattaagaagattgctaaatttattgataataacttaaactgtttttagggagcataattaaatgtaattttaggtttgtaattcattatgtttttttgatatgcaaaaatataatgcgagtagaggtacgataaataatatacaaaacattaatacgaataagaataaattccttgatgatccagtatcactaaaaaatctatcccaggatttctttgatattatcttttgcgctgatatttctaaagcataatatgcaaacgggtatgctacagcaccaatagcaaggtatgcagcaacataaggtatataaggaacataagaaggaaatatctttccatcctttaaatcagtcaaaatgttgtaaaccaaagagccacaaccgactaagccccataaacaatgtctgagatagtatctaaatgtcatattatatacattaatgatatgaaatagggtacatgtggattcaagtaggcagtttccgcaaactgaaagccattaactctgataggccgccatgagtgggccatttgggttttgcccatgatcacagtcatagttctggaaaatggctgtgctctttaaataaatgtctttaactcctcagtgtttatattcgccagcattgaagcctttaaatgtgggaatgtacgaggtatctggaaatcagtttaaaacctttggtatattccagccatcttggcaagtccccggttccgaaaaaccaagcgttacaatcgtaatcagtattataccagttttcaagcaaatgcagcctgtacggttgaacaatatctgatgtgagtttttctctggggtctggttcaccagcaaaaagctcaagcgaaaagtgccctgcaagtccttcagagactatgacttctcctaaagttgagccgtatctcggcccatctaacagcacgatgcagttcatgtgcaaacattcgagcaatggagtgcgcataatttttgcaaaattatggattttctggagctactgttctatagacaactccagcttcagggtaaaaaccaagatgccctttctccgggaggacaagtttccctactttaaccaccacgtccagtgaaggaatcggcattaaccttttaactagttcgtaggtatcagtcaggttgatttgaagccattcatagtgagcagtgagtttcttttgggtattaagaaaatagaggggcatttgagacataacggtaccactcaaaagagtcagtaaatcgctacatgttaacacacaacgtaaatgttgtggtgtaagcacagtagtagaggaccagactgttacccatcatacctgctcttagggcagagcaaacccaaaccatcaaaatagctctggcttttgtgtcatagctgtctcaggttaagtctgagctaatatattaattaaaacagtccattcgccatgtattattaaatagttagttaccatttgataattaatatgaaattacttcacaggaatctctctattattatttattcgtttttatccttcaggtaataggtcttcatataggtcaagcgatgaccattaaacatatagcctgggttaataaagtaatagttctgtatcatggtctctgcaataaacttcttgtcagcaagttctttcatgcctttgaaatattttttctggatatttttacaacatcttgatcgacaatattccatatggctggaaaatttttcgctgataaaacggtagaaaagtgcgcccaaaatgtactgtttaaaatcttatccgtcgacagaccctctgacatcattgaccatttgccctacctggtgttgcagccctgctcgttattgaatgcctgtcatttttaattcgttttcctggttcaggtatgaatcatcaggggctattctacagcaaacgcgtggctcaggtagcccgtaagtaagtcggtggactccgggttattcatggcagggaggcgtggccgaatacttctctcctttgctgtatgtctggcacatcctaaataatttcagacatatattatctccgtgaatcccccgcctcctttcctgtgtgcggggttttgtcttttttcaccgggaatacatgtatgaatccgtctgatgccattgaggcaattgaaaaaccactttcttccctgccttactcgctttcccgtcacatcctggaacatctgcgcaaactcaccagtcacgaacccgtgattggcattatggggaaaagcggggccggtaaatcctcactctgtaatgcactgtttcagggggaggtcaccccggtcagtgatgttcacgccggcacccgggaagtgcggcgcttccgtctgagtggccatggtcacaacatggttatcactgacctgcccggggtgggcgagagccgggacagggatgcagagtatgaagccctgtaccgtgacattctgcctgaactggacctggtactgtggctgattaaagccgatgaccgtgccctgtctgtggatgagtatttctggcgacacatcctgcaccggggacatcagcaggtgctgtttgtggtgacgcaggccgacaaaacggagccctgccatgaatgggatatggccggtattcagccttctcctgcacaggcacagaacattcgcgaaaaaacggaggcggtattccgtctgttccggcccgtacatccggttgttgccgtatcggtccgcaccggctgggaactggatacgctggtcagtgcgctcatgacagcgcttcccgaccatgccgccagtcccctgatgacccgcctgcaggacgagctgcgcacggaatctgtccgcgctcaggcccgtgaacagtttaccggtgcggtggaccggatatttgacacggcggagagcgtctgtattgcctctgttgcatgcacggttctgcgtgccgtccgtgacacggtggtctctgttgcccgcgctgtatggaactggattttcttctgaacactctgccaggggaaatgcctgattacattgcgttaaccaactgaaaacatgacacaaacacctcatacccctcctgtttctcttgcgtggctgccttgttattaatagaataaaacgatcgataaaacaggtatcgatcgttaccatcgatcgtttatagtggttaatggcctgcgaaaaggcagctgaatctcttcatcatgcagaacggaattgcacacaacggactgatacttctctggcggatgagagaggggaagcatttatgtccgggaaaaaccactttatctgaccatgctgttttgtacctgccggtatccacatttgtgggtaccggcttttttattcaccctctgtaaggaaaagctgatgaaacgacatctgaacaccagctacaggctggtatggaatcacattacaggcaccctggtggtggcttccgaactggcacgctcacggggaaaaggcgccggtgtggcggttgctctgtctcttgctgctgtcacgtcagtcccggcactggctgctgacacggttgtacaggcgggagaaaccgtgaacggcggaacactgacaaatcatgacaaccagattgtcctcggtacggccaacggaatgaccatcagtaccgggctggagtatgggccggataacgaggccaataccggcgggcaatggatacaaaatggcggtatcgccaacaacactactgtcaccggtggtggtcttcagagagtgaatgccggaggaagcgtttcagacacggttatcagtgccggaggcggacagagccttcaggggcaggcagtgaacaccactctgaacggcggtgagcagtgggtacatgaaggcgggattgcaacgggtaccgtcattaatgagaagggctggcaggccgtcaaatccggtgcaatggcaaccgacacggttgtgaataccggcgcggaaggaggaccggatgcggaaaatggtgataccgggcagaccgtctacggagatgccgtacgcaccaccatcaataaaaatggtcgtcagattgtggctgctgaaggaacggcaaataccactgtggtttatgccggcggcgaccagactgtacatggtcacgcactggataccacgctgaatggggggtaccagtatgtgcacaacggaggtacagcatctgacactgttgttaacagtgacggctggcagattatcaaggaaggtggtctggcggatttcaccaccgttaaccagaaaggtaaactgcaggtgaacgccggtggtacagccacgaatgtcaccctgacgcagggcggcgcactggtcaccagtacggcggcaaccgtcaccggcagcaaccgtctgggcaatttcactgtggaaaacggtaatgctgacggtgttgttctggagtccggtggtcgcctggatgtactggagggccattcagcctggaaaacactggtggatgacggcggtaccctggcagtgtctgccggtggtaaggcaacagatgtcaccatgacatccggtggtgccctgattgcagacagtggtgccactgttgaggggaccaatgccagcggtaagttcagtattgatggcatatccggtcaggccagcggcctgctgctggaaaatggcggcagctttacggttaatgccggaggactggccagcaacaccactgtcggacatcgtggaacactgacgctggccgccgggggaagtctgagtggcagaacacagctcagtaaaggcgccagtatggtactgaatggtgatgtggtcagtaccggcgatattgttaacgccggagagattcgctttgataatcagacgacaccggatgccgcactgagccgtgctgttgcaaaaggcgactccccggtaacgttccataaactgaccaccagtaacctcaccggtcagggtggcaccatcaatatgcgtgttcgccttgatggcagcaatgcctctgaccagctggtgattaatggtggtcaggcaaccggcaaaacctggcttgcgtttacaaatgtcggaaacagtaacctcggggtggcaacctccggacagggtatccgggttgtggatgcacagaatggtgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatgcctccatgctgacacaggcaatggactatgaccggattctggcaggctcccgcagccatcagagcggtgtaagcggtgaaaataacagcgtccgtctcagcattcagggcggtcatctcgggcacgataacaacggtggtattgcccgtggggccacgccggaaagcaacggcagctatggcttcgtccgtctggagggtgacctgctcagaacagaggttgccggtatgtcactgacgacaggagtgtatggtgctgcaggccattcttccgttgatgttaaggatgatgacggctcccgcgccggcacggtccgggatgatgccggcagcctgggcggatacctgcatctggtacacacgtcctccggcctgtgggctgacattgtggcacagggaacccgccacagcatgaaagcgtcatcggacaataacgacttccgcgcccggggctggggctggctgggctcactggaaaccggtctgcccttcagtatcactgacaacctgatgctggagccacaactgcagtacacctggcagggactctccctggatgacggccaggataacgccggttatgtgaagttcgggcatggcagtgcacaacatgtgcgtgccggcttccgtctgggcagccacaacgatatgaactttggtaaaggcacctcatcccgtgacaccctgcacgacagtgcaaaacacagtgtgcgtgaactgccggtgaactggtgggtacagccttctgttatccgcaccttcagctcccggggagacatgagcatgggtacagccgcagccggcagtaacatgacgttctcaccgtcccggaatggcacgtcactggacctgcaggccggactggaagcccgtgtccgggaaaatatcaccctgggcgttcaggccggttatgcccacagtgtcagcggcagcagcgctgaaggttataacggtcaggccacactgaacgtgactttctgataatcaggtcactccccttcaggccccggtcattatgaccggggccttttactttcagggatcaacagatatgccgggttgtgcatcacgtttattgcccgaagccccttttgctgccaaatggcatctgaattgatcacagtctggccggttattacccgatggggatattgggtgatctccttccatgaaaatacgcagctcaccagtgaagggcttctcagacaataaacgtcattcatttcatttgtcaggccgcgtcttctccgggagacgtggctttttcatttattacaccagtaaatcttaaccaccgataaggagcaaattatgcgactagccagtcgttttggttatgctgcaaaccagatacgccgtgaccgtccgctgacacacgaagaactgatgcactatgttcccagtattttcggtaaagaccggcatacttcccgcagtaaacggtatgcgtacattcccaccatcaccgtgctggaaagtctgcagcgggaaggctttcagccattcttcgcctgccagacctgtgtgcgcgacccgggccgccggggatacacaaaacacatgctgcgcctgcgccgtaacggagagataaacggagaacatgtccctgaaattattctgctcaactctcatgacggtacctccagctaccagatgctgccgggttacttcaggttcgtctgccagaacggatgcgtctgtggtcagtctctgggggaagtgcgtgttccgcaccggggaaatgtggtggacagagtcattgaaggggcttacgaggtggtgggcgtgtttgaccggatagaggagaagcgtgatgccatgcagtcgctgattctgccgccaccggcacgccaggcgctggcacaggcggcactgacttaccgttatggtgacgaacatcggcccgtcaccaccgccgacattctgacgccacgacgccgggaggattacggtaaggacctgtggagtacttatcagaccatccaggagaatatgctgaaaggcgggatttccggtcgcagtgcaaaaggaaaacgtatccacacccgtgccattcacagcatcgacaccgatattaagctcaaccgcgcattgtgggtaatggcagaaacgctgctggagagcctgcgctgatgcagcatgtccctgaaggcgtgattcaggcaccagaatcacccgacgccccggaggcgctgccggggtgtcgttccatttctgatgatgacctgtgcgcctggtgtacccgtctgctttaccgtcccggagaaatcagtctgtgcagactgagtacaggcaatggcatctggccatccgtctgtgaccggaacggttacgcgtacggctgtccggaatttcagccgaatatcattcatccctgatattaccgggtctcacggtcagtgatgaacgtgatgttgccagctcccgacctttactccctctcatttattcacattacaaggatttcatacatgaaaacattgtctcagaacaccacctcttcggcctgtgcaccggagactggcctgcaacaactggttgccaccatagtccctgatgaacagcgcatcagcttctggccgcagcattttggcctcattccacagtgggtgaccctggagccccgtgtcttcggctggatggaccgtctgtgcgaaaactactgcggtggtatctggaatctgtacaccctgaacaacggcggggcatttatggcccctgaaccggatgactatgatgacgaaacatgggtactgttcaatgccatgaacggtaaccgcgctgaaatgagcccggaagccgccggcattgccgcctgtctgatgatgtacagtcatcacgcctgccgtacggagtgttatgccatgacggttcattattaccgtctgcgggattacgccctgcagcatccggaatgcagcgccattatgcgcattattgactgaaagggggcaggaacaatgcaacagctttcctttctgcccggagagatgacgcccggcgagcgcagtctcattctgcgggccctgaaaaccctggaccgccatcttcatgaacccggcgtggccttcacctccacccgtgcggcacgggaatggctgattctgaacatggcgggactggagcgtgaagagttccgggtgctgtatctgaataaccagaatcagctgattgccggtgaaaccctcttcaccggcaccatcaaccgcacggaagtccatccccgggaagtgattaaacgcgccctgtatcacaatgccgcagccgtggtgctggcacacaatcacccgtccggtgaagtcacccccagtaaggcagaccgccttatcacggaacgtctggtacaggcactgggcctggtggatatccgggtgccggaccatctgatagtcggtggcagccaggttttctcctttgccgaacatggtctgctttaacccgccacaaccacatcacacctgttttcacttttatcttctgtcttcagaggtatcccattatgaaaatcatcacccgtggtgaagccatgcgtattcaccaacagcatcctgcatcccgtctttttccgttctgtaccggcaaataccgctggcacggcagcactgaaacgtataccggtcgtgaagtgcaggatattcccggtgtgctggccgtgtttgctgaacgccgtaaggacagttttggcccgtatgtccggctgatgagcgtcactctgaactgagtcagtaagggcattctgatgagcagaattatcaccaccaccgtgtatacactgcatgagctatcctccaccgcacaggaaaaagcccgcgactggtaccgtcagcatcatgctgacagcaactggtatgaaaacgtgtatgaggacttcagggaggtctgtggcattttcggaattgacctccgccagcgcgttttccggctcagcaacggcaggtttatggaagagccgtgcatctggttcagcggattctgcagtcagggggacggagcctgttttgaagggcgctggcactggcagccagcgacaccccggaaaatcagggaatatgcccctcaggaccgtgagcttcatcgtatcgcggatgccctgcaggcggtacagaagcgtaacttctggcagttacaggctgaaatcagtcaccggggacgttactgccatccgtacagcatggatatcaccgtcacccggaacagtccgactggtcaggcactgacagccgatgcggaagccgctgtcagcgaagccctgcgcgacctggccttctggctgtaccgccagctggaaaacgagtacgactggctgacctcagacgccgctgtagatgaggccattcacatcaatgcatataccttcaccgaagccggtctccacgccggctgacctgtcatcgttaaactatcattcaccaattttttgtgaggattttatcgtgtcagacacactccccgggacaacacttcccgacgacaatcacgaccgcccctggtgggggctgccctgcaccgtgacgccctgtttcggggcacgtctggtgcaggagggtaaccggttgcattaccttgcagaccgcaccggtatcagaggccggttcagcaatgcggatgcataccatctggaccaggcttttccactgctgatgaaacaactggaactcatgctcaccagcggtgaactgaatccccgccatcagcataccgtcacgctgtatgcgaaagggctgacctgcgaagctgatacccttggcagttgtggttacgtttatctggctgtttatccgacaccggcagcacccgcaatcaccgtataaccccggatatctcccctttatcaccacctgttacagagaacttaagatgaatacattacccgacactcacgtacgggaggcatcgggctgcccgtctcccgtcaccatctggcagacactgctcacccgactgctggaccagcactacggcctcacgctgaatgacacaccgttcgctgatgaacgtgtgattgagcagcatattgaggcaggtatttcactgtgtgatgcggtgaactttctcgtggaaaaatacgcgctggtgcgtaccgaccagccgggattcagcgcctgtacccgctctcagttaataaacagcatcgatatcctccgggctcgcagggcgaccggcctgatgacccgcgacaattacagaacggtaaataacataaccctgggtaagcatccggaggcgaaatgatgaaactggccctgacgctggaagccgacagcgttaacgtacaggcactgaacatggggcgcattgtcgttgacgtcgatggtattgagcttgctgaactgattaacgtggtctgcgataacggtcactcccttcgtgttgttgatgaatctgaccgagcctcaacagactgcacgccaccatttgctgccctgaccggcatacgctgcagtaccgcgcatatcacggcaaaagacaacgcctggctgtactcgctgtcgcatcagacgaatgacaccggcgaatcagaatggattcattttacaggcagcggatatctgttacgtaccgatgcgtggtcatacccggttctgcggcttaaacgcctgggcctgtcaaaaacgttccgccgcctggttgtcacactcatccgacgttatggcgtcagtctcattcatctggatgccagcgctgaatgcctgccgggtttacccactttcgactggtaaccatgaacaacatgaaatcattaaccacggaaaccgcactggatattctgattgcgtggctgcaggacaatatcgactgcgaatcgggaattatctttgacaacgatgaggataaaacagattcggcagcactgttgccctgtatcgaacaggccagggagggtatccgtaccctgtgccaactgcagcttctgcaccagaaccgatgagtcttactcattcactcaccagacttcattccaatgacgtcagcctgaacagggctggcgttttcgtttataaaccaaaaggaaaaacgatgatgtcagatatcacaatctcccgcctggaagtggtcaacggacatacggacattatctgctccacctcagtcagccacattctggctgtgcgaaagactacactgctgcaaatcgacacacttatccggcaactgactgaaatatcagcaatgacagaaagtattggcggtaaaaccgcactggactgggccatgaaacaggattttcgctgcggctgctggctcatggataaacctgatacagcaatgaaagctatcacccgcaatctcgatcgcgaaatctggcgtgacctgatgcaatgctccgggatgctttccttaatggatgcacaggcccgtgatacatggtaccgatcactggagtacgataattttccggaaatcagtgaagagaatattctgagtacgtttgagcagctacaccagaataaggatgaagtgtttgagcgaggagtgatcaacctcttcagagggttgagctggaattacaaaaccaattgcccctgtaaatttggcaataaaattatcgtcaacaatctggtgaggtgggaccggtggggattgcatcttatcaccgggcaacaggcagatagacttgccgacctggaaagaatgctgcatctgttcagcggcaaaccgatccccgacaacagggaaaacataactattcatctggacgaacatatccggtctcttcagggaaaagaatgctatgaagatgagatgttcattattaaatactttaagaagggctctgcgcacatcacgttcaggaagccagaactggttgacagactgaatgatattatcgcaaaacactatcctgatatgctggcagtatagctttgccagtatgctcaaagatcggaaattgtccgataagatatgatcgtggggcatataaaccggtttcagatggcatacccggtggcatactgtctggaaggataaataaaaaagcgcatgttaaacaataacatgcgcttgtaatctggcggtgagggggggattcgaacccccgatacgttgccgtatacacactttccaggcgtgctccttcagccactcggacacctcaccaaattgtcgttcctgtcttgctggaacgggcgctaatttagggaaatcatgacctgaggtcaacaaacttttttaaaaaatcgctcgattattcaaacttcaatcaatatgcagttttaataagcgaaatttgctttttttgccaccgaccacggatttgttatgctggtggcttttgtagatcataacgataagtgcgaataaattttgcgcaacgcttttcgggagtcagtatggatatcatcttttatcacccaacgttcgatacccaatggtggattgaggcactgcgcaaagctattcctcaggcaagagtcagagcatggaaaagcggagataatgactctgctgattatgctttagtctggcatcctccagttgaaatgctggcagggcgcgatcttaaagcggtgttcgcactcggggccggtgttgattctattttgagcaagctacaggcacaccctgaaatgctgaagccttctgttccactttttcgcctggaagataccggtatgggcgagcaaatgcaggaatatgctgtcagtcaggtgctgcattggtttcgacgttttgacgattaccgcatccagcaaaatagttcgcattggcaaccgcttcctgaatatcatcgggaagattttaccatcggcattttgggcgcaggcgtactgggcagtaaagttgcacagagtctgcaaacctggcgcttcccgctgcgttgctggagtcgaacccgtaaatcgtggcctggcgtgcaaagctttgccggacgagaagaactgtctgcatttctgagccaatgccgggtattgattaatctgttaccgaatacacctgaaaccgtcggcattattaatcaacaattactcgaaaaattaccggatggcgcgtatctcctcaacctggcgcgtggtgttcatgtcgtggaagatgacctgctcgcggcgctggatagcgggaaagttaaaggcgcaatgttggatgtttttaatcgtgaacccttaccgccggaaagtccgctctggcaacatccacgcgtgacgataacaccacatgtcgccgcgattacccgtccagctgaagctgtggagtacatttctcgcaccattgcccagctcgaaaaaggggagaggctctgcgggcaagtcgaccgcgcacgcggctactaataaagcatctggtttcctgctatccttggcgggaattgaatacaggagagagttatgtatcccgtcgaccttcatatgcataccgttgccagcacgcatgcatatagcacattgagtgattacattgcccaggccaaacaaaagggcattaaactttttgcgatcaccgatcatggcccggatatggaagatgcgccgcatcactggcacttcattaacatgcgtatctggccgcgagtggttgatggggttgggatcctacgcggcatcgaagctaacattaaaaatgttgacggtgaaattgactgcagtggcaaaatgtttgattcgctggatctgattattgccggttttcatgagccggtgtttgcgccgcatgacaaagcgaccaatacgcaagcgatgatcgccactatcgccagcggcaatgtgcatataataagccatcccggaaatccgaaatatgaaatagatgttaaagccgttgctgaagcagccgcgaaacatcaggtggcgctggaaatcaataattcctcttttttacactcacgtaagggaagtgaagacaattgtcgtgcggtagccgcagcggtacgtgacgctggaggttgggtggcattaggctcggattctcacaccgcgtttaccatgggtgaatttgaagagtgtcttaaaatcctcgacgcggtagattttccgccagagcgcattttgaatgtttctccgcgccgcttactgaacttccttgaatctcgcggtatggcaccgattgcggaatttgcagacctttaattactagtaatggaaatatattaatgaacgagttttctatcctctgtcgtgtgctgggttcgctctattaccgccaaccgcaagatcctttactggtgccgctgtttaccctgattcgtgaggggaaactggctgcgaactggccactggagcaggatgagttactgacgcgtttacagaaaagctgtgatatggcgcaagtctctgccgattacaatgcgttgtttatcggcgatgaatgtgctgtgccgccatatcgtagcgcatgggttgagggcgcgacggaagcggaagtgcgcgcttttctttccgaacgggggatgccattagcggatacgccagccgatcacatcggcacattgctgctcgcggcttcctggctggaagatcagtcaacggaagatgagagcgaagcactggaaacactgttcagtgagtatctgttaccctggtgtggtgcgttccttggcaaagtggaggcccatgcaactacgcctttctggcgcaccatggcaccgctaacccgcgatgctattagtgcaatgtgggacgagctggaagaagattctgaagagtaaatgtgatctgcatcactcataactgcaacagataatttgttgttgcataaaatgtgtgctcgatctcattcatggccgcgttttctgctatcatgcgcggcatgaacatacttctctctattgcaatcacaacaggcattctctccggtatctggggatgggtggctgtttccctgggcttactaagctgggcgggcttcctgggctgtacggcctactttgcctgcccgcaaggtgggctgaaagggctggcgatctccgctgcaaccctgcttagtggcgtggtgtgggcgatggtcattatttacggtagtgcactggcaccacatctggaaattctcggttatgtcataaccggtattgtcgcgtttctgatgtgtattcaggccaaacagctgctgctttcatttgttccgggaacgtttataggcgcatgcgcgacgtttgccgggcagggtgactggaaactggtgttaccttcgctggcgctcggactggtatttggttacgcaatgaaaaacagcggcctgtggctggcggcgcgtagtacgaagaccgctcaccgtgagcagcaaatcaaaaataaagcgtgaggggcactcacgctttcgcttaaacagtaaaatgccggattattaattccggcatttttatctatcaggattccggtggaaccgacatatggcggtatttcaccagaatgtcattctgccgttctgctttgttctgcaaatcccacagaccacggtcaataccatcattaatcaggaaaatgacccctgtttcgatagccgacatcaggcacagcataacgggttcgttcgaggtgtaacccacttccccttccagcaagcgctggtagtcaataaagcggaaaaccccggcctgaacttcataggaaagtatcgtcttactggtgttcaccgaggagaggatctcaccggtactcacattgacgacacgcaggttcacggcaatctgatcaagctggtattgcgtgtctgcaccgatcccaaaatatcttgccccaacaccgcccgatttgacgttgctttcataaccgataatcgaaccttcaaccatgatatttgccgccgttaaagattgcagcgggattcggttattaatggcaaccgtgccgttttcttgtgccgcacgaataatcttgcgctcgttaagcaggttttgtaagccctggcgctccagcggtataaaccagcgagaatctttcaatgccgtgaccagcattgccgtggcgctttgcggaacagcagtggagaagttacttgccgggtagggtttaaattgcccggtttcgtcctggatgttgtataccgaaacaaagatcttacccgtcggcgctggcagatgggtcaaatctttgtagctctgagcacgaggcattaatgtcggtctggcggcttctttaggcggggcggttaagcatccgctcagtaacatgacggcaaccaaaagaaataagcgctgcatgattattttccttatgaagctggggcttaaaaatcggttgagttattttgtaaacccgaaacctggatggtcgaggtttgtccggttttacgatctgtcacgttcaactgcaattgaccatcgcggttagcaatatcaacaatataatcgttggtcaccatgcggcccggtttaccggtattaatattcgacagtagcccacccaaaatttgtgactggatggcctgagtaaagttatctaacgccgagggcgtttcaataccaaagtcatcgttatagctcggatctttataagagttttgggcctgagcgctatttaacaaaaaagcgccattatttgggttaccaccaaagtttggattacggaactggaaagtcatggttccagcccaacttaatggcgaaataagcatgagtagaactactgcatgtttgacacgcattgcagcctccgaacaattttttatttaaaattcatcatgcgccaaatcgcccgtacttaataacgcctggtttatctggcgacgatttagtgcttcttcagtttgaatcagtgcaaagacgacagttttctcgaagtctcttttcaacggaaataaaaaagtctggaaaataacgtcctgattcaccgttattgtgatccagcttccccatcgtgcactgggcctttcattaatcgttaagttacccgtatagtcactttcccatttatcactaaaggctcggtaaaaatcatggccaatagatgaaacagtatggtcagttaacaatcccgggacttctacctcaacggcgtgaagattccctgcggcgaacagaaattctgccgccacaatccagcgtaaataacgtttcatggctttatcgcctgaggttatcgtttgcccaggaaaccgcttgtgtccggttttttacggctatcttcttgaaaagattataaagatgcgttttaaccgtattttcgctgatgaacaacgaacgagcgatctcgttattagacgcgccgatacgcagcttattcaggatctctttttcccgatgagtaaggagggctgattccgtgctgttataacgatagttacctgaatgcgtaatcaggtaactggcaagcttttgcgtaaagtagcattcgccgcgcaggacgccttgcaacccattgacaacacgttcttgatcctccatggcataaaaaacgccgttgatatgaggccagttttcaatgtcgcggtacgggtaatcttcaggcgtatttagcaacaatattttgatattgttgtttttcctgctcaaagtatcctgccaataatggataagctttttatccgcttccatcatatccagaagaataatagagcctgaagatatatcgtccagagaacgttgaatattatgtaattttcctgtaattgccagcgattgtttaaggtgctgcaagagagctgtcgcctgcaaagaaggtttagtgatcaacaataatgtatgaccatgaatactatggacttcattaaacatgatgaaaccccgctttttttattgatcgcacacctgacagctgcctctaaaatagaagcaccagaagtactgacagatgttgcactgctgtgtgtagtaataaatcagccctaaatgggtaaaatataaaactaatggattacatctgatttcaatctagccattacaaatcttaaatcaagtgttaaacatgtaactaaatgtaactcattatattaaaatgttaaccttaaggttttattaagtttataaatgatagaaaagttgtacatttggtttttattgcacaattttaaaaaatcatacaaatggtgctaacttactaataatgcatataaaaaatatttcgctgtagtcctttcgtcatgaaaaacgttcttgttttttctccataccaccgtggacaattttttactgcaaaaagacgagttttgtcacgacttgtgcgcaagacatatcgcagcaatcagcgacgggcaagaagaatgactgtctggtgatttttgatagcggaaaacggagatttaaaagaaaacaaaatatttttgcgtagataacagcgtatttacgtgggttttaatactttggtatgaacaaaaaaagaaaaatacaacgtgcgggtgagttattaaaaatatttccgcagacatactttccatcgtaacgcagcgttaacaaaatacaggttgcgttaacaaccaagttgaaatgatttaatttcttaaatgtacgaccaggtccagggtgacaacatgaaaaacaaattgttatttatgatgttaacaatactgggtgcgcctgggattgcagccgcagcaggttatgatttagctaattcagaatataactttgcggtaaatgaattgagtaagtcttcatttaatcaggcagccataattggtcaagctgggactaataatagtgctcagttacggcagggaggctcaaaacttttggcggttgttgcgcaagaaggtagtagcaaccgggcaaagattgaccagacaggagattataaccttgcatatattgatcaggcgggcaatgccaacgatgccagtatttcgcaaggtgcttatggtaatactgcgatgattatccagaaaggttctggtaataaagcaaatattacacagtatggtactcaaaaaacggcaattgtagtgcagagacagtcgcaaatggctattcgcgtgacacaacgttaatttccattcgacttttaaatcaatccgatgggggttttacatgaaacttttaaaagtagcagcaattgcagcaatcgtattctctggtagcgctctggcaggtgttgttcctcagtacggcggcggcggtaaccacggtggtggcggtaataatagcggcccaaattcagagctgaacatttaccagtacggtggcggtaactctgctcttgctctgcaagctgacgcccgtaactctgatctgaccattacccagcacggcggcggtaacggcgcagatgttggccaaggttctgatgacagctcaatcgatctgactcagcgtggtttcggcaacagcgctactcttgatcagtggaatggtaaagattctactatgactgttaaacagttcggtggcggtaacggtgctgctgttgaccagactgcatctaactccagcgttaacgtcactcaggttggctttggtaacaacgcgaccgctcatcagtactaatacatcctctgtattaaagaaacagggcgcaagccctgttttttttcgggagaagaatatgaatgcgttattactacttgcagcactttccagtcagataacctttaatacgacccagcaaggggatatgtacaccattattcctgaagtcactcttactcaatcttgtctgtgcagagtacaaatattgtccctgcgcgaaggcagttcagggcaaagtcagacgaagcaagaaaagaccctctcattgcctgctaatcaacccattgctttgacgaagttgagtttaaatatttccccggacgatcgggtgaaaatagttgttactgtttctgatggacagtcacttcatttatcacaacaatggccgccctcttcagaaaagtcttaatttgttgaaatatcgagcataagatgaacctggagagaatggtctgctgcggatcagccaacctgaaagtatggataacacaaccctcaaggatgactaatcattgaggaaatagaataaatgttcagaccttttttagactctctaatgctcggcagtatgttttttccttttattgccatcgcaggaagcaccgcgcaagggggcgtgatccacttttatggccaaattgtggaaccggcatgtgacgtcagcacccagtcaacacccgtagaaatgaactgcccgcagaatggctctgttccgggcagaacctattccagcaaagcgttaatgagcggcaatgttaaaaacgcgcaaatagcctcagtaaaagtgcagtatcttgataaacagaaaaagctggctgtaatgaacatcgaatataactaagtttctgaacaactcacgttgctgagcagaaaaatgcgatttaaccaaaaagcctgctgtacacttaagaaacaagaaggtgtaaggaggcgttatgaaaacgcgtattcatgttgtgcagggtgatattaccaaactggccgttgatgtgattgtgaatgcggctaatccgtcattaatgggaggcggcggcgtcgatggggccattcatcgcgcagcgggtccggccctgctggatgcctgtttaaaagtcaggcagcagcagggcgattgccctacggggcatgccgttattacgcttgcaggcgatcttcccgcgaaagccgtagtgcacaccgtcgggccagtctggcgtggtggtgaacaaaacgaagaccagcttttgcaggatgcctatctcaatagcctgcgactggtggcggcaaacagctatacgtcagtggcttttcctgcaatcagtactggagtttatggttaccctcgtgcggcagcggctgaaatcgcagtaaaaaccgtttcagaatttattacccgtcacgctttacccgaacaggtatactttgtctgttatgatgaagaaaacgcccacctctacgaaagactccttactcaacaaggagatgaatgatttgccccggctggcgagtgcggtgctgccactgtgttcgcaacatcccggtcagtgtggcctttttcctctggagaaaagtctggatgcgtttgccgcccggtatcgtctggccgaaatggcagagcatacgctggatgttcagtattacatctggcaggacgatatgtcgggtcggttactcttttccgccctgttagccgcagcaaagcgtggcgttcgcgtccgtttgttgctggacgacaacaatacgcccggacttgacgacattttacgcttgcttgacagtcatccccgcattgaagtccggctttttaatcctttctcgtttcgcttgctacgtccgcttggttatatcaccgacttttcccgtctcaatcgccgtatgcacaataaaagtttcactgtcgatggcgtggttaccctggtaggggggcgaaatattggtgatgcctattttggggcaggggaagagccacttttttcggatttagatatcatggcaataggaccagttgtagaggacgttgccgatgatttcgcccgctactggtattgcaaatcggtttcacccctacagcaggtgctggatgtcccggaaggtgaaatggcggatcgcatcgagttacccgcctcctggcatgacgatgccatgacgcatcgttatttacgcaaaatggaatccagcccgtttgtaaatcatctggttgatggaacgttgccgcttatctgggcgaaaacacgtttattaagtgatgatccggccaaaggggaaggcaaggcaaaacggcattcactgttaccgcagcgcctgttcgatatcatgggctcacccagtgaacgcatcgatattatctcttcctattttgtaccgacacgcgcaggtgtggcgcaactcttacgtatggtgagaaaaggggtaaagattgcgatcctaaccaattctcttgccgctaacgatgttgctgtcgtccatgccggatacgcgcgctggcgcaaaaaattgctccgctatggcgtggaattatatgaactcaagccgacgcgtgaacaaagtagtacgttacacgatcgcggcataaccggtaattccggtgccagcctgcatgctaaaacctttagcatcgatggtaaaacggtgtttatcggctctttcaatttcgatccgcgttcaacattgctcaatactgaaatgggtttcgtgatagagagcgaaacgctggcacagttaattgataaacgctttattcagagccagtatgatgcggcctggcagctccgtctggacaggtggggacggatcaactgggttgatcgtcatgcaaagaaagagattgttctcaaaaaagaacccgccaccagtttctggaagcgggttatggtcagactggcgtcgatattgcctgtggaatggttattgtaaacgcggcttaacgggctggtgctttatcgttctcacgcttaacaaccggtttaccagagaacaaaaacttcagtaacgggatgcgtaaatgaatttcatacagaattatcgcaatccctactacgaatatcaggccacagagaaaaccaagccagttggaggtgatgtgcggtgtaatgtacgcgccgaaaaacagcgttaacgggtggtgaaccagatagataaacagcgatgcgttaacaaagtaagtcacccgcgctgactggaagttaagcaaacggtggccgaaggagaagaccacattcaccatccacagaccgaggaccatggtgatcacagactcggtttcgtacatccaggcatcgccactgccatagcgctggttgagtaagtaagcgacaaatgccaatgctgctgcgaaggtacagccacgagacggcgtggtaaacaaggctttaagatgagggaaaatgaaagccagtgcgccgaggataaagaacggcaaataaaatagcgtttgcatgacaataaaattgaacatgccgttactcagaatgggcggatacacaataaaaattgttcttcttattaccgcataaccgatgccgaggcacaaaaaaatcaccgatagttttaccatcgagaattttttattcgttttatcagaattttctaaattatttctgatacgtttgaatatccagacgcacagcgtcgtcatgaccactaacaccagtaaaaaccacaggtgtgatattaattcccaggccaacgtattatatttgtcatacaatgacagtccaggccaactttccgctttccctttgacgtattgcagcataataaattgcggcaatgtcagtagggggatggctgttaacatcgggatacctacacgttcgacacgtactttccaccattttttcaagggatagcgtaaaaaaagcatgtaggaaaagtacccggatataacgaaaaatacctgcatgcggaacgagtggatgaagtcattaaaaagggtcagccataatgacggttcggcgctattcacatgccatgtatggctcgaatagattaaagaaatatgaaaagggatccctaacaacatcagccaggcgcggatggagtcgaggaaatattcacgttgcgcgggtactgggttcatatatggttaactaatctcggatttttcgtcttatccctgtcgggttatgcctttaggcttgttgccatagcgacaccgacctgaccgcgccaggcgcaggcttcaaggtttttatgcatagcatcatcgctaccactaaccagaatggaagcgtctgtaagacggttgataaataaatttgctggcaaaccctacacgaagtcgatgcttctgtctttaggagaagcacggaaagtgaaaacggttgcaatcaggtgcttaatccatgagccagtgtgctgaacgataccgggattctgttgtcggaatggcaggttatccattaaaatagatcggatcgatataagcacacaaagggggaagtgcttactaattatgaaacataaactacaaatgatgaaaatgcgttggttgagtgctgcagtaatgttaaccctgtatacatcttcaagctgggctttcagtattgatgatgtcgcaaagcaagctcaatccttagccgggaaaggctatgaggcgcccaaaagcaacttgccctccgttttccgcgatatgaaatacgcggactatcagcagatccagtttaatcatgacaaagcgtactggaacaatctgaagaccccattcaaactcgagttctaccatcagggtatgtacttcgataccccggtcaaaataaatgaagtgactgccaccgcagtcaaacgaatcaaatacagcccggattatttcactttcggcgatgttcagcatgacaaagacacggtaaaagaccttggttttgccggtttcaaagtgctttacccgatcaacagcaaagataaaaacgatgaaatcgtcagcatgctcggggccagctatttccgcgtgattggtgcaggtcaggtttatggcctttctgcacgcggcctggcaattgataccgccttgccatcgggtgaagaatttccacgcttcaaagagttctggatcgagcgtccaaaaccgactgataaacgtttaaccatttatgcattgcttgactcgccgcgcgcgacaggtgcttacaaattcgtagttatgccaggacgtgacacggttgtggatgtgcagtcgaaaatctatctgcgcgataaagtcggcaaactgggggttgcaccgttaaccagtatgttcctgtttgggccgaaccaaccgtcgcctgcaaataactatcgtccggagttgcacgactctaacggtctgtctatccatgctggtaatggcgaatggatctggcgtccgttgaataacccgaaacatttagcggtcagcagcttctcgatggaaaacccgcaaggcttcggtctattgcagcgtggtcgtgatttctcccgctttgaagatctcgatgatcgttacgatcttcgtccaagcgcatgggtgactccgaaaggggagtggggcaaaggcagcgttgagctggtggaaattccaaccaacgatgaaaccaacgataacatcgtcgcttactggacgccggatcagctgccggagccgggtaaagagatgaactttaaatacaccatcaccttcagccgtgatgaagacaaactgcatgcgccagataacgcatgggtgcaacaaacgcgtcgttcaacgggggatgtgaagcagtcgaacctgattcgccagcctgacggtactatcgcctttgtggtcgattttaccggcgctgagatgaaaaaactgccagaggataccccggtcacagcgcaaaccagcattggtgataatggtgagatagttgaaagcacggtgcgttataacccggttaccaaaggctggcgtctggtgatgcgtgtgaaagtgaaagatgccaagaaaaccactgaaatgcgtgctgcgctggtgaatgccgatcagacgttgagtgaaacctggagctaccagttacctgccaatgaataagacaactgagtacattgacgcaatgcccatcgccgcaagcgagaaagcggcattgccgaagactgatatccgcgccgttcatcaggcgctggatgccgaacaccgcacctgggcgcgggaggatgactccccgcaaggctcggtaaaggcgcgtctggaacaagcctggccagattcacttgctgatggacagttaattaaagacgacgaagggcgcgatcagctaaaggcgatgccagaagtaaaacgctcctcgatgtttcccgacccgtggcgtaccaacccggtaggccgtttctgggatcgcctgcgtggacgcgatgtgacgccgcgctatctggctcgtttgaccaaagaagagcaggagagtgagcaaaagtggcgtaccgtcggtaccatccgccgttacattctgttgatcctgacgctcgcgcaaactgttgtcgcgacctggtatatgaagaccattcttccttatcaggggtgggcgctgattaatcctatggatatggttggtcaggatgtgtgggtttcctttatgcagcttctgccttatatgctgcaaaccggtatcctgatcctctttgcggtactgttctgttgggtgtccgccggattctggacggcgttgatgggcttcctgcaactgcttattggtcgcgataaatacagtatatctgcgtcaacagttggcgatgaaccattaaacccggagcatcgcacggcgttgatcatgcctatctgtaacgaagacgtgaaccgtgtttttgctggcttgcgtgcaacgtgggaatcagtaaaagccaccgggaatgccaaacattttgatgtctacattcttagtgacagttataacccggatatctgcgtcgcagagcaaaaagcctggatggagcttatcgctgaagtcggtggcgaaggtcagattttctatcgccgccgccgccgtcgcgtgaagcgtaaaagcggtaatatcgatgacttctgccgtcgctggggcagccagtacagctacatggtggtgctggatgctgactcggtaatgaccggtgattgtttgtgcggcctggtgcgcctgatggaagccaacccgaacgccgggatcattcagtcgtcgccgaaagcgtccggcatggatacgctgtatgcgcgctgtcagcagttcgcgacccgcgtgtatgggccactgtttacagccggtttgcacttctggcaacttggcgagtcgcactactgggggcataacgcgattatccgcgtgaaaccgtttatcgagcactgtgcactggctccgctgccgggcgaaggttcttttgccggttcaatcctgtcacatgacttcgtggaagcggcgttgatgcgccgtgcaggttggggggtctggattgcttacgatctcccgggttcttatgaagaattaccgcctaacttgcttgatgagctaaaacgtgaccgccgctggtgccacggtaacctgatgaacttccgtctgttcctggtgaagggtatgcacccggttcaccgtgcggtgttcctgacgggcgtgatgtcttatctctccgctccgctgtggtttatgttcctcgcgctctctactgcattgcaggtagtacatgcgttgaccgaaccgcaatacttcctgcaaccacggcagttgttcccggtatggccgcagtggcgtcctgagctggcgattgcactttttgcttcgaccatggtgctgttgttcctgccgaagctattgagcattttgcttatctggtgcaaaggaacgaaagaatacggcggcttctggcgcgttacattatcgttgctgctggaagtgctgttttccgtgctgctggctccggttcgcatgttgttccatacggtcttcgtcgtcagcgcgttccttggctgggaagtagtgtggaattcgccgcagcgtgatgatgactccacttcctggggggaagcgttcaaacgccacggctcacagctgctgttagggttagtgtgggctgttgggatggcgtggctggatctgcgttttctgttctggctggcaccgattgtcttctcgttgatcctgtcaccgtttgtttcggttatttccagccgtgccaccgttggtctgcgaaccaaacgctggaaactgttcctgatcccggaagagtattcaccgccgcaggtgctggttgataccgatcggttccttgagatgaatcgtcaatgctcccttgatgatggttttatgcacgcggtgtttaacccgtcatttaacgctctggcaaccgcaatggcgaccgcgcgtcaccgcgccagcaaggtgctggaaatcgcccgtgaccgccacgttgaacaggcgctgaacgagacgccagagaagctgaatcgcgatcgtcgcctggtgctgctaagcgatccggtgacgatggcccgtctgcatttccgcgtctggaattccccggagagatattcttcatgggtgagttattacgaagggataaagctcaatccactggcattgcgtaaaccggatgcggcttcgcaataaaaacgtagttgcctgatgcgctacgcttatcaggcctacatcgttcctgcaatttattgattttgcaagattttgtaggtcgggtaaagcgttcacgccgcatccggcaaaaacaacgagccaataaaaataccggcgttatgccggtattttttacggaagaggtatcaaatgcgtttaattgtgatgagcataatggtgaccttgctgagtggctgtggcagcatcattagtcgcactataccggggcaggggcatggcaaccaatattatcccggtgtgcaatgggacgtgcgtgactccgcctggcgttacgtcacgatccttgatctgccattctccctggttttcgatactttactgctgccgatcgacgtacatcatggcccgtatgagtgattaacgttcatcccactcatcagctgcagtgcgtccttcctcggtatccagcggtggctcaagctgaaattccccctcgtcccattcatgtaatgtattctcatcttgccactcctggcggatctctatctcatcatagtcgccgtcaaagacactttgcgcggcttcaccgctaagcatgggtaaacattcaccttcttccccttcgtcggcaaaaaactcaacttgccacatgatgtcgccgtcctgcaaaacgtatttttgggcattgaactgttgcacattcgcgttttcggcatcgatgccggggttgtctgcaagaaattcttcgcgtgcagcgtcaatggcttcttcaagcgttgcgtacatggtcatcacgattctccctttgagttgatgaggtttcagggaaaaggatagctgattctccgcttttgcaagtatgaaaggcgaaaaatcagttcgatatctgggggattcgacgacgacgtagactgttccatgaatagactgcgttgaataacactacgccagcggtgacgagaaataccgccctgaaaccgtagttcgctgaaatcgctgctcccatcaatggtccggtaacgttgccaatatcacgaaacgattggttatagctgaagatacgcccggcgatctggttgctcgagttgtaaaccaacagtgtctgtacggcggggagtaatgcaccatcggcggcaccgagcaaaaaacgtaaaatcccaagttgtaatggcgtctgaacgtaagacattgggatcaacagcagtacagaaaagatcagcgccgtaatcaggatcttttcggggccgattcgatcgccaagtttgccgagtcgtggtgcacttagcagagccgccacgcctggcaccgaggcgatcatgccactgataaaagcgacgttactgacgttacccgccagttcgcggacatacagcgtcagaatgggggcaattgagcccgtcgccacctggatgattaacgtggtgacaaacaggctgagtaccagtttcgggtttttaagtgatgtcaccacttcccgcatatgcagcatctcttttttgctgaccggctggaatttttctctgatgcaaaacagggtgacgaaaaagcagagtatgagcacactggcggtaataaagaataccggacgtaagccgtagctatcggcgagcaaaccgccagccattgggccgagcaacgcgccgctaacgccgcctgtggagagcgtacccagcgcccagccgcttttattacgcggtacttgtgtggcgataagagcattagcgttggggacaaatccgccaagtaaaccaagaagcgcccgcaggatcaaaaactgccagatattttgtgccagtcccatcaacaccatcacgatgcccatgccgagagcagagcgtaatagcatgagttttcggcctttacggtcggcgagtccaccccaaaacggtgaggcgatggccgaaaataaaaatgtaatgctgaagacaataccggaccacatattcagggcggagtggccggtaacgccaagctgctcaacgtagaggggtaagaagggcattaccaggctgaaggcggcaccggtaagaaaacagcctagccaggcgacgatcaggtttcgtttccagtttataggggtgtcattttcacagggtgacatagcaatccgctgttggtgcgccaggcgcggtgaacataagaagaaaagataagcacactaattatgcgcccgacttccagggggcgcaatccagagagcttttatcgctaaatcagggggattttctgtggtaatgccggatgccattctgaagcatccagcatggaagatttaatagcgtgaaggaacgccttccgggcgtgttttaaagcgacggtgtaaccacatatactgctctggtgccatcatgatgcatttttcgaccactttgttcatccacgcggcggtagtttcggcatcatccagcggcggagaacactctggcggcagtataatcaactgataccctttgccatctggcttacggcgtggaacgaagggcaccagacatgcgccggacatccgtgccagcatccaggttccggtcgtggtcgcagcctgctcaacggcaaacaacgggacgaaaacgcttgagcgcgggccgtaatcatgatccggtgcgtaccagaccacttcgccttttttcagggctttaatcatgccttttaaatctttgcggtcgagcatcgatttatttgagcgcaaacggccccaggtttgtagccagtcaatcagtggattatcgttcgggcggtaaacgccaatccccggttcctgcataccaaactgccgcgcacccagctccagtgtcagaaaatggatgccaactaacaggatgccgcgtttttgcgcctgcacgtcacgaatgtgttccatgccgatcacttccgtccagcgggcgattcggcggtccggccagaaccacgccatgccggtttccatcaggcccatgccaacggattcgaaattcttcaccaccattttacggcgttcttgttcgctcatttccgggaagcacagttccaggttgcgatgcacaatttttgcgcgtcgtttcataaaacgtaacgccagttttcctaatccacaaccgaggcggtagataaccgggtagggcaattgcacgaccaaccaaagtacgccaatacccaaccaggttaaccaataacgcggatgaagcagtgcggtggagaacttgggtagattcgtcatatcaatcctgtttttcaacctatacgggcaattgtatgtattgtcgcattttttcgtccgcaaccaaaatttgtgactgaagactgggcgaaattgccgcgcttgtaaataacaaataatttttaatgctaaaatgtagcgtaaaatgtgtggatgttaattatcgataattgctatatcatgccgcggatttttactttcccatctcgcaggaaccgtacaccatgccagtgttacacaaccgcatttccaacgacgcgttaaaagccaaaatgttggctgagagcgaaccgcgaaccaccatttcgttttataagtatttccacattgccgatcctaaggtgacccgtgacgctttatatcaactgtttaccgcgctgaatgtttttgggcgagtgtatctggcgcatgagggcattaacgcgcaaatcagcgtacctgcgagcaatgttgaaacatttcgcgcgcagctctatgccttcgacccggctttagagggtttacgcctgaatatcgcgttggatgatgacgggaaatccttctgggtactgcgtatgaaggtacgcgatcgcattgttgccgacggtattgacgatcctcactttgatgccagcaatgtgggtgagtatctgcaagcggcggaagtgaacgccatgcttgacgatcccgatgcattgtttatcgacatgcgtaaccactatgagtatgaagtggggcactttgaaaacgcgctggaaataccggcagataccttccgtgagcagctgccaaaagcagttgagatgatgcaggcacataaagataaaaaaatcgttatgtactgcaccggcggcattcgttgtgaaaaggccagtgcctggatgaaacataacggattcaacaaagtctggcatatcgagggtggagttattgaatacgcccgtaaggcgcgcgagcagggcttgccggtgcgttttattggcaaaaattttgtttttgacgagcggatgggcgaacgtatatctgatgagattatcgcgcactgccaccagtgcggtgcgccgtgcgacagccataccaactgtaaaaatgatggctgccatctgttgtttattcagtgtccagtatgtgcggaaaaatacaaaggttgttgtagtgagatttgctgcgaagaaagcgcgttaccgccagatgaacagcgacgccgtcgggcaggacgtgaaaatggcaataagatctttaataagtctcgtggacgtctgaatacaacactgggcattcctgatccaacagaataaatatcattgccggatgcgtgccatccggcaacatttcactcttacttctgctgtacgccttccactgaaataatcagatccacttcctgagacgctggacctaaatctgtcttgatattgaagtctttgagcttaattttgccttcggcctcaaagcctgcacgtttaccgccccacgggtcgtcaccctgaccaattaatttcgcttccagtgtgacgggcttggttacaccattcagcgtcagatcgccggtaatatccagttcgtcaccgtctttcttcacgctggtggaggtgaatgttgcctgtggatattttgcggtattgaggaaatccgcactgcgaagatgtttatcgcgttcggcgtgattagtatcgacgctggtggtgttaattgtcacattcactttatcggcagctggatttttttcatcaaaggtaaaagtaccgtcgaaatctttgaaggtgccatataaccagctatagccaagatgctggattcggaagttaacaaaggcgtgctgaccttctttgtcaattttgtaatcggcggcaaccgctgaaccggcagagaacatcaaggaagcgaaggttaaaccaagcagactttttttcattttttatactccatagtcagatgacgactttcccagcatgcgcttcagagtgtcgtctttatcgatgaaatgatgcttcagggccataaatccgtgcataacggacagtactacaacgctccacgcgagccaaaaatgcagggcaccggcaaagtcagcctgtgcgccagcgtcggagagggtcgcggggacgtcaaaccagccaaaaacgctgatcggtttaccatcggcagttgagatcagatagccgctgatgccgatggcgaacagcaataggtacaatgcgagatgtccagcttttgctgcaagacgagtcatgggcgaataactcggcagcggacccggcggtggagatatgacacgccacagaacgcgaataaccagccccatcattaacaaaatgccgatgcttttatgcagttccggtgcctggtggtaccagccatcgtaataactgagcgtgaccatccacagacctaaagcaaacatgccatagacaataattgcgcttagccaatgtaaggccgcagatataacaccatagcgttcaggggtatttgtgaatgacataagtgcatccaaaacgaatttgcgagagaaagaaaatggcgtgtcggagaatgaattgcaacacaaaaataacaaattgaatgatatttatttctatttcaataattttgaattaataatgaaagaatcttcataagtttagtgggttcagcatctggaaggtctagtgagtgctgtagaggcaggaagaatctcattcaatttttcacgctaaatgaaagggagattaaatatttgtcagtttatgtcagtgcggaaaactaaaaataaaacacatagatcagatccataattgccaacaatccccagagaaaaagataaagcatcagatgctcgcgaatattattgatgagatagtgcaacagtcgacgcattaaatactcctgtaaaaacggcctcattctggaggccgtaatgatgattattggaagcgggaaagcctgaatggcgtcaaatcaaaatcgctttttttgtcttgcgcaaaatcggcagctatttcccctaaaactgacgcaaatttaaaaccgtgcccactcaggccggtaatgagcagtgtattatcgtggccgggtagggtatcgataataaaatcttcgtcaggcgaattatcataggtgcaggcagcgccgtacaggcagcaaccgatacccggcaacacattgcgcaagaacgggaaggcttccgaaccatcgctgaccacttccgcaaacggaacacgttcatccgctgaatggataacctggcctccgttatgtttgccaatcttcaacgcgtcgttttctgccggaaaaccataatattgatcgccattgggcagttcaccggtaaacgccgggaatttattcttcacgctatagcgaccatcggcctgataccaggcaaatactttgcgtacgggctggacaggcagctccgggagtaggtcttttacccatgttcccgcgcagacaatcgcttttttcgcctgatactcaccgtcagccgtttcaatagttacgccatcatcgtcatgacgaattgcggtgaccgggcagttgaacagctgcgcacagcccgcttccttcgccagttggatccaggttttaatcgccagttcgctgcgcaaaaaaccggaatcagtttcaaataaaccgatgtagttgtccgggacgcgtatttctggccagcgggccataatcccttgcgcgtcgagcttttcaacgttgagttgccactgttcggcgctgtgggcgacgttggcgagaaatgcggagtcagccggaccgaggttaatgacaccagagcgtacaaaaatgggatcatcttcgttgtggcgggaaagttcatcccacagcatttgcgcgcggaggaccagcgggacatacttttcgccttcaccataagcatggcgaattaatcgcgtatcgccgtggtggctgccgtgttgatgcggtggcatatgggcgtcggtcattagcacgtttaaaccggcgcgggttgcataatacccggcggcagcgcctacggaaccgctgccaataatgatgagatcgtatttcatttttttctctctgctctcatggtttaagcagagtaattaactgaatgcagatatacaacccagaaatggtaaaggcaccggtgaggtgccttttgggtggatggtcatgtcatgttaatgacgccgatactcgtttacctggaaatcaccggattcaattttggcgattcctgcttctaatatcgaaataaattgtctggcaacatcagtggttaaccagagcgtctgaccaacttcagtcccttcctgctcggacttatttggggtctggtagtgcaaacgcaacatcagcgcatcatagctatcaacggtgctgatgtcccaccctacgagcggatgagtctgaatgacttcattatttttttccatcatggccccctaattcgtgttactagacaacgttattcgaggttcaatgcgtttttatctgaagcaacttcagtataccaataagtaagggtattcaccgaatttttaaaggggggagcagataaatttctgcttttaagatttatatgaacaataaaacagcatgtcattcatatttttttagcatattgtgcaattattttgaggaagtgtagaaattttgtactcacaattcgcaagtaaaataaaaaagccggggcgacccggcaaaaacaaaaatcactgcatattattcgctgacaaaccagtcatcggcgctttcccacgtttcctggagaatttcgctaatgcgctgtttatcttcttttgtcgcgccaataaccgataaattatttgctgcggcataacgtaccgatacgtggccttcattatcaggaaacgcatactgaatacggcgggaaagttcgccagccagggcgtcaatagccccagctggcaatggagaagttttcgctatggtgacttcaattcgcataatagccccctgttgaatatactggttatttatacaggtaaaataacctaatgacaacaggaagctacgatttttattgtttaacggaccagcgtaccgtttctccggcgaggaatggcaccagcgtgtcatcagtcagtgcgatgctttcagcaacctgttgctcttcacgtaccagttcgatgaatgtgtcgttgaccggcaagccatagaactgcgggccgtttacagaacagaatgcttcaaagtactgcaaagcattcatctcttcaaagacggtagcgtaactgcccagcgcggttggggcgttgaaacagcccgcgcagccgcagctgctctctttgcgatgacgtgcatgtggcgcagaatccgttccgaggaatacacgattaaaaccgctggcgaccagttcacgcaatgcctgttggtggatattgcgtttgaggatgggtagacaatacaggtgcggacgcacgccaccaaccagcatatggttgcggttaaacatcagatgctgtggagtgatggtggcagccagccgttcatttccgtcacggacatagtcggcagcgtctttggtggtgatgtgctcaaaaacgactttcagtgcagtcaggcgctggcgcagcggttccatcacgctttctataaagcgcgcttcacgatcaaaaatgtcgatatctgcatgtgttacttcaccatgcaccagtagtggcataccgattttttccatgcgctcaagtaccggcatgattgcgtcaactgacgtaacgccgtggctggagttagtggttgcgtttgccggataaagttttgcagcggtgaacacgccttcgttaaatccgcgctccagctcattcggatccagcgaatctgttaaataacaggtcatcagcggggtgaaatcgtgcccggcaggtacggcgtcaagaatgcgctgacgatacgccacggcagcctcaacggtggtcacgggcggagccagattgggcattacgatagcccgtccataaatttcgctggtatacggcacgacagtttttaacatgtcgccatcgcggaggtgaaggtgccagtcgtctgggcggcggatctttaatacctgggatggtgcagtcattaatctctatgctccggctgaagggatgtttttgccggacacaaaggataagcggaaacgttttcctttgcacgaaaaataaagggcgcgaatgcgccctcgtgattaatcagtaaacggaatgacaatttcgcctggcttcacttcaatgcctttcgccagtttcttcgccattgcttcgccctggctgccatcttcgcgcaggacgtaagcaggttgctggttaaagtaattgcgtaatgcctggtttaaatagggaagcaacgtttgcatcaccgtttgcattttttccggttgtaccgtcgcatcgaccacttccatctctttcaggaagatcgcgcctttttctttatcaaacacgggcagcgctttcagcttcagtttcatggtcgctttctggctaccgaacagggagttcatgtccagattggcgtctccggttagggtaaccttattcggctcttcgcgaccaatttggctggtcaggtttgtcagaacaatatgggcgtcagccacgccgggtaaaccgatatcttttgagaaattattatgtttcgcaagcgactggttaatttcttgttcggtgatggtgtattgggtgagttgattacagccaacgagcaggccactgacgatcaatgcagcggcaaataaaaacttgttcatggtagtcctcgacatgaaatctgcgtcaatatcctgacacaacgcagcatgtgtcaccagcgataaacgcgccagcagaaaaaactgaaaacggcggcaacccgcgaatacaggctgccgcggcgggtcaggattaaatcgccattgatgataacaaattgatttgtgtctgtttcgccatattatcgcggtaatcagcaacgcggcttggccagttgattccggctactagcgtcagattacgcaggagcggaaatagctgaatatcatcttccgaaagttcgccattcacggcgttcggtttgacgatcagtttgtccagcgcacgtaaatcatcgctgatattcttaatcagaccgtcagagtgggccagcaggtcggcaaaattacccgcgctggcctctttcttgtcgacgaaatatttgcgcgcggcaggagtagaaaactcatcaaatgccgatttggcaaaacgcggcaacagcagtttgttggcgtagccattgaccttgcgcagccactcttcaatggcaggggaacgtttgccggtcagtaacggtttgccgtcgagtttatcgacatagtgaacgatgtccatgctttctggcatatagcggctgtcatctttttgcagaatgggaacctgtttttgaccgaccatccgggtgggtgtttctgcgtcgtcgttgagcagaacatgtaattcgacggggatatttttcaggccgaaaatcatgcgggctttgaggcagtaagggcagtgatcgtaaatgtatagcttcacgtgactcctccatttggctgtcagttcactttcagtatggaggagtcaggggggagtatcaaatcaggcgtcgcgttcaagcaaacgacgcgcggcgcgtttctggctaaactgccaacccagcgcaaggaaagtgaagatgccaataatgcccagcatcatccacggaagctctggctggtgcgccgatttgcccaggtcaaacagccagccgccaccgatataaccaatagcgccgccaatcgccagacccagacggctaaaccccatatagctgccgcgagctcttgcgtctgccagcgaagcacttaaggtttcacgcgcaggctcggcaatgatcgacccgatataaaacagacaaatcagggtgaaaagttgttgcaggccgctgaccatgcctactggcatcatgcttaatgacattatcaacagcccagccattaaccggtgttccagacgaaaatgcttttcactccagcgggcgatagggtagagcaacgttaacgacagacacgcttcaatggcatacatccatttaacggcagagggcgcgccagccacgtcgttgaccataattggcagcatcagcatcacttgtacagccagcatgtagtaacccgccagcgtcaggacataggtgacaaaacgcttgtcgcgcatcacgcgggtcatgccttcgcgaacgggcgtgcgcacggtggagagtttccatgccggtaacaaccacgcattgaacgctgcacacagcacaaacaaaactgcccctgtggcgcagaccaggcgaaagtcgtattgcaacagccagctccccaacaatgcgccaatgaccgcaccggcactgtcctgcatcatcaacagcgagaaaaaacgaccacgctgctgtggacggattaatttcaccaccagcgccgaacgcggaggatcaaacaacgtgccgccgagtcccgaaagcaggcatgaaaaccacagtagccacggttcgtgggcgatacccattgtggcgaatccggcggcacgcatcagcataccggtgacaatcatcggtttggcaccaaagcggtcggcaattgcgccgccgaaaatacccagaccttgctgaataaactggcgtagaccgagggcaataccgaccatgacggcggcccagcccatttgatcaacgaagcggatagagatcagcgggaagacaacaaagaaccccagcacgaccagcatattatcgatgagcaggaaatatttacccaggttcctcgcctgcgacacgcgggacatttcccctcccgggaaataaaagatgagcactttctattctgcattgccgctaagacttttcccatcacttcggggacaatatttttttatcaaaacgtcgctttgatagagagtttttatcaaatatgtgaataatgcagaaaatggcattctggacttttcacagggtctggttgcgcaggtatagtaatacttacagcgtattaaagacgttacgggaaggagtaggtatagaatgtttggctatcgcagtaacgtgccaaaagtgcgcttaaccacagaccgactggtcgtgcgtctggtgcatgatcgtgatgcctggcgtctggcggattattacgcagagaatcgccatttcctcaagccctgggagccagtgcgcgacgaaagccactgttatccatcaggctggcaggccaggctagggatgattaacgaatttcataaacaaggttcagctttctactttggcttattcgacccggacgaaaaagagattattggcgttgccaatttttccaatgttgttcgcggctcttttcatgcctgctatctcggttattcgattgggcaaaaatggcagggcaaaggactcatgtttgaagctctgagcgcagccattcgttatatgcagcgcacccaacatattcatcgcattatggctaattatatgccgcacaataaacgcagcggtgatttactggcgcgactgggttttgaaaaagaaggctatgcgaaagactatctgttgattgatggacaatggcgcgatcacgtactgacggcattaactaccccagactggacgcccggccgctaaggagaatctcatgaaatatcaacttactgccctggaagctcgcgtgattggttgcttgctggaaaaacaggtgaccacgccggagcaatacccgctctcagtcaatggtgtagtcacggcctgtaatcagaaaacgaaccgtgaaccggtcatgaatctgagtgaatccgaggtgcaggagcaactggataatctggtcaaacgccattatctgcgcacggtgagtggctttggtaatcgggtcaccaaatatgaacaacgtttttgtaattcagaatttggcgatctgaaactgagcgccgcagaagtggcgttaatcaccacgttgttattgcgtggtgcccagacgccgggtgaactgcgcagccgcgccgcgcgaatgtatgaattcagcgatatggcggaagtggagtcgacgctggaacaactggcaaatcgcgaagatggtccttttgtggtgcgtctggcccgcgaaccgggtaaacgtgaaagccgctacatgcatcttttcagtggtgaggttgaagatcagccggcggtgatggatatgtcgaacgcggttgacggtgatttacaggcacgcgtcgaagccctggaaatcgaagtggcagaactgaaacagcgtcttgattcgttgctggcccatctgggagattaaagtgaaaaaattacgtatcggcgtagtggggttaggcggcatcgcgcaaaaagcgtggttaccggtgctggcggcagcgtctgactggacgttacaaggtgcgtggtcgcctacgcgcgccaaagccttgccaatttgtgacagctggcgcattccttatgctgattcgttatccagccttgccgccagttgcgatgcggtttttgtgcattccagcaccgccagccactttgacgtggtcagtacgttactcaatgcgggggtacatgtctgtgtcgataaaccgctggcagaaaatctgcgcgatgctgaacggctggtggaactggcggcgcggaaaaaactaacgttgatggtcggttttaaccgtcgtttcgcaccactctacggtgagttaaaaacgcaactcgccaccgcagcctcgctaagaatggataaacatcgtagcaatagcgtcgggccacacgatctttatttcacgttgctggatgattatctgcatgtggtggataccgcgctgtggttgtcgggcggcaaagcctctctggatggcggtacgctactgactaacgacgctggcgaaatgctgtttgccgagcaccatttttcggccggtcctttgcagatcaccacctgtatgcatcgccgtgccggaagccagcgtgaaaccgtgcaggccgtgactgacggtgcgctcatcgacattacggatatgcgcgaatggcgtgaggagcgtgggcagggtgtagtgaataaaccgattcctggttggcagagtacgcttgagcaacgtggatttgtcggctgtgcgcggcacttcattgaatgcgtgcaaaatcagacagttccgcaaaccgccggcgaacaggcagtgctggcgcaacgtatcgttgacaagatctggcgcgatgcgatgagtgaataaaccctgtaacatctggcggtagcaattcaccataatccaggtagactattcgcctctttcagcgcctgccttgcaggcgttttgcccgtgggtctggattagaacaccgatgaatttattaaaatcgctggccgccgtcagctcgatgaccatgttttcgcgtgtgcttggcttcgcacgtgacgcaattgtcgccagaatctttggcgcagggatggcaaccgacgcctttttcgtcgcttttaaacttcctaacttgttacgccgtatctttgccgaaggggcattttcccaggcatttgtaccgattctggcggaatataaaagtaagcagggtgaagacgccacgcgggtctttgtctcttatgtttctggcctgctgacacttgcgctggcggttgtgacggtcgctggcatgctcgccgcaccgtgggtgatcatggtgaccgcgccaggcttcgctgacacagctgacaaatttgccctgaccagccagctactaaagattacctttccctatatcttgctgatctccctggcgtcgctggtgggagcgattctgaatacgtggaaccgcttctcgattccggcgtttgctccaacactgcttaacatcagcatgattggtttcgcgctgtttgccgcaccgtactttaacccaccggtgctggcgctggcgtgggctgttacggtcggcggcgtcctgcagctggtgtatcagctaccgcacctgaagaagatcggcatgctggtcctgccgcgcattaacttccacgatgccggagcaatgcgcgtggtgaaacagatgggaccggcaatccttggcgtctctgtgagtcagatctccttaatcatcaacaccatttttgcctcgtttcttgcttccggttcggtgtcttggatgtattacgccgaccgcttaatggagtttccgtccggtgtactgggcgtggcgcttggcaccattttgctgccgtcgctgtcgaaaagttttgccagtggcaatcatgatgaatacaaccgtttgatggactgggggctgcgtctttgtttcctgttggcgctgccgagtgcggttgcgttgggcattctttcaggtccgttgaccgtttcgctgtttcagtacggtaaatttaccgcctttgatgcgctgatgacccagcgggcgttaattgcctactcggtgggtttgattggcctgattgtagtgaaagtgttggctcctggcttttattcccgccaggacattaaaacgccagtgaaaattgccatcgttacgctgattttaacgcaattgatgaacctggcgtttattggtccgttgaaacatgccgggctgtcactttctattggtctggcggcgtgtctgaatgcttcgctgctttactggcagttgcgtaagcagaaaatctttaccccgcaacctggctggatggcgtttctgttgcgtctggtggtggcggtactggtgatgtctggtgtgcttttaggtatgttacatatcatgccggagtggtcattgggtaccatgccctggcgcttactgcgtttaatggcggtcgtgctggcggggattgctgcgtactttgctgcactggcggtactgggcttcaaagttaaagagtttgcccgccggacggtgtaacaatgtattccggcctgcagtgcaggccggagataatcttcagatcgaaatctttttactgccgcgatgggttgttgaggtctgaccgttcgctccatatagcgtcggttcctgatgcggtttcaacatttccagcgcctgttgattgcgctcaatctgtccttccagtaaccagccgttatgttgattcagttggcgtagttgctgagttttgccagtaatttcctgccagcgttgactaatatcaacgctatttgctgtattgggttctttcctgcgtaactgttcgaggtaatccagcgtcgccagcagtgagcttttttgttctgtaatccattgcaactggctgccgttgatctgccccatagagagatgttgctgctcttgatccattaccgttttgagatcgttaagcacagcggacatctggtcgaggatctctgcaagacgcgtcatacgatcaattactctgcaagtcttgctgcgcttcgttgatcagcgcatcggcaattttgccggtgtccatttttagttcaccgttacgaatcgccagttttaacgcttcgacacgttcaagattgatatcgctgctgccgggttgcatcagttttgcttgcgcgtcgcttaacgtcacactggtgctggtggaggctgttgtttttgccgctcgggtgtttgttaccggcgcgtcagtggtttcgcgcggttgaacggtgcttactggcttcagaggcgaagtgcgatcaatactcatggtttattcctcattgagggcgcttttatcatgtgttgcttatttatcggcaagggacgggtaatctttaacagcttacaggtttataagaatattcccatctgcatcaacaacgccgctgaccacttgtcccgatatcatgcgcacccgcgcattctgtgcgacggctgcattgttcagcgcctgaccttctgcgttggcgctaaacccatcaccgctggcgatcacgttgacacgttgtcccgcttttacccgccatgcctggcgaaagtgggttaactggataggttgatcgggtgatagatcgcgcaggctaacggcatcaacaagttgattgatatccagcaccgtacgcggtggcaaggtatccagtcggccgcgtttcagtttgacattgccagcttccagctttcctccacgcacaatgggcatcgcggcaaccacataatttcctgtggcctgtacattaacctgtaaatatcgtttgtcgttaccgcagcgtgccaacacattcacattgccccacaggcgggaattattgctcatcgaaagcaatggctgctcgcacggcggtagtagattgggcgctgtacgaatagaaacacgaacctcatcacttacccccgcgagctgggcgctaaaaaaggtgtgcaattgcgatgtgagattgctcgccgcacttaacggactgaacagtatcgcgatgatcgccacgctacgttttattgtcagcattttcgcccccagccatttctacaacgtgaattgtacctgtccgcaatgaccatcaacggcataaatagcgacccattttgcgtttattccgccgataacgcgcgcgtaaaggcatttaagctgatggcagaattttgatacctgcggaggagatatgctcgataagctcgacgccgccttacgttttcaacaagaggcgctcaatctgcgcgcccagcgtcaggaagtgctggcagcaaacatcgccaatgccgatacccctggttatcaggctcgcgatatcgattttgccagtgaacttaaaaaagtcatgcaacgtggacgggatgcaaccagtgtggttgctctgacgatgacctcaacgaaacacattccggcgcaggcgctgacgcctccttccgcagaactgcaataccgtattccggaccagccttcgcttgacggtaatactgtcgatatggatcgcgaacgcacccagtttgccgataacagcctgcaataccagatgagccttagcgcgttgagcgggcagatcaaaggcatgatgaacgttttacagagcggaaattaacggatggcactgctgaatatttttgatatcgccgggtcggcgttaactgcccagtcccagcgcctgaacgtggcggccagtaatctggcgaatgctgatagcgtcaccggtcccgatggacagccatatcgggcaaaacaggtggtattccaggttaacgctgcgccaggtgctgcgacaggcggcgtaaaggttgccgatgttatagaaagtcaggccccggacaaactggtttatgaaccgggtaatccgctggcggatgcaaagggctacgtgaaaatgccaaacgttgatgtcgtcggagagatggttaacaccatgtcggcgtcacgcagttatcaggccaatgttgaagtgctcaacacggtgaaaagtatgatgctgaaaacccttacgctcggtcaataaaggagaaagctatgtccattgcggtaaccaccaccgatccgacgaataccggcgtcagtaccaccagcagtagttcgctcacgggcagcaacgccgcagatttacaaagcagttttctgactttgttggtggcgcagctgaaaaaccaggacccgaccaatccaatggaaaacaacgagctgacgtcgcaattggcacaaatcagcacggtcagtgggattgaaaaactcaataccacgcttggatctatttccggacagattgataacagccagtcgttacaggccagtaacctgattggtcacggcgtgatgatccccggtaccactgttcttgcgggaaccggcagtgaagaaggggctgtgaccacgaccacgccgtttggtgttgagttgcaacaggcggcagacaaagtgacggccaccatcaccgataaaaacggcgcggtcgtccgtaccattgatatcggtgaactgactgccggagtccacagtttcacctgggacggtacgttgactgacggcagcactgcgccgaacggttcttacaatgtagcgattagcgccagtaacggtggtacacaactggttgcccagccgctgcagtttgctctggtgcagggtgtgatccgcggcaacaacggtaatacgctggatctcggcacttacggcaccaccaccctcgacgaagtacggcagataatttaagccttcacatttcaggagtcagtcatggccttttctcaagcggttagcggattaaacgctgccgccaccaacctcgatgttattggcaacaatatcgccaactccgccacctacggctttaaatcaggcacggcctcttttgccgatatgtttgccggttcgaaagtgggactgggggtaaaagttgccggtatcacccaggactttaccgatggcacgaccaccaacaccgggcgaggtctggacgttgctatcagccagaacggttttttccgtctggtagacagcaacggttcggtgttctacagccgtaatggacaatttaagctggatgaaaaccgtaacctggtgaatatgcaaggtttacagctgacggggtacccggcaaccggtacgccgccgactattcagcaaggggcgaatccgaccaatatttcgatcccgaataccctgatggcagcgaaaactaccaccacggcgtcaatgcagatcaacctgaattccagtgattcgcttccctctgttaacgcatttgatgccagcaatgcggatagctataacaaaaaaggttcggtgactgttttcgatagtcagggtaatgctcatgatatgagcgtgtactttgtgaagaccggggataataactggcaggtctacacccaggatagtagtgatccaaacagcattgcgaagacagcgacaacactggtgtttaatgccaatggcgttctgacctcaaatccaacagcgaatatttccactggcgcaattaacggcgcagatcccgccacgtttagcctgagcttcctcaactccatgcagcaaaataccggcgctaacaacattgtggcaaccacccagaacggctacaaaccgggcgatctggtgagttatcaaatcaatgatgacggtacggttgtcggcaactattccaacgaacaaacccaactgctggggcagattgtactggcgaactttgccaacaacgaaggtctggcatccgaaggcgacaacgtctggtccgctacgcaatcttctggcgtggcgctgttggggacagccgggacgggcaactttggcacactgaccaacggtgcgctggaagcgtccaacgtcgatctcagtaaagaactggtcaatatgatcgttgcccagcgtaactatcagtctaacgcccagaccatcaaaacccaggaccagatcctcaatacgctggttaacttacgctaatcgctgacgggatagctcaatggatcacgcaatttataccgcgatgggagcagccagccagacgctgaatcaacaggcggtaaccgccagtaatctggccaatgcctctacgcccggttttcgcgcgcagttaaacgccttgcgcgcagtgccggtggaagggctttcactgcccacgcgcacgctggtaacggcgtcaacaccgggtgcagacatgacacccggcaagatggattacacctcgcgcccgctggacgttgcgttgcagcaggatggttggctggccgtgcagaccgctgacggcagtgaagggtatacgcgtaatggcagcattcaggttgatcccaccgggcaactgacaattcagggacatccggtggtaggcgaggcggggccaattgctgtgccggaaggggcggaaatcactattgctgccgatggcacaatctcggcgctgaatccgggcgatccggcaaatacggttgcgccagtggggcgtctgaagctggtgaaagccacgggcagcgaagtccagcgcggtgacgatggcatttttcgtttaagcgcagaaagccaggctacgcgtgggccggtactgcaggcagatccaaccttgcgtgtgatgtcgggggttctggaaggcagtaacgtcaatgccgttgcggcaatgagcgacatgattgccagcgcacggcgttttgaaatgcagatgaaggtgatcagcagcgtcgatgataacgcaggccgtgccaaccaactgctgtcgatgagttaattgaaaggatacatgacaagtataagttgccctatgcgcaagtttatcgggtctatgggggcaatcgcaatttatcgattttgcgagctcttgtaggccggataaggcgtttacgccgcatccggcaagaagacatatgcactttgtcactaatccactacaggacattttatgatcagttcattatggatcgccaaaacgggccttgacgcccagcaaaccaatatggacgtcattgccaacaacctggcaaacgttagtaccaacggttttaagcgtcagcgcgcggtgtttgaagatctgctttatcaaaccattcgccagccgggggcacagtcttccgaacaaaccaccttaccatccggattacaaatcggtacgggggtacgcccggtcgccacggaacgtttacacagccagggcaacctgtcgcaaaccaataacagtaaagacgtcgcgattaaagggcagggctttttccaggtgatgttgccagatggctcatcagcctatacccgtgacggctctttccaggtggatcagaacgggcagctggtgacggccggtggttttcaggtgcagccagcgatcaccattccggcgaatgcgttaagtatcaccatcggtcgtgatggcgtggtcagcgtaacccaacaaggccaggcagctccggttcaggttgggcagctcaatctcaccacctttatgaatgacaccggactggagagcattggcgaaaacctctacaccgaaacgcaatcctccggtgcaccgaacgaaagcacgccgggcctgaacggcgcgggactgctgtatcaagggtatgttgaaacgtctaacgtcaacgtggcggaagaactggtcaatatgattcaggtgcaacgcgcttacgaaatcaacagtaaagcggtgtccaccaccgatcagatgctgcaaaaactgacgcaactctaaggcttaaccggtggcaggttcaccggtttactgatttttgaagatgatagccatgcaaaaaaacgctgcgcatacttatgccatttccagcttgttggtgctttcactaaccggctgcgcctggataccctccacgccgctggtacaaggggcgaccagtgcacaaccggttcccggtccgacgcccgtcgccaacgggtctattttccagtctgctcagccgattaactatggctatcaaccgctgtttgaagatcgtcgaccacgcaatattggcgatacgctgactatcgtgttgcaggagaacgtcagcgccagcaaaagctcctctgcgaatgccagccgtgacggtaaaactaattttggctttgatactgtgccgcgctatttgcaggggttgtttggtaacgctcgtgccgatgtcgaagcctccggtggtaacacgttcaacggaaaaggcggggccaatgccagcaatacctttagcggtacgttgacggtgacggttgaccaggtactggtcaacggcaacctgcatgtggtgggtgaaaaacagatcgccattaatcagggtaccgaatttattcgcttctctggcgtggttaatccacgcactatcagcggcagcaataccgtaccatctactcaggtggcggatgcgcgcattgaatacgtaggcaatggctacattaacgaagcgcaaaatatgggctggttgcagcgtttcttccttaacctgtcgccaatgtaagtgaggctgtggtgattaaatttctctctgcattaattcttctactggttacgacggcggctcaggctgagcgtattcgcgatctcaccagtgttcagggggtaaggcaaaactcactgattggctatggcctggtggtggggctggatggaaccggtgaccagacaacccagacgccgtttaccacacaaacgcttaataacatgctctcacagctgggaattaccgttccgacgggcaccaatatgcagctaaaaaacgtcgctgcggtaatggtgacggcgtcacttccgccgtttggacgccaggggcaaaccatcgatgtggtggtttcttccatgggtaatgccaaaagcttgcgtggcggtacgttgttgatgacaccgcttaagggcgttgacagtcaggtgtatgcgctggcgcagggcaatattctggttggcggcgcaggagcctctgctggcggtagcagtgttcaggtaaaccaactgaacggtggacggatcaccaatggtgcggttattgaacgtgaattgcccagccagtttggcgtcgggaatacccttaatttgcaacttaacgacgaagatttcagcatggcgcagcaaatcgctgacaccatcaaccgcgtgcgtggatatggcagcgccaccgcgttagatgcgcggactattcaggtgcgcgtaccaagtggcaacagttcccaggtccgtttccttgccgatatccagaatatgcaggttaatgtcaccccgcaggacgctaaagtagtgattaactcgcgcactggctcggtggtgatgaatcgcgaagtgaccctcgacagctgcgcagtagcgcaggggaatctctcggttacggtcaatcgtcaggccaatgtcagccagccagatacaccgtttggtggtggacagactgtggttactccacaaacgcagatcgatttacgccagagcggcggttcgctgcaaagcgtacgttccagcgccagcctcaataacgtggtgcgcgcgctcaatgcgctgggcgctacgccgatggatctgatgtctattttgcaatcaatgcaaagtgcgggatgtctgcgggcaaaactggaaatcatctgatgatcagcgacagcaaactactggcaagtgcggcctgggatgcgcaatcactcaacgaactaaaggcgaaagcgggcgaagatccagcggcaaatatccgtccggtggcccgccaggtggaagggatgttcgtgcagatgatgttgaaaagcatgcgcgacgctttaccaaaagatggcctgttcagcagcgagcgcactcgcctgtataccagtatgtatgaccagcagattgcccaacagatgacggcgggcaaaggtctggggctggcagagatgatggttaaacagatgacgccagaacaaccattgccagaggagtccacgccagcagcaccgatgaaattcccgctcgaaactgtggtgcgttatcaaaatcaggcgctttctcagctggtgcaaaaggccgtaccacgtaactacgatgattcgttgccgggtaacagtaaagcattcctcgcgcaactctcactgcccgcccaactggcaagccagcaaagcggtgtgccacatcatttgatcctcgctcaggcggcgcttgaatctggctgggggcaacggcaaatccgccgcgaaaacggcgagccgagttacaacctgtttggcgtcaaagcctctggcaactggaaagggccagtcactgaaatcaccacgactgaatatgaaaacggcgaagcgaagaaagtaaaagcgaaatttcgggtctacagctcgtatctggaagcattgtcggattacgttgggctgttaacacgcaatccgcgctacgctgccgtgacgaccgccgtgagtgcggagcagggggcacaggccctacaggacgcgggctatgccaccgatcctcactatgcccgcaaactcaccaacatgattcagcagatgaaatcgataagcgacaaagtgagcaaaacctacagtatgaacattgataatctgttctgaataactcaagtccggcgggtcgctgccgataatactctgtaattgaaggcttataaggaacctccatgtccagcttgatcaataacgccatgagcggactgaacgcggcccaggcggcgttaaatacggcaagtaataatatctccagctataacgttgccggatatacccgccaaaccactattatggcgcaggccaatagcacgctgggcgctggcggctgggttggcaatggcgtctacgtttctggtgtgcagcgtgagtatgatgcatttattaccaaccagttacgtgcggcgcagacgcaaagtagcggcctgactgcccgctatgagcagatgtcgaaaatcgacaatatgctctccaccagtacctcttcgctggcaacacagatgcaggatttcttcaccagcctgcaaacgctggtaagtaacgcggaagacccggcagcgcgccaggcgctgattgggaaatcagaagggttggtgaatcagtttaaaaccaccgatcaatatctgcgcgaccaggacaaacaggtcaatatcgcgataggtgccagcgttgatcagatcaacaattacgctaaacaaatcgccagcctgaacgatcaaatctcccgcctgacaggcgtgggggcaggggcgtcacctaacaatctgctggatcaacgcgatcaactggtgagcgaattaaaccagattgttggcgtagaagtcagcgttcaggatggtggcacttataacatcacgatggccaatggctactcactggttcagggaagtacggcgcggcaacttgcggcagttccttccagcgccgacccttctcgtacgactgtcgcttatgttgataggacggcaggcaatattgagatcccggagaaattactgaataccgggtcgctgggcggcattctgacattccgttctcaggatctggaccagacgcgtaatacgcttggacaactggcgctggcatttgccgaggctttcaacacacaacacaaagccggatttgatgccaacggcgatgctggtgaagatttctttgctattggtaagcccgcggttctgcaaaacacgaaaaacaaaggtgacgttgcgatcggtgccacggtaactgatgcctccgcggtactggcgacagattacaaaatctcgttcgataataatcagtggcaggtcacccgccttgccagcaataccacttttacggtgacgccggatgccaacggtaaagtggcatttgatggtctggagttgacgtttacaggaacgcctgccgttaacgacagcttcacgctgaaaccggtaagtgacgccatcgtcaacatggatgtattaatcactgacgaagcgaaaatcgccatggcgagcgaagaagatgcgggtgatagcgacaaccgcaacggtcaggccctgctggatctgcaaagcaacagtaaaacggtgggcggtgcgaaatcctttaacgacgcttatgcctcattagtgagtgatatcgggaataaaaccgcgacgttgaaaaccagtagcgccacgcaaggtaatgtggtgacgcagctttccaatcagcagcagtcgatttccggtgtcaatctcgatgaggagtacggaaatctgcaacgttttcagcagtattacctggcgaatgcgcaggttctgcagacggcaaacgcgatttttgatgcgctgattaacattcgctaaggggagataaaatgcgtttcagtacccagatgatgtaccagcaaaacatgcgtggcatcaccaattctcaggcagaatggatgaagtacggcgaacagatgtcgacgggtaagcgagtcgttaacccttcagatgatcccattgctgcatcacaagctgttgttctctcccaggcacaggcacaaaacagccagtacacgctggcgcgtactttcgccactcaaaaagtgtcactggaagagagtgtgcttagccaggtcaccactgctatccagaatgctcaggaaaaaattgtctacgccagcaatggcaccttgagtgacgatgaccgggcctcactggctacggatattcaggggcttcgtgatcagttactgaatctggcgaacaccactgacggtaacgggcgctacatttttgccggttataaaacagagactgcgccgtttagtgaggctgacggtgattatgtcggcggaacagaaagtattaaacaacaggtcgatgcttcgcgttcgatggtgataggacatacgggcgacaaaattttcgacagtattaccagcaacgcggtagcggaaccagacggtagcgcttctgaaaccaatctttttgccatgctggatagcgccatcgcagccctgaaaacgccggtcgcggatagcgaagcggataaagaaaccgccgctgcggcactggataaaaccaaccgcggactgaaaaactcgctgaacaatgtgctgactgttcgcgcggaattaggcacgcaactgaacgaactggagtcgctggattcattaggtagcgatcgcgctttagggcaaacgcagcagatgagcgatctggttgatgtggactggaatgcaactatttcatcttacatcatgcagcaaacggcattgcaggcatcgtataaagcatttaccgatatgcagggattgtcgctcttccagctcaacaaataagctcgctttaaaacatatcatgaaactgggtatgttttgtctgcccgctctgggatcgccggggcgggcatttttttgcctattttgtatagttggttagcaaggatgccatttgatgaattttaatatgttgactcaaagatgaaataaaaaagccctggcagttaccagggcttgattgcttgagctaattattactcaacaggttgcggacgcgcaggagcggcggaggcatgatgcgttgccgtatgaccacctgcggcacctttaccttcgaaggcgaaagtagggcgctgccagtcactgtgacgcggtgcttccggaacatattccggtgccggagcgcgcgtcatcggcgcggtagcgtggttatgctcaacggtgacctcaggttcaaccgcagctaccgtttcaacttctgctgcgacttcagcgacgactggcgcggcaggttgagcaacaacttcaggttcagcaaccacaacctcagcagtttcggcaacttcttcaatatctgccgtctcttcctgcggttcaaccaccggttctgcgtgttctgcaacttcctgggctacggcaacatcagactcggtaatcacctgcggctgttcagttaccgcggcagcaatcacttcaggatgcgtcgtttcaaccacttcaggttgcggttcggcaacctgaacgggggcttctacgacttcagccacttcttcaacaactggcgcgctaacaacaggtttgacagcggcggcgacagggacctcagtcaccatcggctgcacttgtacttcttcctgttcgtgctgctcttcaacctgtacatcttgcggacgtacaattggatagcggatccagactttgccagaggccagttccggagacgcgcacgctacggtcaacggcattggcgactgggttggataacgctcgtcacgatagcgacgacgacgctgaccacttacgcgcaggtgacgaggcgagcggcgagaacgacgcggcatgccaccgttgtcacggttatcggcattgttctcttcttgctgttctggtgcagcttgcgctacgactggcagcgggactttcaccagttctgtgcgtggagctggcgcttcctgaacaattggttcggcagcgacagtttcttcaaccaccggtgcgactaccgcttcttcggctacgctttgctcgtaacgcactttctgattgagctgacgctgtttacgacgcggctgaaccggacgtacacgttcttcctgttcggtttcctgaacagattgctcttcaacattcagcgccttcgcttcttgttgcgcctgacgtttatcatcgttacggcggcggctacgttcacgacgcggcgcttgctgctcgtctgtggtacgcgctttttccgttacctctgcctgctgacggctctcacgcgtctcggcagtctgctgctgtgcctggcgacgattacgacggttttcttcgcgattatcgctgccttctgtacgttcactacgggtatcgcggcgctcattacggtcacggcggttgttctgacgaggcttgcgacgatcctgttgacgttccggtttcgcttctgctttcggtgctgattgctcggccggtttggtttcttcaccaccgctgaacagcgctttcagtgcgccgaagaagcggctcaacaaccctggttgtgcaggagatgctggtgttgccgttgcagctttaggtgctggggctacaacaggcgcggcaggttcagctggggttggagctggcggcacatccggcatggcaaaggttgccagcgcaggttgttccggacgcttacgttcagcgaactcttcttcagacggcagcgccatcgcttcttcatgcagcttcggcagcatgtagcttaaggttgaggtttcttcccctttgcgcacgcgcagcacatggtagtgcggggtttccatctgatcgtttggcacaatcacacagcgtacgccgtcctgacgagtttcaatcgcatttaccgcagaacgtttttcattcagcaggtaagaagcgattggcacaggaacaatggcgtgaacttcctgggtgttctctttcagcgcttcttcttcgatcagacgcagaatagagagcgacagcgattcgttgtcacgcacggtaccggtaccggagcagcgcgggcagacgtgatggctggattcacccagtgatgggctcaggcgctgacgggacatttccagcaggccaaagcgagaaatatggctgatttgaatacgcgcacggtcctgacgcaccgcttcacgcagacggttttctaccgcacgctggtggcgtacaggcgtcatgtcgatgaagtcgataacaatcaggccgccgaggtcacgcaggcgcagctgacgagcaatctcatcggcagcttcgaggttagtgttaaacgcggtttcttcgatatcgccgccgcgggtcgcgcgtgcggagttgatgtcgatggccgttaacgcttcggtgctgtcgataacaatcgaaccaccggatggcagacgaacttcacgctggaaggcggactcgatctgcgactcgatctggtagtggctgaacagcgggatctcgccggtgtacagtttgattttgctgctgaaatccgggcggcctaatgcagcgatatgctgacgtgccagttcgagcactttcgggttatcgataaggatttcaccgatgtcctggcgtaagtaatcgcggaatgcgcgaacgattacgttgctctcctgatgaatcaggaacggagccgggcggctttcagcggcttttttgatggcttcccagtgtttcagacggaagcttaaatcccattgcagcgcctcagcagatttgccgacgccagcggtgcgcacgataagccccatgccttccggcagttcaaggcttgccagtgcttcttttaattcggtacggtcgtcgccttcgatacgacgagaaataccacccgcgcgcgggttgttcggcatcagaaccagatagctacccgccagactgataaaggtggttaatgccgcgcctttgttgccgcgctcttctttatcgatctgaacaatgacttcctgaccttcacgcaacacatctttaatgttgggacgaccatgagcactgtagttagcagggaaatattcgcgggcaatttcttttagcgggaggaaaccgtgacgttcagcgccgtaatcaacaaaagcagcttccagactcggttcaatgcgggtgattttacctttgtagatgtttgcctttttctgctcgtgccctggactttcgatatccaggtcatacagacgctgcccatctacaagggcaacgcgcaactcttcctgctgagttgcgttgattaacattcttttcatcgtaacttactcattattattacattgacgactaagctgcgggcaaagtaacgcctttccgggtgtgaaccgatggcctcgtgtctagtcgcgtcgccaacctcacggttatcgtcagctcaaagaggcgcagagtgtcggttgcccgtttttcatgcggaaaaacagcgcaattatcagagaaacagactgggtattactctccagaaatatttccatctaccggtaaggactgcaacccgcagcccgctaactgcctgaaagatcaatacgtcttacgccattgctgcgtggatgatcggtcgggcaaaatgggttattccgtaaaatttcttgttttaacaaggatggacacggaaacggcctcattattccactgcaagccttgttatagcaagatgacttttaccatttatcacccgcttactcacagttttttcacttcttgctggtgattggtttaataaccatcaataaagtgatcacctagtgaagtaataaggtgtaaaactaaatataagcatagaaaaatgagtggcgcgaatcctgttggctaattagaatcgcccaccatgaaaacagagactccatccgtaaaaattgttgctatcaccgctgacgaagcggggcaacgtatcgacaactttttgcgtacccaattgaaaggcgtaccaaaaagtatgatttaccgtattttgcgtaaaggcgaagtgcgggtgaacaaaaaacgtattaagcctgaatataaactcgaagcgggtgatgaggtgcgtatcccaccggttcgcgttgctgagcgggaagannnnncattccattcattaattaattaatgaatgaatgnnnnntgtgttgctggtagcgaaaaaacgctcggcgttgcgttctctgcatgagcaattacgtgaaaaagggatgcaaaaagattacctggcgctggtgcgcggtcagtggcagtcgcatgtgaagagcgttcaagcgccgttactgaaaaatattctgcaaagcggcgaacgtatcgtgcgtgtgagtcaggaaggcaaaccgtcggaaacacgctttaaagtggaagagcgctatgcatttgccaccctggtgcgttgtagcccggtaacagggcgtactcatcagatccgtgtgcatacacaatatgcgggtcatccgattgcctttgacgatcgctacggtgaccgtgaatttgacagacagctcactgaagcaggcacgggattaaatcgcctgttcctgcacgccgcagcgttgaagtttactcatccggggaccggtgaggtgatgcgtattgaagcgccgatggatgaaggtttgaagcgttgtttgcaaaagctgcgtaacgcgcgctaatacaagcatataaacctgataatgggcggttggcctgataaggcgtttacgccgcatcaggccgccagcaccgattgccggatgcgaagtaaccgcatccggcgcaaaaaactatcccatcagcgggtttttcccttcccgacgtaacatctgacacagcgcgattagcggtaaaccaaccagcgtgttaggatcacgcccctctaaacgctcaaacagcgtaatgccaaatccttcactcttaaagctacccgcgcagtgcaggggatgctctttacgcacgtaattatcaatctccgcctcgctcaggtgacggaaatggacgtcaaaaggctccacttctgtttgtagatgcccattcgccgaattaaacaacgccagtccagtatagaaggtgacgatattgccgctggctttgcgtaattgcagacgggcattttcttccgttaacggtttaccggtgatttcgccatcaagaacacatacctggtctgaaccaataattaaatgatccggataacgtgacgccagagattgcgctttttcttgtgccagtcgaagcaccaactgtcgcggtgattcgtcgctgcgtggagtttcgtcgacctcgggtgctgcacattcaaaagagatttgcagtttttccagaagagcgcgacgccagggcgaggtggaggctaaaataagtttaggcatatttttttccatcagatatagcgtattgatgatagccattttaaactatgcgcttcgttttgcaggttgatgttcgttatcagcactgaacgaaaataaagcagtaacccgcaatgtgtgcgaattattggcaaaaggcaaccacaggctgcctttttctttgactctatgacgttacaaagttaatatgcgcgccctatgcaaaaggtaaaattacccctgactctcgatccggttcgtacggctcaaaaacgccttgattaccagggtatctatactcctgatcaggttgagcgcgtcgccgaatccgtagtcagtgtggacagtgatgtggaatgctccatgtcgttcgctatcgataaccaacgtctcgcagtgttaaacggcgatgcgaaggtgacggtaacgctcgagtgtcagcgttgcgggaagccgtttactcatcaggtctacacaacgtattgttttagtcctgtgcgttcagacgaacaggctgaagcactgccggaagcgtatgaaccgattgaggttaacgaattcggtgaaatcgatctgcttgcaatggttgaagatgaaatcatcctcgccttgccggtagttccggtgcatgattctgaacactgtgaagtgtccgaagcggacatggtctttggtgaactgcctgaagaagcgcaaaagccaaacccatttgccgtattagccagcttaaagcgtaagtaattggtgctccccgttggatcggggataaaccgtaattgaggagtaaggtccatggccgtacaacagaataaaccaacccgttccaaacgtggcatgcgtcgttcccatgacgcgctgaccgcagtcaccagcctgtctgtagacaaaacttctggtgaaaaacacctgcgtcaccacatcactgccgacggttactaccgcggccgcaaggtcatcgctaagtaatcacgcgtctgcgtgatgaagcttagtgaggattttccccaggcaactggggaaagaccaaaccgggcggcgacgatannnnncattccattcattaattaattaatgaatgaatgnnnnncggtcgttcgaccgcctgagttttatcttttgtcccactagaatcattttttccctccctggaggacaaacgtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccaagcatctctatcgcgaccgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgcgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaagttgtcattttccacccttataaaaggtccgcttgcgggccttttttcttagcttttattccgacttgttccgtagtgaacatgctgccacactaacaattctctgataaggagccggtatgttcttaattaacggtcataagcaggaatcgctggcagtaagcgatcgggcaacgcagtttggtgatggttgttttaccaccgccagagttatcgacggtaaagtcagtttgttatcggcgcatatccagcgactacaggatgcttgtcagcggttgatgatttcctgtgacttctggcctcagcttgaacaagagatgaaaacgctggcagcagaacagcaaaatggtgtactgaaagtcgtgatcagtcgcggtagtggcgggcgagggtacagcacattgaacagtggaccggcaacgcggattctctccgttacggcttatcctgcacattacgaccgtttgcgtaacgaagggatgacgttggcgctaagcccggtgcggctggggcgcaatcctcatcttgcaggtattaaacatcttaatcggcttgagcaagtattgatccgctctcatcttgagcagacaaacgctgatgaggcgctggtccttgacagcgaagggtgggttacggaatgctgtgcggctaatttgttctggcggaagggcaacgtagtttatacgccgcgactggatcaggcaggtgttaacggcattatgcgacaattctgtatccgtttgctggcacaatcctcttatcagcttgtcgaagtgcaagcctctctggaagaggcgttgcaggcagatgagatggttatttgtaatgcgttaatgccagtgatgcccgtacgtgcctgtggcgatgtctccttttcgtcagcaacgttatatgaatatttagccccactttgtgagcgcccgaattagtcatgaaaaaagtgttattgataatcttgttattgctggtggtactgggtatcgccgctggtgtgggcgtctggaaggttcgccatcttgccgacagcaaattgcttatcaaagaagagacgatatttacccttaagccagggaccggacgtctggcgctaggtgaacagctttatgccgataagatcatcaatcgcccacgggtttttcaatggttgctgcgtatcgaaccggatctttctcactttaaagccgggacttaccgctttacaccgcagatgaccgtgcgcgagatgctgaaattgttggaaagcggtaaagaagcacagttcccgctgcgactggtagaagggatgcgtctgagcgactacctcaagcaattgcgtgaggctccgtatatcaagcacacgctgagcgacgataagtacgccaccgtagcgcaggcacttgaactggaaaacccggagtggattgaaggttggttctggccagacacctggatgtataccgccaataccaccgatgtcgcgttactcaagcgagcgcacaagaaaatggtgaaagcggtcgatagcgcctgggaagggcgtgcggacggtctgccttataaagataaaaaccagttggtgacgatggcatcaattatcgaaaaagaaaccgccgttgccagtgaacgcgatcaggttgcctcagtatttatcaaccgtttacgcattggtatgcgcctgcagaccgacccgaccgtgatttacgggatgggagagcgttataatggcaaactttctcgtgcagacctggaaacgccgacagcgtataacacctataccattaccggtctgccgccaggtgcgatagcgacgccgggggcggattcgctgaaggctgctgcgcatccggcaaaaacgccgtatctctattttgtggccgatggtaaaggtggtcacacgtttaataccaatcttgccagtcataacaagtctgtgcaggattatctgaaagtgcttaaggaaaaaaatgcgcagtaagtatatcgtcattgaggggctggaaggcgcaggcaaaactaccgcgcgtaacgtggtggttgagacgcttgagcaactgggtatccgcgacatggttttcactcgggaacctggcggtacgcaacttgccgaaaagttaagaagccttgtgctggatatcaaatcggtaggcgatgaagtcattaccgataaagccgaagttctgatgttttatgccgcgcgcgttcaactggtagaaacggtcatcaaacctgcgctggctaacggcacctgggtgattggcgatcgccacgatctctccactcaagcctatcagggtggaggacgaggtattgaccaacatatgctggcaacactgcgtgatgctgttctcggggggtttcgccccgacttaacgctctatctcgatgttaccccggaggttggcttaaaacgcgcgcgtgcgcgcggcgagctggatcgtattgagcaagaatctttcgatttctttaatcgcacccgcgcccgctatctggaactggcagcacaagataaaagcattcataccattgatgccacccagccgctggaggccgtgatggatgcaatccgcaccaccgtgaccaactgggtgaaggagttggacgcatgagatggtatccatggttacgacctgatttcgaaaaactggtagccagctatcaggccggaagaggtcaccatgcgctactcattcaggcgttaccgggcatgggcgatgatgctttaatctacgccctgagccgttatttactctgccaacaaccgcagggccacaaaagttgcggtcactgtcgtggatgtcagttgatgcaggctggcacacatcccgattactacaccctgactcccgaaaaagggaaaaatgcgctgggcattgatgcggtacgtgaggtcaccgaaaagctgaatgagcacgcacgcttaggtggtgcgaaagttgtctgggtaaccgatgctgccttactaaccgacgccgcggctaacgcattgctgaaaacgcttgaagagccaccagcagagacgtggtttttccttgctacccgcgagccagaacgtttactggcaacattacgtagtcgttgtcggttacattaccttgcgccgccgccggaacagtacgccgtgacctggctttcacgcgaagtgacaatgtcacaggctgcactacttgccgcattgcgcttaagcgccggttcgcctggggcggcactggcgttgtttcagggagataactggcaggctcgtgaaacattgtgtcaggcgctggcatatagcgtgcaatcgggcgactggtattcgctgctagcggcccttaatcatgaacaagctccggcacgtttacactggctggcaacgttgctgatggatgcgctaaaacgccatcatggcgctgcgcaggtgaccaatgttgatgtgccgggcctggtcgtcgaactggcaaaccatctttctccctcgcgcctgcaggctatactgggggatgtttgccacattcgtgaacagttaatgtctgtcacaggcatcaaccgcgagcttctcatcaccgatcttttactgcgtattgagcattacctgcaaccgggcgttgtgctaccggttcctcatctttaagagagacatcatgtttttagtcgactcacactgccatctcgatggtctggattatgaatctttgcataaggacgtggatgacgttctggcgaaagccgccgcacgcgatgtgaaattttgtctggcagtcgccacaacattaccgggttatttacacatgcgggatctggtaggcgaacgcgacaacgtcgtattttcttgtggcgtgcatccactcaaccagaatgatccctacgatgtagaagatttacgtcgtctggcggcagaagagggcgttgtagcgctgggtgaaaccgggctggattattattacacgccggaaactaaagtacgtcagcaagagtccttcatccatcatatccagattggtcgtgaactgaacaagccggttatcgtccacacccgtgacgcccgcgccgatacgctggcaattctgcgcgaagaaaaagtgacggattgcggtggcgtactacactgttttacagaggacagagaaacggcgggcaaattactggatctcggattttacatctccttttccggcattgtgaccttccgtaatgcggagcaactgcgcgatgctgcgcgttatgtccccctggatcggttactggtggaaactgactcaccttaccttgcgccagtaccgcatcgaggaaaagagaatcaacctgcgatggttcgtgacgttgcagaatacatggctgtgttgaaaggtgttgccgttgaagaactggcgcaggtaaccaccgataacttcgcccgtctgtttcacatcgacgcttcccgccttcaatccatccgttgaatgagtttttttaaagctcgtaattaatggctaaaacgagtaaagttcaccgccgaaaatcgggcggtgaataaccacgtttgaaatattgtgacatatgttttgtcaaaatgtgcaacttctccaatgatctgaagttgaaacgtgatagccgtcaaacaaatcggcactgaattattttactctgtgtaataaataaagggcgcttagatgccctgtacacggcgaggcactccccccttgccacgcgtgagaacgtaaaaaaagcacccatactcaggagcactctcaattatgtttaagaatgcatttgctaacctgcaaaaggtcggtaaatcgctgatgctgccggtatccgtactgcctatcgcaggtattctgctgggcgtcggttccgcgaatttcagctggctgcccgccgttgtatcgcatgttatggcagaagcaggcggttccgtctttgcaaacatgccactgatttttgcgatcggtgtcgccctcggctttaccaataacgatggcgtatccgcgctggccgcagttgttgcctatggcatcatggttaaaaccatggccgtggttgcgccactggtactgcatttacctgctgaagaaatcgcctctaaacacctggcggatactggcgtactcggggggattatctccggtgcgatcgcagcgtacatgtttaaccgtttctaccgtattaagctgcctgagtatcttggcttctttgccggtaaacgctttgtgccgatcatttcaggcctggctgccatctttactggcgttgtgctgtccttcatttggccgccgattggttctgcaatccagaccttctctcagtgggctgcttaccagaacccggtagttgcgtttggcatttacggtttcatcgaacgttgcctggtaccgtttggtctgcaccacatctggaacgtacctttccagatgcagattggtgaatacaccaacgcagcaggtcaggttttccacggcgacattccgcgttatatggcgggtgacccgactgcgggtaaactgtctggtggcttcctgttcaaaatgtacggtctgccagctgccgcaattgctatctggcactctgctaaaccagaaaaccgcgcgaaagtgggcggtattatgatctccgcggcgctgacctcgttcctgaccggtatcaccgagccgatcgagttctccttcatgttcgttgcgccgatcctgtacatcatccacgcgattctggcaggcctggcattcccaatctgtattcttctggggatgcgtgacggtacgtcgttctcgcacggtctgatcgacttcatcgttctgtctggtaacagcagcaaactgtggctgttcccgatcgtcggtatcggttatgccattgtttactacaccatcttccgcgtgctgattaaagcactggatctgaaaacgccgggtcgtgaagatgcgactgaagatgcaaaagcgacaggtaccagcgaaatggcaccggctctggttgctgcatttggtggtaaagaaaacattactaacctcgacgcatgtattacccgtctgcgcgtcagcgttgctgatgtgtctaaagtggatcaggctggcctgaagaaactgggcgcagcgggcgtagtggttgctggttctggtgttcaggcgattttcggtactaaatccgataacctgaaaaccgagatggatgagtacatccgtaaccactaatccgtaagacgttggggagactaaggcagccagatggctgccttttttacaggtgttattcagaattgatacgtgccggtaatgctgaaattacgcggtgcgccgtagacgatagaaccttccacgttggtatcgtaggttttgtcgaacaggttattgacgttcccctgtaacgagaagtttttcgtcacctggtagcgggtgaagagatccaccagcgcgtagctaccttgctcggcgcggaaggtgccatacggtgtcacggtgtcggtatacacgcgattttgccagttaacaccaccgccgaccgtcaactctggcatgacaggcaaccggtagctggtgaacattttaaccgtggtgcgtggcagattaggattaacggcgtttccttcgttatcttctgcaatatagcgcgttgcgccaaacgtcagctgccagttgtcggtaattgcgccgttgagttcaaattccacacctttactgactgtcccatccaccgctttataggcggtttcgccgttgctgccggggataggtgtaccggtggactgagcgacattatcctgctcaatacggaagatggctaacgtggtggtcagacggctattcatccagtccgatttcagacccagctcgtagttgttaccggtgattggagtcagatatttgcctgaactgtcacgatcattttgcggctggaaaatagaggtatagctggcgtaggtcgaccagttgtcattgatgtcaaacaccagaccagcgtaaggcgtggtgtggtttttctccatgctgtaagtcagcgtatcaacccgccagttggtataacgtgcgccgaggatcagatgcagcggatcggcaagggtgacacgagtggcagcatataacgatttcatatgtgtggtatcgtcctgcgccaggctctgtggtgaccagtcggtttgtgggaaattgccattaaagttgtagaaactgccaatttcatccgggaagatgttggcccatgaactgaagtaacgattgttttgtttgctgtaactgccaccaaacattagattgtgctgacgaccaaacaattcataactaccgtcagcgaacaaatccagcgcatcaactttacgtttgccgctgttccaaccggtgccgccgacataatcaaaaccaggtccataattactgtatggcccaaccagcataccatccgctttgtttacataggcatcgacatacatcattttgctgtcaaattcgacttcagagtgggtggcattcagcgtcgcttgccaggtatcagcaaaccgctgcttcagggtcataaagaccttgttgatctctttatcgttgtacgcccagtcaggtgcggtactgcgtgcgcgatcgtaactgttgctgctgccatcagtattccagcgcggtaaaccaccccaggttgggctattaacatcaatacgctgatattcgtaaccggctgaaagcatcgtaagatcgcctaaatcagcatcgacaatgccggagaagaaggtcttttcactgttgtagcggtccagccatgagtcgttattctggtagccgccgacaattcgtgcgcggattttaccatcttcggtgagtgggctttgtaaatccgccacataccgttctttgttccagctaccgtattccgccgagacatcgcctttaaattcacgactggtcgcgtgttttcgaaccatattaattgccgcagatggattacccgtcccggtcatgaggcctgtcgcgccacgcactacttctacgcgttcaaacagtgccatatcagaaagtgcgtcgcccagattccagcgcgattcaaaataggtggggataccatcaaccatatagttatcgatctggaatccgcgggaataataaagagcacgatcggaatccgcctgacttttgctgatccccagcgtgttttccatcacttcgcccagcgtttgtaactgctgatcttccatccgctgctggctaacaatagtgaccgactgaggaatatcacgttgagtcatctgcatttttgtacccgcagaggtagacgttacgttgtaatcattttcgccatcatctggggctgtggctgaaccctcaacaatcaccgtttcttcagtgactggtgcagcaaaagcggcggaaggtaatagtgccagtgctatgcaaccggcaaggagtgacggtttgatgatagcttgatgttgattatccctgttaaattgtgtcgaaagcatttgaaatctcttggtttatgttggcgtcaggctcatgccggagcagggtgatgagcggttatatttagtgtgcgaataattttgtatgtaaatgcaaatgagaaatatacgcattcatatttagtgtgtaaaccaaacagagaatgtcttttcagcgcattcgcaggcagaaatgggaataatggcgatatatacggcagcaaaacgattttttgcttaagaaatcgtgagttaaggttgaaagagcaggtttaactcgaccatactctatactcgcagtgtggcgcggcgtagcatggcgcaacgcatggctatttgaaaaaggaaaatgtcgtggcagaagaaactatattcagcaaaattattcgtcgtgagatcccctccgatatcgtctaccaggatgatctggtaacggcgtttcgcgatatttcgccgcaagcgccaacgcatattctgatcattccgaatatcctcattccgactgtgaacgacgtgtcagctgagcatgagcaggcgctgggacgcatgatcaccgtagcggcaaaaattgctgagcaagaaggtattgccgaagatggctatcgtctgatcatgaacaccaaccgccatggcggacaagaggtttaccacatccatatgcatttgttgggtggctgtccgctgggaccaatgctggcgcataaaggtctgtaacgatgagaaaaggatgctttgggctgatgtctctggcgttgttagtgctggtgggctgtcgttcacatccggaaattccggtgaatgatgagcaatcgctggtgatggagtcatctttattagctgcgggcatcagtgcagaaaagcccgtcctttcgacatctgatattcaaccttcagcatcctcaacgctttataacgaaaggcaagaacccgttaccgttcattatcgtttttactggtatgacgccagagggctggagatgcatcctctggaaaggccacgcagcgttaccattcccgcacattcggcggtcacgctgtacggcagcgccaattttctgggggcgcacaaagtcagactttatctatatttgtaaggggtgaatcttgatgacaaaaatgagtcgctacgccttgattaccgcgctggcgatgtttcttgccgggtgtgtggggcaacgtgaacctgcaccggtagaagaagtgaaaccagcgccggaacaacctgctgagccacaacagcctgtccccacagtgccatcggtgccgacgataccgcagcagccaggcccaattgagcacgaagatcaaactgcaccgcctgcgccgcatattcgccattatgactggaatggcgcaatgcagccgatggtcagtaagatgcttggggctgacggcgtgactgcgggtagcgtcctgctggttgatagcgttaacaaccgtactaatggttcgttgaatgccgcagaagcgaccgaaacgctgcgaaatgcgctggctaataacggtaaatttaccctggtttccgcccagcagctgtcgatggctaagcaacaattaggtttgtcgccgcaggacagtttaggcacccgtagtaaagccataggcattgcccgcaatgttggcgctcattacgtgctgtactccagcgcctctggcaacgttaacgctccgaccctacaaatgcagctgatgctggtgcagacgggcgaaattatctggtcaggtaaaggtgccgtttcgcagcaataatcccctcacgcgcgacgaattgctgtcgcgctttttcccgcagtttcatcccgtcacgacgtttaatagtgggcttagtggcgggagttttctcattgaacatcagggccagcgttttgttgtgcgtcagccgcacgatcctgatgcgccgcagtccgcgttcttgcgccagtatcgggctttatcacaactacccgcatgcattgcaccgaagccgcatttatatctccgtgactggatggtggtcgactatctgcccggcgaggtaaaaacgtatttgccggataccaacgaactggcaggcttgctgtattatctacatcaacaaccgcgttttggctggcgaataacgctgttgccgttactggaactgtactggcagcaaagcgatccggcgcggcggacagtgggttggctgcgaatgttaaaacgtctgcgcaaagcgcgggaaccacggcttttacgcttaagtccattgcatatggatgtccacgccggaaatttagtgcatagcgcgtcagggttaaaactcatcgactgggagtatgccggagatggtgatatcgcgctggaactggcggcggtgtgggtggaaaatattgaccagcatcggcaattggtcaatgactatgccactcgcgcgaagatttatccggcgcaattatggcgtcaggtcaggcgatggtttccctggctgctgatgctcaaagcagggtggtttgagtaccgctggcgacaaaccggcgatcaacaatttatcaggctggccgatgacacgtggcggcagctattaataaaacaataaggagagcagtgtgggtccagtaatgttggatgtcgaaggttacgaactggacgcggaagagcgtgaaatactggcgcatccgctggtgggagggctgattctctttacgcgaaactatcatgatcctgcccagttacgtgaactggtgcgccagatccgcgcagcatcgcgcaatcatctggtggtggcggtagatcaggaaggtggacgcgtgcagcgttttcgtgaaggttttacccgcttgccagcggcacaatcattcgctgcgctgttgggaatggaagaaggcggaaaactggcgcaagaggcaggttggttgatggccagtgaaatgattgctatggatattgatatcagctttgcgccagtgctggacgtcgggcatatcagcgcggcgattggcgagcgttcttatcatgccgatccacaaaaagccctggcaattgccagccgttttattgatggtatgcatgaagcgggaatgaaaactaccgggaaacacttcccaggtcacggtgcagtaacggcagactcacacaaagaaacaccgtgcgacccacgtccgcaagcggagattcgcgctaaagatatgtcggtcttcagttccttaatccgcgaaaataaactcgacgccattatgcctgcgcatgtgatctacagtgatgttgatccgcgtccggcgagcggttctccctactggctgaaaaccgttttgcgtcaggaattgggttttgacggcgtgattttctctgacgatttatcgatggaaggcgcagcgattatgggcagttatgccgagcgtggacaggcatcactggatgcaggttgcgatatgatcctggtctgcaataatcgtaaaggggccgtcagcgtgttagataatctgtcaccgatcaaggcagaacgtgttacacgtttgtatcataaaggttcattttcgcgacaggaactgatggactcggctcgctggaaagcgatcagcacccgtctgaatcagttacatgaacgctggcaggaagagaaggcaggtcattaaccctggcttatgtgaggaagcgatgattatctatttgcacggttttgactctaacagtccgggtaaccacgagaaagtcttacaattgcagtttattgacccggatgtacggctaataagctacagtacgcggcatccgaaacatgatatgcagcatttgctcaaagaagtggacaaaatgttgcaactgaacgtcgacgagcgcccgctcatttgtggtgttggtctgggcggttattgggctgagcggattggttttctctgtgatatccgccaggtgatcttcaaccccaatttgttcccttatgagaacatggaagggaagattgatcgcccggaagagtatgccgatattgccactaagtgtgtgaccaacttccgtgagaagaatcgcgatcgttgcctggtgattttgtcgcgtaatgatgaagcgcttaacagccagcggacatctgaagagttgcatcattattacgagattgtctgggacgaagagcagacgcacaaattcaagaatatctccccgcatttacagcgcattaaagcgttcaaaaccctcgggtaaatgccctcgtcgcatcaggtaaccttgccggtacctgatgcgctccggattctgtgggttggataaggcgttccgccgcatccgacagtcgagcatcaatgcctgatgcgcctcttatcaggcctaccgaacgccctccatacacacctcactctatatcattctcacaaatcagctcaaataataaacaacaaactctgttttttgatctcacccggtaaagtcgcctatcttttcagcaacaaaacttgattaacatcaattttggtatgaccaatgcaccattcatgttattctcaatagcgaagaacattttcattgctgtaacctgttgttaattaagagctatgttaataaccattaattaacaattggttaataaatttaagggggtcacgttgactacgccattgaaaaaaattgtgattgtcggcggcggtgctggtgggctggaaatggcaacacagctggggcataagctgggacgcaagaaaaaagccaaaattacgctggtcgatcgtaaccacagccacctgtggaaaccgctgctgcacgaagtggcgactggctcgcttgatgaaggcgtcgatgcgttgagctatctggcccatgcgcgcaatcatggtttccagttccagctgggttccgtaattgatattgatcgtgaagcgaaaacaatcactattgcagaactgcgcgacgagaaaggtgaactgctggttccggaacgtaaaatcgcctatgacaccctggtaatggcgctgggtagcacctctaacgatttcaatacaccaggtgtcaaagagaactgcattttcctcgataacccgcaccaggcgcgtcgcttccaccaggagatgctgaatctgttcctgaaatactccgccaacctgggcgcgaatggcaaagtaaacattgcgattgtcggcggcggcgcgacgggtgtagaactctccgctgaattgcacaacgcggtcaagcaactgcacagttacggttataaaggtctgaccaacgaagccctgaacgtaacgctggtagaagcgggcgaacgtattttgcctgcattgccgccacgtatctctgctgcggcccatagtgagttaacgaaactaggcgttcgcgtgctgacgcaaaccatggtcaccagtgctgatgaaggcggcctgcacactaaagatggcgaatatattgaggctgatctgatggtgtgggcagccgggatcaaagcgccagacttcctgaaagatatcggtggtcttgaaaccaaccgtatcaaccagctggtggtggaaccgacgctgcaaaccactcgcgatccagacatatacgctattggcgactgcgcgtcatgcccgcgtccggaagggggctttgttccgccgcgcgctcaggccgcacatcagatggcaacctgcgcaatgaacaacattctggcgcagatgaacggtaagccgctgaaaaattatcagtataaagatcacggttcgctggtatcgctgtcgaacttttccaccgtcggtagcctgatgggtaacctgacacgcggctcaatgatgattgaaggacgaattgcgcgctttgtatacatctcgctgtaccgaatgcaccagattgcgctgcatggttactttaaaaccggattaatgatgctggtggggagtattaaccgcgttatccgtccacgtttgaagttgcattaatcggcttgtactggcggatgcggcgtaaacgccttatccgccctggacaaatggtacgagcggtaggcctgataagacgcgttaagcgtcgcatcaggcattccttcagactcctccgaatccctaagtatttccagccattcccgcgcttttcatcttctgtctgatagctgcttttctccttcgcttgcatgattggcataacagcaaagaaggaggtattcccgtgaataagtcaatgttggcgggtatcgggattggtgtcgcagctgcgctgggcgtagcggcagtggccagtctgaacgtgtttgaacgtggcccgcaatacgctcaggttgtttctgcaaccccaatcaaggaaacggttaaaacaccgcgtcaggagtgtcgcaacgttacagtgacccatcgtcgaccggtgcaggatgaaaatcgcattaccgggtcggtgctcggcgctgttgctggcggcgtgattgggcatcagtttggtggtggtcgcggtaaagatgtcgccactgttgtgggggcgctggggggtggatatgcaggtaaccagatccagggctctctccaggaaagcgatacttacacgactacgcaacagcgttgtaaaacggtgtatgacaagtcagaaaaaatgctcggttatgatgtgacctataagattggcgatcagcagggcaaaatccgaatggaccgcgatccgggtacgcagatcccgctagatagcaacgggcagctgattttgaataacaaagcataacaaggttgtactctgcaatttagcccctcattcgctcaagctgaggggctttttttgcgacctatttcagcagttccggccataaacgcaaagtcgttcgggcaatctgcatcagtttttccagcgatgcaccttcgcgtgcgctgatcgacatcccctgaataatacaattaaggaattctgccagatgcgtcacgtcacagtgggtcgggatttccccgcgcgcttgtcgttgacataaaaactgctgcaaagtgcgctcttgcatcgcatggcgtgatttcagcgtattggcgatatctcctgaatccggggagagggtggtgcagttgttgatcatgaagcagccagccggagtgtctttgctggtaaagcagttggcgatggcagcaaaatagtcagccagcgcagactccacgcttttctcttcacaaaacagctgtgcttcatgcttggcggcaaaacgatcgatatagcggtcgagtacggcgcggaataacccctctttgttggtaaattccgcgtatagcgtgggcgctttagctccggtcgcttcaacgaggtccgcaagagaagtcgcttcataaccgtgctgccagaacaatttcatggccttatcaagcgcggcatccctgtcgaacacttttgggcggccacggcttttttttacacattgtgttgagtcagttgccatgatgccgttgtacctggtgactgtgaatgaaaggttattataaaaataatcacctccgttcaccagtccagaaaccataaaaataatcgctttatatttaactgaaatttaaaggtttttaaattaattaatgattgttataaaaaatatcttgtatgtgatccagatcacatctatcatttagttatcgatcgttaagtaattgcttgcgacgtcattcatctgcataaggccactattatgaaaaacgtaaaaaacctcatcgctgcggcgattttaagctccatgtcatttgccagctttgcggctgtcgaagttcagtccacgccagaaggccaacaaaaagtcggtactatcagtgctaacgcggggacaaatctgggatcgctggaagagcagttggcgcaaaaagcggatgagatgggcgcaaaatctttccgtattacttctgtaaccggtccgaataccctccatggaacagcagtaatttataaataagcattaaccctcattaatgcctgctactgctgattttttccccgcgacatgccgtgtcgcggggatttttttatccgagctttacagagtttgtgggctcacttgatgacggcggacatccaccggcatcccggaacggacatccatcacatgttgcatcacttcagcgtcagtttgtgctgcatctttaaatgattgcattgcgctattcagcgtaattggcagcagctgcggatcgtcatcaatcttctcagacagcggctgatgtacttcaaccagacgcgcaccgtttggttcggcagagacttttatcggagtgttgatgatattcactttggtgcctggggtgacctggctaaagagtgttttgatatcgtcatcccgcagacgaatacagccagaacttacccgcatgccaatgccgaaatcggcgttcgtaccatgaagcaaataaacgccgccataggccgccagacgaatcgcatgatggcccattgggttatccggtcctgccggcactaccgcaggcaactcaattccctgtgccttataccgcgcgcggatgtttgccgttggcgtccaggttgggtttgcacgtttgtctgaaacggtagtcaccatcgttggcgtcagcgtgtcaccacctaactgaccaatgccgatgggatacacggttaccgaatttttacccggcgggtagtaatagagacgcagctccgcaatgttgatcacaatgccttcgcgcggcgcgtctggaagtagggtttgcaacgggatcgttaacacgctacccgcgcgcggtacgtaaggatcaacgccggggttagcctgtaacagagcgagaaagccgacgttatattttttggcgatcgcttccagagagccaccgtcattttccaccacatgaaatttgttttcaccaaccagacgactgcccgcttgcggcagcggccaggtgttggcttttgccggtagcgccagcgccacggcagcggcgaacgtaaaaaacgttagccagcgagaaaaatgcgttttgatcatcaccaaaaatccataataaatataaggttattgtaataaacagataagcctgaattatggatggtgacagtgtcggatagtgcagggaagtgcaaagaatttgtaaatgttgcagatgggggcgcagaaacgcccctaatctaaccatcaagcgatcgcgttctcttccagttcacgcataaactggcgtacccattcgatacgcgttttccgctcactcaaatcctgaataaacttcaggcgcgtcggaccatcaaggcggtaatgctgcggctgtttttgcagcaaaccaatcaaccaggccggattaacgtgattcttctcggcaaattcgatcacgccgcctttctcattaccttccagcttcctgatccccagtttctgcgcttgctggcgcagacgggcaatatccagcagggtacgcgccggatccggtagcaggccgaagcgatcgataagctcgactttgatctcttccagttcgttttccgttttggcgctggcaatacgtttgtagaacgacagacgcgtgttcacgtcagggatgaaatcatctggcaatagcgacggcatccgcaggtcgacttctgtttgctggctggtgagatcttccagcgacggctcgcgtccggctttcagcgcatcgacggcgttttccagcaactccatatacagcgagaaaccgatggtttccattgagccgctttgttcttcgccaagcagttcacctgcgccgcggatctccagatcgtgcgttgccagcgcaaaacctgcaccgagatcttccagcgaggcaatcgcttcaagacgtttttgcgcatcggtagtcatcgcttttggatgcggcgtcagtagccatgcatatgcctggtggtgagaacgcccgacgcgaccgcgcaactggtgcaactgtgccagaccgaagtgatccgcgcgttcaatgataatggtgttggcggtaggaatgtcgatcccggtttcgataatggtggtacaaaccagcacgttgaaacgttgatgatggaaatcattcatcacccgttccagttcgcgctcacgcatttgcccgtgaccgatggcaatccgcgcttcaggtaccagttctgccagccgttcggcggctttctggatgttttccacatcattgtagagataataaacctgtcctccgcgcaaaatttcacgcaggatcgcctcccggaccaccagactgtcatactcacggacaaaggttttaactgccagacgacgggcgggcggcgtggcgataatcgacagatcgcgcattccgctcattgccatattcagcgtacgtgggatcggcgttgcggtaagcgtcagaatatccacgttcgcgcgcatcgctttaatgcgctctttatgacgcaccccgaagcggtgttcttcatcgacaatcagcaggcctaaatctttaaacttgacgtcactttgcagcagtttgtgcgtaccgatcagaatatcgattttcccttccgccacttccgcaaggatttgcgtctgctctttggcgctgcggaaacgggagatcatttcgatacgtaccggccagttggcgaaacggtcgcggaagttgtcgtaatgctgctgcgcgagaagggtggtaggcaccagcaccgccacctgtttgtggttatctaccgccaggaaagcggcgcgcatcgccacttctgttttaccaaagccaacatcgccgcacaccagacgatccattgccagcggctgacacatgtcgctaagcaccgcattaatggcttgagcctgatccggcgtggtttcaaacgggaagctgtcgcagaataactgatactgctcacgatcgtgtttaaacgcgaagccctctttggcggcgcgttgcgcgtagatatccagcaattccgccgccacatcacgcactttttccgccgctttctgccgtgcgcgtgaccaggcatcgccaccaagtttatgcagtggtgcgttttcttctgcgccacccgcgtaacggctaatcagatgcagtgacgacaccggaacatacagtttggcgtcgttggcataggtgagcatcaaatactcgccagtaatgcctccagcttcgagcgtggtcattccggcataacgaccgacgccgtgctccagatggaccaccggctgaccaatatgcagctccgcaaggttacggatcagtgtatcggggttgatggcgcggcgagaatcctgacgacgacgggcaacgcgttcaccgagcagatcgctttcgcaaatcagcgccaggttacgcatcgtatcgacaaaaccatgttcggcagcgccaatcatcagataacgcccacggtcgctggcttcatcaagacgcataatgcgttgcggagcaattttaattcgcgcgagcagttcacccagcgcttcacggcgaccttcactttctaccgagaacaccaccggaccgtcgaaagtctcgaggaacttacgcagcgcatccagcggcgctttttgttgtgcctgaatggccaggtctggcagtttctggaaacctaaattggcattcgctgcttttgtcggtaaatgttcagtttttagctgcacacgcggccagtttttcagctctgaaaagagctcatccacccgcagccagagcgattgtggtggcaacagtgggcgcattgggtcgacgccgcgattctcaaaacgcgccagcgtgtcagcctggaaacgttcggcactgttttccagatcgccagtattcaccaacagcgtattggcagggaaataactgaacagtggcggcagcggttcgctgaagaatagcggctgccagtactcgatcccggcaggtaatgtgcctttactcacttgctgataaatatgttccgggtcgcgcttcacttcgaaggtatcacgccactggctgcggaacagttcaattgccgctttatcggtcggaaattcgtgcgcgggaagcagattgatcgcttctacttcctccagcgtgcgctggctatcgacgtcaaacacccgcaggctgtcgatttcatcatcaaagaaatcaagacgataaggcagctcactccccatcgggaagagatccagcaacgcgccgcgcgtggcgtattcgccgtgctccatcacctggtcaacatggcgataaccggcgctgtccagttgggttcgtaatgcatctcgtgacaggcgctgaccttttttcatcaccagcgcatgaccgtggagaaaactgtgcgggcaaacgcgctgcataagcgtattcaccggaacaatcagtacgccacgctgcatcgtcggtagctggtaaagggtggaaaggcgcgaggagataatgtcctgatgaggcgaaaaactgtcgtaagggagggtttcccagtccgccaggttcatcaccatctgatcggtgaactggctgatttcatcatgcaaacgcagagcattttgcatatctggcgcaataagcaccactggtccggcgtgacgttcggcaatttccgctaccagcgttgcgcaggcagcgccagttaactcgcccagcagacgctgctcacccgctttgacgggcagcgtataacgatattgttcaggcataacggttgtcagattctcgttaggatatgcctcaacatatgggggcatatctctgataagcaatgctgttcattatccgtaatcgacatggtttagcaaattgaatcgccccggctggggcgatggcttagcgggagtaactgacggccgcgggcagagaaggcggggagaacaacagatcgctgaatgcgcgctgtgaaagttttcttaccagcaagcccgcaacagtacagatgaacaaactaacaaaggggtaaaccagcaggagtgtcagttcgacttgcggcgaccagcgtgctgcgttcatttgcgcaagcagagttaagctgaatatttcaaccagaatgcgatgggtggtgtagatagcaatggtgttggaaccaatcacattcagcaggctggtggagcgcataccgaaacgttgttcgtactgataaaacagcttcatgatcaccacaatcgataccagcgacaacagcagcgagatattaaacaaccaggcaccgaccgccagaacggccagcaaagaagccatcagcagatggcggcgcaacggtaccgctttaacacaggtcattaatgttgcgccaaaccatgcgccaaggctgtaataaggcaaattgcggctcacactgttcattccccaccacggtgtgggtacgaaattaacagccacactcatcagtataaacagaacaaataacggcagggccaggcggttaaaaattttacatatcacgaaatagacaattaacgcatacagataccacaagctggtgctggcggtgatcatcccgtgcaggaactcaccggtggaatcggcataagcggcattggaggcattgcttaaattgcgctcaggtgccagccactgatttagtgcacttagcgccagccactgcaccacgccccaaagcgccagcacccagaagatgttccagatgcgtttatcgagacaatttccccacggtacgctgtcgatatagcggcgaatcaaatagccagagataaagaaaaaaaccggcatacgaaagggtgcaaggtaaagattgaaatagatccagcatttgctcaggacttctgataacggatgctggaaagtggtcagatgcggataaaaggtaatgaccgagtgataaatcaccaccagacaaatacataaccctttgatctggttaatccatagctctttttgtttcatcaggacaacacgctctttttatttaacatgcggttgatcctgcggggcgagtcgcgtggtgtaatgcgtatctgtctgtatttggttatttttcagataaagctcagcccacaaggccgatgagaaaatgaggcactttagccgattgatttgccggtgcttttcagattagccctgacgatcacttacagttcagacgtttacccatcccgctttcgcttatatactcgtgtctttgctaacagcaaccagacggatttcatgtaccaacctgtcgctctatttattggcctgcgttacatgcgtgggcgtgcagcggatcgcttcggtcgtttcgtctcctggctttctaccatcggcattaccctcggggtgatggcgctggtcacagtattgtcagtgatgaacggctttgagcgcgagctgcaaaacaacatccttggcctgatgccacaggcaattctctcttctgagcatggctctcttaacccgcagcaactcccggaaacggcagtcaaactggacggcgttaatcgcgtcgcacctattactaccggtgatgtggtactgcaaagcgcgcgcagcgtggcggtcggggtgatgctgggtatcgacccggcgcaaaaagatccactaacgccgtatctggtcaatgtgaaacaaactgacctcgagccggggaaatataatgtcatcctcggtgaacagcttgcctcacagttgggcgtcaatcgcggtgatcaaatccgcgtgatggtgccatctgccagccagttcacgccgatggggcgtattccaagtcagcgcctgttcaatgtgattggcactttcgccgccaacagtgaagtcgatggctatgaaatgctggtgaatattgaggatgcctcgcgtctgatgcgttatccggcaggcaatattaccggctggcgtttgtggctggatgagccgctgaaagtcgactcattaagtcagcaaaaactgcctgaaggcagcaaatggcaggactggcgtgaccgtaaaggcgagctgttccaggccgtacgcatggaaaaaaatatgatgggcttgctgctgagcctgattgtcgccgttgcggcgtttaacattattacctcgctgggactgatggtgatggagaagcagggcgaagtggccattcttcagactcaggggctgactccgcgtcaaatcatgatggtctttatggtgcaaggggccagcgctgggattatcggtgcgatcctcggagcggcgcttggcgcactgcttgccagccagttgaataatctgatgccgataatcggcgtcctgcttgatggcgcggcgctgccggtcgctatcgagcctttacaggtcattgttattgcgctggtggcgatggctatcgcgctgctgtctacgctttacccttcctggcgcgctgccgccactcaacccgctgaggctttacgttatgaataagatcctgttgcaatgcgacaacctgtgcaaacgctatcaggaaggcagtgtgcaaaccgatgtactgcacaatgtcagtttcagcgtgggcgaaggtgaaatgatggcgatcgtcggcagctctggttccggtaaaagcaccttgctgcacctgttaggcgggctggatacgccaacctccggcgatgtgatctttaacggtcaaccgatgagcaaactgtcgtcggcggccaaagcggaactgcgtaaccagaagctgggatttatttatcagtttcaccacctgttgccggattttaccgccctggaaaacgtggctatgccgctgttgattggcaagaaaaagcccgctgaaatcaacagccgtgcgctggagatgttaaaagcggtggggctggagcatcgtgcgaatcaccgcccatctgaactttctggcggcgaacgccagcgtgtggcgattgcccgtgcgctggtcaataacccgcggctggtactggcggatgaacctactggtaacctcgatgcacgtaacgccgacagcatcttccagttgcttggggaattgaatcgcttgcagggcaccgccttcctggtggttactcacgacctgcaactggcgaaacgtatgagccgccaactggaaatgcgtgatggacgtttgacggcggaactgagcctgatgggggcggagtaatggcgatgcctttatcgttattgattggcctgcgttttagccgcggacggcgacgcggcggcatggtgtcgttgatctccgtcatttctaccattggcattgccctgggcgtggcggtattgatcgtcggcttaagcgcgatgaacggctttgaacgcgaactgaataaccgcattctggcggtagtaccgcacggtgaaattgaggcggtagatcagccgtggaccaactggcaggaagcactggataacgtgcagaaagtgccgggcattgccgccgctgcgccgtatatcaatttcaccgggctggtggagagcggcgcgaatctgcgcgcaatccaggtgaagggcgttaacccgcaacaggaacagcgtctgagcgcattaccctcgtttgttcagggggatgcctggcgcaattttaaagcgggcgaacagcaaattatcatcggcaaaggcgtggcggatgcgctgaaagtgaagcagggcgattgggtgtcgattatgatcccaaattcgaatcccgagcataaactgatgcagccaaaacgtgtgcgtttgcacattgccggtattttgcagttgagtggccaactcgatcacagttttgccatgatcccgctggccgatgctcagcaatatcttgatatgggttccagcgtgtcaggtattgcccttaaaatgacggatgttttcaacgccaataagctggtacgcgatgcgggggaagtgaccaacagctatgtttatattaaaagctggattggtacttacggctatatgtatcgcgatatccagatgatccgcgccattatgtatctggcgatggtactggtgattggtgtggcctgtttcaacatcgtctccaccttagtgatggcggtgaaagacaagagtggcgatatcgcagtattaagaacgctgggggcgaaagatggtttaattcgcgccatctttgtctggtatggattgctggcagggctgttcggcagcctgtgtggtgtgattatcggcgtagttgtttcactgcaacttaccccgattattgagtggattgaaaagctgatcggtcatcagttcctctccagcgatatctattttattgacttcttgccatcggaattgcactggctggacgtcttctacgtactggtcacagcattgttgctgagtcttttggcaagctggtatccggcgcggcgcgccagtaatattgaccctgcgcgagtccttagcggccagtaaaggcagtacattaaaacaaggagcggcaatgtattacgggtttgatattggtggaacaaaaattgcgctaggcgtgtttgatagcggtcggcagttgcagtgggaaaagcgggtgccgacaccgcgtgacagctatgacgcatttttagatgcagtgtgcgagctggtagccgaagctgaccggcgttttggctgtaaaggttctgtcggcatcggtattccgggaatgccggaaacagaagatggtacgctgtatgccgccaatgtccctgctgccagcggtaaaccgctgcgtgccgacctgagcgcacgtcttgatcgcgatgtacgccttgataacgatgccaactgctttgccctttctgaagcatgggatgatgaatttactcaatatccactggtgatggggttgattctcggcaccggcgttggcggcgggctgattttcaacggtaaacccattaccggtaaaagctatattaccggcgagtttggccatatgcgtctgccggttgatgcgttaaccatgatggggctggatttcccgttacgccgctgcggctgtggtcagcatggctgcattgaaaattatctgtctggtcgcggttttgcgtggctgtatcaacactattatcatcaaccgttgcaggctcctgagatcattgcgctttatgatcaaggcgatgagcaggcaagggcgcacgttgagcgttatctggatttattagcggtttgtctgggaaatatcctgaccattgttgaccctgacctggtcgtcattggtggtggcttatcgaatttcccggcaatcacaacgcaactggcggaaaggttgcctcgtcatctcttacctgtagctcgtgttccgcgcattgaacgcgcgcggcacggtgatgcggggggaatgcgtggtgcggccttcctacatctaaccgattaaacaacagaggttgctatgctgtcgcgtcggggtcatcggttaagtcgttttcgtaaaaataaacgtcgcctgcgcgagcgtttgcgtcagcgtatttttttcagagataaagtggtgccggaagcaatggaaaaaccaagagtactcgtactgacaggggcagggatttctgcggaatcaggtattcgtacctttcgcgccgcagatggcctgtgggaagaacatcgggttgaagatgtggcaacgccggaaggttttgatcgcgatcctgaactggtgcaaacgttttataacgcccgtcgtcgacagctgcagcagccagaaattcagcctaacgctgcacatcttgcgctggctaaactgcaagatgctctcggcgatcgctttttgctggtgacgcagaatatcgacaatctgcatgaacgcgcaggtaataccaatgtcattcatatgcatggggaactgctgaaagtacgttgttcgcaaagtggccaggtcctcgactggaccggagacgttacgccagaagataaatgccattgttgccagttcccggcacccttgcgcccgcacgtagtgtggtttggcgaaatgccactcggtatggatgaaatttatatggcgttgtcgatggccgatattttcattgccattggtacttcggggcatgtttatccggcggctgggtttgttcacgaagcgaaactgcatggcgcgcacaccgtggaactgaatcttgaaccgagtcaggttggtaatgaatttgccgagaaatattacggtccggcaagccaggtggtgccagagtttgttgaaaagttgctgaagggattataaagcgggaaaaattgcctgatgcgctacgcttgtcaggcctgtgaaggggcgcaatcaattgaatttgcgggttttgtgggccggataaggcgttcgcgccgcatccggcataatacatgcgaactttactgcctcttttaccgtttactcgtccatagtaacgcggcaataaacgtacagacaccaatcagccctgcccagagtggcgatattctggtaatcgcaaagctgttatcgatatacaaacataaagcctgataacccatattggcaacagccatcgccactgcaaattttaacgcataataaaggcgcgttgtgtagttaaaaaatgcagcaaagacgatgaatgcaactgcccaggcaaaaaggcctaatgtcgtggtactgccgggtggatcattttcatgctgttgtccgggatgcggataatatgtcagtggtggcgtcggttgttttaatatttgtgcttgtaaaacagccaatgcattattgataccctgataccagagatccgcatgtaaataagccagcgtgtgattttctaccagaaggccgagatgtttatcgtccatactgctttcgacctggccgttggttatcataattaaccgtggctcgcgggtagtaaagagtaacaggacgctgccttttacattactcattgaagatgccgcatgcgccagcatcgctttgccattttgcctgagactggcttcattattaatgtcgggtaaaaccacaataaacggtgcaactccggtttgttggcgaaaaagctcggctttatgcgcgatctcttcagcatctggtacagtaccggtaacatctgtaaaaagagtcttcattattggaatcaatggattactggtcgccgttagaggcaggagtatcagtaaactgagcaatattatgatttttttcatgggcgggacttccgtttcctgcgtgtcttttttgaggagggcatactgattaataaaccgacggcgataaaaataacgcccataatgccgataaacccccatttaaaaaaattaacccacgggttatttatctcagccttttcaggatgtcctggagaataataaacattaactttatcgccttcgctgtcttcataaaaatcgctgccaatactcgaattgaaaattagcgtgtaatctggcgtcggacgaaagacaacgacgggataccacgaaccatttttacccgtgcgatgagaatgactggagtgccagacggtatcaacaatgacgccttcagtatgaatcgcgtctttgctataggtgaactggttataaaagataacaacagaaatgaggatcagtaccagaccgataccgaagaatatacgaaagaaaactctactgtcctggctcattagccacatccttgctaaataaaaaacgggcggtaataccaccgcccacttgctgaattaacgtcctgctttcagcttctgataatactcttcataaatgctgctggcggagcctacgtcattttgccattcaccatttttaatggtttcagcatccgggtagagcgttttatcgttcgccacttccggacttaacagcttacgcgccgcaaggtttggcgttggataaccgatagtttcagcaacctgttttgccacatccgggcgcagcaggaagttgatcaatttcagcgcgccttctttgtttttggcatttgccgggatcgccaggctgtccatccagaaaatgccgccttctttcggccataccacatcaattggcgtacccgcctggcgtgcaacgaaagcagaaccgttccagatcatgccgaggttaacttcgccttccatatacgggttagcggggttatcggagttaaacgccgcgacgtttggcatcagttttttcagctcgttgtatgcagcttcaatctctttcggatcggtggtgttaccggagtagcccagcttacgcagcgccatctggaacacttcacgggcatcgtcggtcagcagcaggctgcccttgtactcaggtttccacagatcggcccagctggtgacagatttcggatccaccgcatcaccgttaacgccaatcgccgttgcaccccagatatacggaatggaatagtcgttattcgggtcaaacggcttgttgagcatgtctggatcgaggttgctgaaattgcttaacttcgacttgtcgatcttctggatcatcccttctttacgcattttatcgacgtaataggttgaaggaaccaccaggtcataggcaccgtctttgtacgttttcagcttcgcgtacatggtttcgttcgactcgtaagtcgaatagataaccttaataccggtttctttggtgaactgttcaagcagtcctggcggcacgtactcggtccagttgtagaaatacagcgtgttgttgtcatcggcgtgagcggcgctcatgcccagtgccagagcacccgccgcgagcaggtggcgtgaccattttttcatttaacgtcccctgtgttacctttcgttttatcacgagcaataagctggctggcaattaccatcaccagcgacagcaccagtaatatggttgccagcgcgttaacttccggcgatacgccgactttgaccatcgaataaatttttaacggcagaatttcataactcggcccggtgacaaacgaagaaaccaccacgtcgtccatcgacagggtaaagcttaacacccagcccgccgctaccgctggcattgccagaggcagaatgatttttcgcagaatggtaaattcgctggcaccgagatctttcgccgcttccagcattcgcacgtcaaaacctttcaggcgcgaatacactgtcaccaccacaaatggcaggcagaaggtgatatgcgagaacagcagcgaccagaagccaagctgaatacccagcagcataaacagcaccagcagcgaaatcgccatcacgatatctggtgacatcatcaccacaaacagcattccgctaacgaacggtttaccacgaaagcgataacggtacagcgcaactgccgtcagtgaaccgataagcgtagcaaacgtcgccgaaaacaccgccattgttagtgaatgctgcgctgcctgtaacaggctgtcgttgttcatcagcaggctataccatttggtggtaaaaccctgccagttgatgccaaagcgcgagctgttaaaggagttcacaatcaaaataatgattgggatatacaggtacgcgtagatagcggtcataaaaccgccgcgaagcagtcgaccgatcattcgagttccaccttcttattcagcagacgagaagcgcgccagtaaaccagcaacatcaggcccattacgatagtcagcgtaatgctggtggctgcaccaaacggccagtcacgaatattgaggaactgtaccttgatgacgttaccgatcagcaggtttttcgcaccgcccatcaggtcggacacatagaacaggcccatcgctggcagcatcaccagcagacatccggcaataattcccggcatcgttagtgggataatgatgcggataaaggtctgcaacttgctggcaccgagatcgcgcgccgcctcaagcaacggcttatccagtttttcgatactggagtacagcggcatcaccataaacggcagcagaatgtaaaccagaccgataatcaccgcactaggcgtgaacatgatgcgaattggtgtatcgataacgcccagccagagcaaaaactcgttgagatagcctttggtgctgaggaaaattttcagcccgtaaatacgaatcaatgagttggtccagaacggaacaatcagcagaaacagcagcagcggacgcaccttgtgtggcagcttcgccagaaaccaggcaaaaggatagcccagcaccaggcaggcgagggtggcgatcagcgccatattcagcgagtgcaatagcacttcaaaatagagcggatcgagcagacgcgtgtagttatccagcgtaaagaccattttgacgaaactggcgtcgtcgcgggtcaaaaagctggtgccaatgatcatcaggttgggcagaaagacaaacaacacaagccaaccgacaatagtgacaatcactacattctggaacttacttgtgttcttcatcagccagtacgacctcccagctttctacccaattaatggccattttttggtcgagagagtggtcaaagtcaggatcgtcttcattgaagaattcgctgaccatcaccatcttgccattttccagctcaacaaccgactccagcgtcatgcctttgtagttacgctcgcgaacgtaaccaatcagcccttcggcgtggttgtcgtcgttaatctcttcaacacgtaagtcttccgggcgcagcagaacatgcagtttttgccccggttcaacggcgaagttaacgtagatattacattcgcggccttcaacgttggcgcgtacgcgctgctcgtcgagacgttcgatgacagtggcgttaaacatattgatttcgccaataaacccggcaacaaacaggtttttcggctcttcgtagatttcacgcggcgtgccgtcttgctcaatgcgaccatcgcgcatcaccacgatcctgtccgacatggtaagtgcttcttcctggtcgtgagttacgaacacgaatgtaatgccaagcttacgctgtaacgctttcagctcgttctgcatttgcttgcgcagtttgtaatccagcgctgagagcgactcatccagcaacaacagacgaggcttgttaaccaccgcgcgagcaatggcgacgcgttgctgttgaccaccagagagctgatgcggtttgcgttgagcgaaggtttccagctgcaccatccgcagggcttccatcacgcggggcgtaatttcagcagcgggggttttttgcatgcgcaacccaaaggccacattttcgaacacggtcatgtgggggaaaagtgcgtagctttggaaaacagtgttcacatagcggttttccgccggaacgtgggtgatgtcctcgttatccagcatgatgcgtccggaatcaacagtttccagacctgcaatcaggcgaagaacggttgttttaccgcagccagaagggccaagcagcgtgaggaactcgccattgttgatagtcagatccagctggggaatgacctctttaccatcaaagcatttgcgaattcccgccaattgcaccagcggtgaaagcgaattcggttgtttattcaattttttactctgtcccatgtaaacgcaacggatggcttaccgatgcggggtttgtggttaaccaccttggtgactcttaatgagggcggtaattctacggcaaaccgcttgaatcgccaatctttgttgtgaattactggcttagctttatattcattaaggtaatgctgataaatattcccgcttgcagggctaaaagtgacctgacgcaatatttgtcttttcttgcttcttaataatgttgtcacaaaaagtgagggtgactacatggataaactacttgagcgatttttgaactacgtgtctctggatacccaatcaaaggcaggggtgagacaggttcccagcacggaaggccaatggaagttattgcatctgctgaaagagcagctcgaagagatggggcttatcaatgtgaccttaagtgagaagggcactttgatggcgacgttaccggctaacgtccctggcgatatcccggcgattggctttatttctcatgtggatacctcaccggattgcagcggcaaaaatgtgaatccgcaaattgttgaaaactatcgcggtggcgatattgcgctgggtatcggcgatgaagttttatcaccggttatgttcccggtgctgcatcagctactgggtcagacgctgattaccaccgatggtaaaaccttgttaggtgccgatgacaaagcaggtattgcagaaatcatgaccgcgctggcggtattgcaacaaaaaaacattccgcatggtgatattcgcgtcgcctttaccccggatgaagaagtgggcaaaggggcgaagcattttgatgttgacgccttcgatgcccgctgggcatacaccgttgatggtggtggcgtcggcgaactggagtttgaaaacttcaacgccgcgtcggtcaatatcaaaattgtcggtaacaatgttcacccgggcacggcgaaaggagtgatggtaaatgcgctgtcgctggcggcacgtattcatgcggaagttccggcggatgaaagcccggaaatgacagaaggctatgaaggtttctatcacctggcgagcatgaaaggcaccgttgaacgggccgatatgcactacatcatccgtgatttcgaccgtaaacagtttgaagcgcgtaaacgtaaaatgatggagatcgccaaaaaagtgggcaaagggttacatcctgattgctacattgaactggtgattgaagacagttactacaatatgcgcgagaaagtggttgagcatccgcatattctcgatatcgcccagcaggcgatgcgtgactgcgatattgaaccggaactgaaaccgatccgcggcggtaccgacggcgcgcagttgtcgtttatgggattaccgtgcccgaacctgttcactggcggttacaactatcatggtaagcatgagtttgtgactctggaaggtatggaaaaagcggtgcaggtgatcgtccgtattgccgagttgacggcgcaacggaagtaagcgaaaagggatgcggcatgtgatgccgcatccggcttaaatccaaacttacccttcgaagaaccagtatccgctattgaccagcgccgcgagcatcgcgaggaatgacggatcttccagcgcatcgccaaaattctccgcggtcagcgcaatgttgctggcgagcgcatccagtgccggacggtgcggggaatcgatcttctcaccattggcatacacgtcgtcgccaatgcgcaatacgcgcagaccccccaggcgcaccagcacatcaccttgtttcagcgcatcgtagatttcatccggctgataaggcggctctggcggcgcgatgtccagttcatgacgtgactgggatataaactcgccaaaccattgtttaaagtgttccggctggttgatcaattcgagcatcatctcacgcagtttatccatctcttgcggcagaacgtccgcaggatgagcgcgaggtggaacatcaggatcgctgtagtagttgccgcccagttcacgttgcagcacataatcggcaaatccgctaatcagttcccgcgtatttggcgcgcgaaaacccacggaatagttcatcgcattttccagcgcgtagccttcatgcgggaatcctggcggaatataaagaatatcgccaggctccagctcttcatcgatgatggcttcgaacggatcgacctgtaacaggtccgggtgcgggcagtgctgtttcatttgcagcttttcgcccactcgccagcgacgacgaccggtaccctgaatgataaacacgtcgtactgatcgagatgcgggccgacgccgccgcccggtacagaaaaagagatcatcagatcatcaatacgccagtccggtagttcacggaacggtcgcattagcgcagcggtcggctcatgccagtggttcactgcttgcactaacaatgaccagttagtttcaccgagatgatcgtagctttcgaatggaccgtggctgacctgccatttgccatcctgatgactgaccagtcgactgtcgacttcgctttccatcgccagacccgccaactcgtctggagagatcgggtcaataaaattattaaagccgcgttttaacaccaccgggcgtttctgccagtgacgttcaagaaaatcgggccagttaagagtgagttggtattccatgttaagcatccacaggctggtatctgcaaccgattataacggatgcttaacgtaatgcgtgaagtatggacatatttattcatctttcggcgcagaatgctggcgaccaaaaatcacctccatccgcgcaccgcccagcatgctctctccggcgacgattttaccctcatattgctcggtgatttcgcgggctaccgccagccccacaccttgcccagggcgtaaagtatcaacccgttgaccacggtcgaaaatgacctctcgcttgcttaatggaataccggggccatcatcctcgaccacaatatagagatgctcgtcggtttgccttgcagaaatttcgacaaactcgaggcaatatttacaggcgttatccagcacgttgcccatcacttcgacaaaatcattctgctcaccaacaaagctgatttctggcgagatatcgagagagatattgacacctttgcgttgatacactttgttcagcgccgaggtgagattgtccaacagtggcgcgaccggatgcagctcgcggctaagcaatgtcccgccgcgcatactggcacgatgcaggtagtagccaatttgctgtgaaatgcggctgatttgctccagcattaccggctcagcatcactgacgctcatcttctcactacgcagagaacgcagcgtactttgcagcaccgccagtggcgttttcagactatgggtcaggtcggtgagcgttgtacgatatttgtcgtaacgttcgcgttcactttttaacagtcggttcaggtttcgtaccagactggtcagttctcgcgttgtggctggattgagcaattcacggttatgttcttccagttcgcggacttcttttgccagggcttcgatggggcgtaaactccaccaggcggcgacccacagcagcgggatcactaacagcagattggctgagagcacatagataaaccagctccagaccatataggaactttttagctccaccggaatggtatccaccaccacaatggttaactttggcatccgcgatgttgccgggtagacgtttaccgccaccgagtgggtcatctccgcgtcgtcatcatcttcccgcacttcctgcaactgttgctgtatcgaatgatctccactcagcaagaggctggtatcgttaacatccgcttcaatttcatgaaaaccattcgatttcagccagtcaggctggatcatcttcatcagccagggcacgtcacgttgcgcccataaaagctgcccgttctcatcataaattagtgtcatcgtggggctttgcttgtcgatattttcgggtaactcgacatgcaacttattgttttcccacttcgcaagggtatagaacagattgctctcgccacgtaacagccgaaacgtggttttatcgaaactgacgctataaccgatcagcgcaaccattccgtaggcaagcgaaagcaccaatactactgctgccgttgctaacagaaaacgtacccgcagcgagagcgggaaaaaaagatgcagtaattttttcatcagcgcaattcgaacagatagccctggccgcgaacggtggtaatcacttcttgcggatattgtgcctgtatttttttgcgcagacgtcccatcagtacatctatggtatgactttcccgcagctccgcatccggatagagttggagcattaacgaatctttgctcaccactttgccattattgcgtatcaacgtttccataatggtgtattcgaacgcggtcagtttgatcacttcgtcattaatagataattcacggcgggagagatcaacctgaaacggtggtagcgaaatgacctgtgaagccagaccgctattacgccgcattaatgcctgcattcgcgccatcacctcttcaatatgaaacggtttagtcacgtaatcatcagcaccggcacttaatacttcgactttgtcctgccagctctcacgggcggttaataccagaatcggcagtgaaacatcattgctacgccagcggcgaatcagtgacagaccatcctcgtcaggcaatccgagatcgacaatcgcaatatcaggtaaatgttcattgagataataatcggcttctttggcatcttctgcgtcatcgacctgatgaccagcatcctgtatctgaactttaagatggtgacgtaacaacgcattgtcttcaacaaccagtacgcgcatttttatttctccctgtcttaattattaaaatagtgtaacgcgattatgtggttatgggggtaaacattaaataaaccagcggggaggggaggtaaagtgaaaaaacaaaaagtggataatcttaataagcaggccggacagcatcgccatccggcactgttttgaggcttatttcagctcatcaaccatggtgatggcgcgaccaatgtagttagccggcgtcatcgctttcaggcgggctttctcttcttctggcaacgccagaccatcgataaactgcttcatgccttcggcgtcaacgcgcttaccgcgagtcagctctttcagcttctcgtacggtttttcgatgccatagcgacgcataactgtctggattggttcagccagcacttcccagttgtgatccagttcatccagtagatggtcacggttcacttccagtttgctcacgcctttcagggtggattgatacgcaatcagcgcataaccgatacccacgccgaggttacgcagcacggtggagtcggtcaggtcacgctgccagcgggaaactggcagtttgcttgccaggtgctgcaataccgcgttggaaaggcccaggttcccttcggagttttcgaagtcgatcgggttaactttatgcggcatggtggaagaaccaatctcaccagcaatggttttctgtttgaagtggttaagggcgatataaccccagacgtcacggtcaaagtcgatcagaatggtgttgaagcgcgcaacgcaatcaaacagttcggcaatgtagtcgtgcggttcgatctgggtggtgtacgggttccactgaatacccagcgaggtgacgaactcttcgctgaactgatgccagtcaacttccgggtaagcggcgatgtgggcgttgtagttaccgacagcgccgttgattttgccgaggatctccacctgattaagctggcggtactggcgctccatacggtaggcgacattagccatctctttaccgatggttgacggcgtggctggctgaccgtgggtacgagacagcagcgggatatcgcgatactgaacggcgagatctttaatgccatcaatcagttgacgccagtacggcaggatcacttcatcacgcgcggttttcagcattaatgcgtgggagaggttattgatatcttccgaagtacaggcaaagtggatgaattcagaaaccgcgtgcagttccgggatatccgccactttttctttcaggaaatactcaaccgctttaacgtcgtggttagtggtacgctcgatggttttgatgcgtgctgcatcttcttcgctgaaactggcgacaattgcatcaaggtaaccgattgcgtcggcagcaaaagcaggaacttccttgatcgctgcgtgcgcggccagtttttgcagccaacgtacttcaacttgtacacggaatttcagcaaaccgtattcgctgaaaatcccgcgcagcgcgctgactttatcgccgtagcgtccatcgacaggggaaacggcggtcagtgaggataattccatagatcacaactccggggttaaatgagcaagaatttgttttgcctgagtggtcaggcgattacgagaaaacatcagttgcagacgaccgccgccgacctggtgccagagcacggcggcgcgaatgcctgccagcagggttgcgcgaactttcgcctgcacctgtgggctttgcagtacagcaggggaaccagtgacctgaatgcgcgggccaagcgggctgataacatcaacatagatggcagccatcgcgctcatcagcgtttcggactgtaaatcgaagtgttcgagctggcgttgcaggccgttgatccggttgcccagagtgtcgagcgcacctttcgctgaggagagtttgcgctcaagcaccatcagactgagtgtgtagcgggttaattcggcgtttaagccctggcgactgctggcattgagtacgccgagcaaggtttccagcccgacgcgcaggttggcttcgctaccgccaaaaaccgccagcgttgagctggggttcatatcgataatactgttgagtgagacgtgtagcgcatcgccatcacaatgcccctggtgagcgagttgttgcaccaggcgtgccgactgacaaataccggcaagggcgagggtgatgtcatagtaattctttgccacgttcactgcttccttgttttaagtaaagataataatcagaccggcagcggcagacgctgctcaataataccgccaccgaggcacacttcaccgttatagaaaacggcagactggcccggcgtcacggcggcaaccggctcatcgaaaatcacttcaatgcgatcagcgtccagcgccttgacggtgcacgggatgtcggtctggcgatagcgggtttttactgtgcaacgcatagtaccggtgaacggctcgcgatcgacccagtgcagctgctgggcaatcagaccgacagacatcagacgcgggtgttcatggccttgcgcaacaatcagaatgttgttttcgacgtctttatcgaccacataccacggttcttcggtgccgtctttggtgccaccgatacccagacctttacgctgaccgagggtgtgatacatcagcccctggtgctcaccaatttcatcgccatcgacggtaatgattttgcccggttgcgccgggagataacggcccaggaactcgcggaatttacgctcgccgataaagcagataccggtagagtcttttttcttcgcggtgaccagaccgagatcttcagcaatcttacgcacctgcggtttttccagttcgccgaccgggaacaggctttgcgcaatttgctcatggctgagcgtataaaggaagtagctctggtctttattgctgtccaggccacgcagcaggcggctcttgccatcgacatctgcccgacgtacgtaatgaccggtagcgatataatcggcacctaaatcttcggcggcaaattcgaggaaagctttaaatttgatctctttgttgcacagaatatccggatttggcgtgcgaccggctttatattcggcaaggaacagttcgaagacgttgtcccagtactcggcagcaaagttaacggtgtgcagttcaatgccgagcttgtcgcagacagcctgggcatcagccagatccgctgccgctgtgcaatattcctcaccgtcgtcttcttcccagttcttcataaacaggccttcgacctgatatccctgttgttgcaacagccaggcagaaacggaggaatcgacaccgccggacatgccgacgattactttttttgcggtttcagacattggatcactcacgacattgaacttcaaggcggcgtattctatcacgcagccttttagatgacaccctttgtaaaaggccagttaaaatcgccaatcatctccagcggatagcgttgcccgctttgataacaacgaatactttccgccaccagcggcgaacgaagatttgacgcctgtaaaatttcttcggcgctgacccaacggcagcagtcgatatcgctgtcatgaggctgcgtcgggcatatttgctcaagctcaatggcaaagaggaaacgcaaaaacggcgttttatccggcgcaatccactgatgcatacgaataaagtgttgcggctgcgcgctaatgccggtttcttcccacagctcacgggcggcggcttccactaaggtttcatcggcttccaggtgcccggcaggttggttccataacgctttaccattaatcgtctcttcaacgactaaaaatttgccttctgcgtgcaccacgcaggcaacggtaacgtgcggtttaaacattttgcatccttaatctgtcgcgtctcgccattcgccattggcaagattatccaaagagtaatcccccatcgcatagcgaatcagtcgcagcgtggggaaaccaacatgggcggtcatgcggcgcacctggcgattacgtccctcatataaggtgatcttcagccagctggtgggaatacttttgcgctcacgaattggtggattccgcggccataaccacgcgggttcttcaaccagctccgcgcctgcgggcagggtagggccatcatttaaggttacgccattgcgcaaggcttcaagtgcgtcttgtgtgggaataccttccacctgcacataatagatttttccggtgcgtttacccggctgggttaaacgcgcctgcaacgcgccgttattggtcagcaccagtaacccttcgctgtcgcggtcgagacgacctgccgcatacaccccctgaaccgggatgaattcttttaatgttttgcgtccggcttcatcggtgaactgcggaagaacatcgtagggtttattgaacaggatcacacgcgtgggctggttttcaggtttacgcctggtagaacgttgcgagctgaatcgcttaacctggtgatttctaaaagaagttttttgcatggtattttcagagattatgaattgccgcattatagcctaataacgcgcatctttcatgacggcaaacaatagggtagtattgacaagccaattacaaatcattaacaaaaaattgctctaaagcatccgtatcgcaggacgcaaacgcatatgcaacgtggtggtagacgagcaaaccagtagcgctcgaaggagaggtgaatggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagttgagaaagcctataaaggcgagcgtaaaatctcctggatggaaatttacaccggtgaaaaatccacacaggtttatggtcaggacgtctggttgcctgctgaaacccttgatctgattcgtgaatatcgcgttgccattaaaggcccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgctgagaaagtgattaaattcctgcgtgaagagatgggcgtgaagaaaattcgcttcccggaacattgcggtatcggtattaagccgtgttcggaagaaggcaccaaacgtctggttcgtgcagcgatcgaatacgcaattgctaacgatcgtgactctgtgaccctggtgcacaaaggcaacatcatgaagttcaccgaaggcgcgtttaaagactggggctaccaactggcgcgtgaagaatttggcggtgaactgatcgacggcggcccgtggctgaaagttaaaaacccgaataccggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggtggtatcggtatcgcccctggcgcaaacatcggtgacgaatgcgccctgtttgaagccacccacggtactgcgccgaaatatgccggacaggacaaagtaaacccaggctctattattctctccgctgagatgatgctgcgccatatgggttggactgaagcggctgacctgattgttaaaggtatggaaggcgcaatcaatgccaagaccgtaacctatgacttcgaacgtctgatggaaggcgctaaactgctgaaatgttcagagtttggtgacgcgatcatcaagaatatgtaatcactacatgtgttaaatattgaaacgggcgtataacacgcccgttgttttatgatgatgtaaaatcttccccaaaactttccccaaaacccttccccaaaactggctattttctatgctgttttgatatctacgataatccagtctttaccacgatcatcattgtatcggtcggtcatttttctggatttatggcctaacaacttttgcgtatccagaccctgttcccgatataaccgttctgacagagatcgctgctcatgaaatgtgggcgcagttccttgctcccattttatgccacatttttcccgggcctttttaaaagccgttgtcagagtattcgcagaaacctggtctcctctgtttgcttgagaggtagtgtgacggtaatggaccagatatttactaacaacagcatccctgcactgagatataacttcacgaagggtaatattcagagcatcgcatttcaggttaagcggaatagcaagttttgaaccggttttttcctgagtaatgtgcaacatgtcgtcccatatatcagagaatttcaaattgcagatatcgcctaaacgttgtccagtaacaagagcaagtagcatgccgcattttaaatagggctgccgtctgcttacgctgtcaaatattgcctgccattcgggcagtgacaatctttggcggtttactcgatttcgcggttgttttgttgcctgcgctgggttaaatcctggcggaacatgtcctgcgtgttgtgcttctttgaagacgtcgatcaacaccattctcacgacttgcgccatcctgttatgaccttcagcctttacagcatcaattatttcggcaatatcaagtgcggtaatatccttgaggtgttgcattccacaatgctcacggaaaagacgaatgggtttgcctttttgccgataggagttgggtcttagttcattatgttgcagcctgtcctcttggatagaaatatatttatcaagccattctgtcaccgtaatgtctgagcgcctgcctttcattctttccagacgctcattgacgcttaatatttgtctggtacgttgttcagcaataatggtatttgcttcagtagcaacttgttttgcttcattctcatcagttcctaagctatgaaaacgaccggatagtggatgtttgtattgccaatatacctttccggttcgcttatctaatttgcaatataaattgggtatagagattttgtgagatcggggtctagcagccatcagcgattatcctttggagttttgggtttgcgtttattgggagttgcggttctgcaagcgttcctacaaaacgggaatttcggtcaatcatccagtagcgaccaacttttatagcgggtggggccatcattttcccttgcgcgtattttttcagaactcgctcacttggtgctaagtccccaaattcttctttagcccagtcctgtaaagtgattagtcgagacatttgtcctcctcttagctgctgagggagtttgtgaccgatatatctgacatgatattaagctcatggcaggtacatctcttgactggtcatagagataaatttaatgctgagaaatgcagtattgaatttatcaatttttctatttcctgcgcatgtcacgtaacttcttaatgtgttctgccgtttcgatctcttctgctatccgatctgcatcagctttattcacaggttcaaagtcatgattaaagcggaacatgctggcgatacatgttctgccttttcggatgtagtgaactttgttgtgggtagaacgcaggattttgcagggagtgccgtggtggtcgacgtaccaggtgttagggtcaatcactctgaacattcttgaccttgtgttgtgcggattgatattcagtgctgatattcacctttatagcgaacacctttaccggtttatcgccaaagtgcggatgtgtgattgtcttcacttcatatccgtcatacggaacatcaattctgcgactggaatcgtcgcgcttcggatatccctttgtgataatcaggcggtcatattcccggaacataattcgcttattccagtagtcattacacaagcgatactcttccgttttctctccgcgaatcatggcatcgaagtattcacttttaacagcaagttgcaggttagccatcacttaatccccctttgtttgcggataagctccagatcttgctggcaactggcgcaagtccgacaaccctgaacggccaggcgtcttcgttcatctatcggatcgccacactcacaacaatgagtggcagatacagccaggtagttcaggcggcgcatttttattgctgtgttgcgctgtaattcttctatttctgatgctgaatcaatgatgtctgccatctttcattaatccctgaactgttggttaatacgcttgagggtgaatgcgaacaataaaaaaggagcctgtagctccctgataattttgcttttcatgttcatcgttccttaaagacgccgtttaacatgccgattgccaggcttaaatgagtcggtgtgaatcccttcagcgttaccgtttcgcggtgcttcttcagtacgctacggcaaatgtcattgacgtttttggaaactgctgtctgacttttttgatttcagaattagcctgacgggcaatgctgcgaagggcgttttcttgctgaggtgtcactgaacaagccccatgtcggcaagcataagcacacagaatatgaagcccgctgccagaaaaatgcattcagtggttgtcatacctggtctctctcatctgcttctgctttcgccaccatcatttccagcttttgtgaaagggatgtggctaacgtatgaaattcttcgtctgtttctgctggtattggcacaaacctgactccaatttgagcaaggctatgtgccaaatcaatactcgttcttaactcaacaggagatgctttgtgcataccgccccccgtttattatttatctcctcagccagccgctgggctttcagcggatttcggataacagaaagaccgtgaaatacccagcctcgctttgtaacggagtagacgaaagtgatcgcgcctacccggatattatcgtgaggatgggtcatcgccattgctctccaaatacaaaaccaatttcagccagtgcttcgtccattttttcgatgaactccggcaccatctcgtcaaaactcgccatgtacttttcatcccgctcaaccacgacataatgcaggccttcacgcttcattcgtgggtcatagttggcaaagtaccaggcatcttttcgtgtcacccacatgctgtactgcacctgggccatgtaagccgactttatggcctcgaaaccaccgagccggaacttcatgaaatcccgggaggtaaacgggcatttcagctcaaggccattgccgtcactgcataaaccatcgggagagcaggcggtgcgcatactttcgtcgcgatagatgatcggggattcagtaacattcacgccggaagtgaattcaaacagggttctggcgtcgttctcgtactgttttccccacgccagcgccttagcattaacttccggagccacaccggtgcaaacctcagccagcagggtgtggaagtaggacattttcatgtcaggccacttctttcctgagcggggctttgctatcacgttgtgaacttctgaagcggtgatgacgccgagccgtaatttgtgccatgcatcatccccctgttcgacagctctcacgtcgatcccggtacgctgcaggataatgtccggtgtcatgctgccaccttctgctcagtggctttctgtttcaggaatccaagagctttcactgcttcggcctgtgtcagttctgacgatgcgcgaatgtcgcggcgaaatatctgggaacagagcggcaataagtcgtcatcccatgttttgtccagggcaatcagcagagtgttaatctcctgcatggtttcatcgttaaccggagtgatgtcgcgttccggctgacgttctgcagtgtatgcggtattttcgacaatgcgctcggcttcatccttgtcatagataccagcaaatccgaaggccagacgggcacactgaatcatggctttatgccgtaacatccgtttgggatgcgactgccacggccccgtgatttctctgccttcgcgggttttgaatggttcgcggcggcattcatccatccactcggtaacgcagatcggatgattgcggtctttgcggtaaatccggcatgtacatgattcattgtcctgctcaaagtccataccatcaaactgctggttttcattgatgatgcgggaccagccatcaacgcccaccaccggaacaatgccgttctgcttatcagggaaggcgtaaatttctttcgtccacggattaaggccgtactggttggcgacgatcaacaatgcgatgaactgcgcatcgctggcatcacctttaaatgccgtctggcgaagagtggtgatcagttcctgtgggtcgacagaatccatgccgacacgttcagccagcttccctgccagcgttgcgagtgctgtactcatccgttttatacctctgaatcaatatcagcctgatggtgagcaatggtttcaactatgtaccggatgtgttctgccatgcgctcctgaaactcaacatcgtcatcaaacgcacgggtaatggcttttttgctggccccgtggcgttgtaaatgatcgatgcatagcgattcaaacaggtgctggggcaggcctttttccatgtcgtctgccagttctgcctctttctcttcacgggcgatctgctggtagtgacgcgcccagctctgagcctcaagacgatcctgaatgtaataagcgttcatggctgaactcctgaaaatggctgtgaaaatatcgcccgcgaaatgccaggctgattaggaaaacaggaaagggggttagtgaatgcttttgcttgatctcagtttcagtattaatatccattttttataagcgtcgacggcctcacgaaacatcttttcatcgccaataaaagtggcgatagtgaatttagtctggatagccataattgtttgatccattttttgggactcctggctgattaagtatgtcgataaggcgtttccatccgtcacgtaatttacgggtgattcgttcaagtaaagattcggaagggcagccagcaacaggccaccctgcaatggcatattgcatggtgtgctccttatttatacataacgaaaaacgcctcgagtgaagcgtaattggtatgcggtaacgccgcgctcaggcggccttgatagtcatatcatctgaatcaaatattcctgatgtatcgatatcggtaattcttattccttcactaccatccattggaggccatccttcctgaccatttccatcattccagtcgaactcacacacaacaccatatgcatttaagtcgcttgaaattgctataagcagagcatgttgcgccagcatgattaatacagcatttaatacagagccgtgtttattgagtcggtattcagagtctgaccagaaattattaatctggtgaagtttttcctctgtcattacgtcatggtcaatttcaatttctattgatgctttccagtcgtaatcaatgatgtattttttgatgtttgacatctattcatatcctcatagataaaaaatcgccctcacactggagggcaaagaagatttccaataatcagaacaagtcggctcctgtttagttacgagcgacattgctccgtgtattcactcgttggaatgaatacacagtgcagtgtttattctgttatttatgccaaaaataaaggccactatcaggcagctttgttgttctgtttaccaagttctctggcaatcattgccgtcgttcgtattgcccatttatcgacatatttcccatcttccattacaggaaacatttcttcaggcttaaccatgcattccgattgcagcttgcatccattgcatcgtttgaattgtccacaccattgatttgtatcaatagtcgtagtcatacggatagtcctggtattgttccatcacatcttgaggatgctcttcgaactcttcaaattcttcttccatatatcaccttaaatagtggattgcggtagtaaagattgtgcctgtcttttaaccacatcaggctcggtggttctcgtgtacccctacaacgagaaatcggataaactctattcacccctacagagagcaaaagagaaacgccgatgaacaactcatggtggcaggaactaatgcattttttcctgcaaggaatgacacttaaacagttgattcatatgctaatcatcctgatcatattgattattgttatgccggtaagcgtaaaagaatggataaacctgcataatccagaaatccttcctcattactggatgtattacatcctgttgttttgcgttagctatgtgcttaacggcgttgttaattccgcttatcacgctgtgactgaaagaattgaggtattcgctgctcagaagcgcaaatctaaagaagaaaaatatgtgcaagatttgtttgattcgttaactcttggagaaagagcgtatttggcattcgctgtagccgctaataaccagctacaaacggaaaagggcgctcatgaatcaatttcattgctcaaaaaaggactcctcgttcgaaggcctcctgctgttggatatcctgataccgaccgtttcgttatccctgaaagctatagacatgagtgctacattaggtttgccgggaaggcagacagccttatggatgaacttatcgctcaggataagcatggcaaaaacaagtaattagcaaatgaatttatcatctcgccgtcagttgttttgatttccggtagcctgccgcgtaaagagctacgttcggaagacaagttgaaccttcatattttctggtcaacgttgtcagagttatcacttctgctctcattgctggtttgagcttgcattgcaagaccactcgtgaaggggttggcctgtgtagcttgtcggagctgatcgcctcctgactttgcagatttgcgcgacgagctctacggcgagaagctgcggtgcctttaaattctgtttttctggacatggattcctcccgaataaactttggcgatgcaatctcgaagctcctcctgagacggttgcttcggcattgcatcccacagcttatgtggttgggtgatctggcttttcagccacgtagtcgagagtcgacgttgtttaaagagcctgccagtctgttccatttggcttccagcgtcctgctgacggttaaatagtacgatatgtactttacaagatcaatacaatttgttgtaagttggcgtggttttttataacgctttgtatttaatagtgttgttttttagcgtggatgtattgcctcggcgatgtaaggagagatcagaattgcgtggtttagtgggttgcatctatttatttttcaataaatataattggttatgtgtttttaggtgggcgaacgtgaggcaaagaaaacccggcgctgaggccgggttgtattatgctgcaagtctcttaacccaagtctctcttttggagaatggtagaacttggcttgattcatggaagagtaaggagagttgttgcatttgatcaccaattgcttcgctgtctataacaacaaatctgttgttatactcctcacttgaagctttaagatcaattagtttcccaagcaatgagtaagcactattccagcttcctccgtgtttcacgcttgatgtaaaaacgtatttaggtatgtcggtttttattgttacagggacggtaatttgatgtccactcaagccatatacgttttcacgaagagaaagtgcgtctctaagctctgtgtgatatagataatcaataaccatactttcaaacttttcagcttgaactggctgataccagtctaacgacaaagttgatgcgagtataccagctctaattatgttcgatgtaatcgcaccgacatccttttctgttgcccaagcaatgatttctcctcgagcattgagttctgcgccttctttaagcagtaattgtcgtatctcatcaagtcgttttttggtaagcgagatccctcttgcctccatattcattaaggcatcgcatctgtcactaactaaatacctaccattgacttcacggataaaggcaccgacatgctctccatcatcacagtaagtgaatggactgataattctcnnnnncattccattcattaattaattaatgaatgaatgnnnnnggtttgccttattcctggcaaagttggtgttcaggatcctcagtttgcgattgaaggcctgctcaattacgcgatggcactggataacccgacattgaacaaattgagtgaagaaacccggttacagatcatcccttaccttgtgaattttgcctttgctgattattccaggtctgcggcaagtaaggctcgctgtgagcattgtactggtactggatttcataatgtattgcgcgaagtggtgaaacattccagaagcggggaatccgttatcaaagaagagtgggtgaaggaactgtgtcagcattgtcatggcaagggagaagtcagcacggcgtgcagagggtgtaagggtaaaggtattgtcctggatgaaaaaagaacccggcttcatggcacgcctgtttataagacttgtgggcgttgcaatggaaaccggtttagccgtttaccgactacactggcacgacgtcatgtccagaagctggttccagacctgactgattatcagtggtacaaaggatatgcagacgtaattgataaactagtaacaaagtgctggcaggaagaagcatatgctgaaacacaattgagaaaggtgacgagataagtgattttcgccgaagatagtgacatgaagcttgcatttttcaaaaaatatggataagattttctcaacgatgggctttgtatgtctgccgttgataattttcacgaacccgctgttgagcgggtttttatttacttgtactgaaacacattatataacctcatatcagttaaaaaggaggttgtatgattaatgccgttgagtacagattaccgttaggaaatatctctccagagaatcttgacgcgttgtcagaacttatcgttaagcattccgataaatttaataactatgtacttagttctatttctgatgatgatattcgatattcttacgattactacaattttgaaatcacagagatagatgaatatgggtttcactttatagcaccatatagctattatgaaggatgcgttgacaataacttctcaggagaggttgaaggttatgcagaatacgaaattattgataatgaattagtcttctctcttgaggaactaccttgggatgtaaaataaatatcaataataaaggccgtaacgaacggcctttattattataaaatcatcaatgcctgatgaattagaatgtaattttcgaattaataataaatcaacatatcatttcacgctccgattttctgtcggaggcgaaactgcggctattcatatgcacgaaaaagagaatcttgccggagcgttctggcttgttttgctgatcatcgcaggttggggggggcttgtccgttacctgattgatgtgaagcagagtaaagcaacgtggagctggataaatgccctcgctcagatagttgtatcaggattcaccggtgttattggtggcctaatcagtatcgaaagtggattcagtatttacatgattctcgcaactgcggggattagtggtgcgatgggttcggttgcactgacgtacttctgggaacgactgacaggggtgaaaaatgcaaaatcttaatcctcagcgtaaagctttcctcgatatggtggcctggtcagaaggaacggataatgggctacaaccgacacgtaatcatggttatgacgtcattgtgggcggagaaatattcactgattactccgatcaccctcgcagacttgtcacgctaaacccaaaactcaaatcaacggctgccgggcgctaccagcttctttcccgctggtgggatgcataccgtaaacagcttggactgaaagacttctctccaaaaagccaggatgctgttgcactgcagcagattaaagagcgtggtgctttaccgatgattgatcgcggtgatattcgtcaggctatcgaccgttgcagcaatatctgggcttcactgccgggagctggttatggtcagtttgagcataaggctgacagcctgattgcaaaattcaaagaagccggcggaacggtcaaagagattcaggtatgagcagagtaacggtgattatatccgctctggttatctgcatcatcgtctgcttgtcatgggctgttgataattaccgtgatgacgccatcgtctacaaagtacagcgcgataaagccacatccatcatcgctgatatgcagaagcgtcaacgtaatgtagctgaactcgatgccagatatacaaaggagcttgctgatgctaatgcgactatcgaaagtcttcgtgctgatgtttctgctgggcataagcgcctgcaagtcgccgccacctgtacaaagtcaacgaccggagccagcggcatgggcgatggagaaagccctagacttacagcagatgctgaactccattattaccgtctccgaagtggaatcgacaagataacctcacaggtcaattacttgcaggagtatatcaggacgcaatgtcccaactaatcacattttgaggatatttaacgtctatgctttaatgattttattcattgttttataatcgcgaagaataatgatgaacttggcaaaggatatgattatgcgtattaaacctcaagattttaagtttgatgtgttgactgttgctggttacgctaaccctaaagctaaaacacatttcgcaccttctgcttctggatttaattttaaatgggagtgggaagggaaaatttatgagcttcatatcgagcaagaaaaattacagtaccctgattttattcttgaacgactttttgatgccgcaattgagatggctaaaaaatgacaaaaatcaccggatggggtttttgtttatagatattcacacatagcccttgcatctagaacagaaaatcttgtcatggcgcggggctatgttagcaaaaatttatttaataggatattttgtttgcagatttaagctctttaagagtagcgtcaagtatatgtaaaaatagagaagtgtcgccatactcataatgtggctcggatttgtattctctaatataaataaatccacctttggataaaaataaatcaatcagctcgttgttattttcatcggttgggtcaatggcagcaaacttcaatacaggagcttcatcaatgactagcagtgtttctttgaaaataagttctagttcatatgttgaaagtttgagggttaacctatttttttatctttattgaaaattattgtgtcgccaagaaaatcgtattcagagcttgagtcaataatgttattcttaagtttgagagatattgcatctaaagcctttttatgctctgcgcacttaacaactttatgaacatctaaactggggatactcataatacaaccacctatgtaagaactaaagagcattgagtctatgtgattaatatcaagacccaattaaattttttaaattattagagttagatcccactttaaatgcccccacgaaccccaaaagcctgccgcgttcgcggctgccgccaaaccaccactgatccgtcaggctattgtgaaagccacaaaagcgaaggctggaaacaatacaagccaggacaatcccgtcaccagcgcggctacggttcgaagtgggatgttatccgcgcgcgcgtgctgaagcgtgacaaaggcctgtgtcagttgtgcctgcatgtcggtgtggtgcgtgaggcgaaaaccgttgaccacatcatccctaaagcgcatggcggcactgatgcagactgcaatctgcagagcctgtgctggccgtgtcataaggcgaagacggcccgtgaacgactgaagtgataataattctcaactttctgaggggaggggcgggtcaaatccctgtgacctgacgtcttccggactgcccgccccatcgtttttttatacccgcgaaaaatgaaatttaaccaggagtgccgcatatggctggaacggcggggcgttccgggcgtcgccccaagccaacggcgcgcaaggcgctggccggaaaccccggcaagcgagccctgaacaaagatgaacctgtttttacgcccatcaaaggtgttgagccaccggagtggttcgctgaagaagatctccctctcgccacgatcatgtggcaactgacaaccaaagaactctgcggtcagggcctgctgtgcgtgactgacctcgcggtgcttgagcggtggtgcgtggcctatgagttctggcgacgtgctgtgaaaaatattgccatacagggcaataccatcaccggcgcaatgggcggcagggtcaaaaatccggagctgacagccaaaaaagaacaggagtccgagatgagcagcacgggggcaatgctcggactcgaccccagcagccgtcagcgtctgattggcctggcggggcagaagaaagccactaacccgtttctgaaaatcatcgaatcatgagccggaaatcttaccccaacgtaaatgctgccaatcagtatgcccgggatgtcgtgcgcggaaagattgtggcctgccagtttgtgattcaggcctgccagcgccatcttgatgacctgatggcggaaaaaagtaagtcgtttcgttaccgcttcgacaaggacctggctgaacgggccgccaaatttattcagctgttgccgcacaccaagggtgagtgggcatttaagaggatgcccatcacgctggagccgtggcagctctttgtgatctgctgcgcgtttggctgggtcaataaaggctcccggctgcgccgcttccgggaggtgtataccgaaatcccccgtaagaacggcaaatcggcaatctctgccggtgttgccctgtattgttttgcctgtgataacgagtttggcgcggaagtgtattccggtgccacgacagagaaacaggcgtgggaagtctttcgcccggctcgactgatgtgtaaacgcacacccatgctgacggaagcgttcgggattgaggttaacgcctcaaacatgaaccgtccggaggatggcgcgcggtttgaaccgctgatcggtaaccccggtgatggttcatcaccccactgtgcggtggtggatgaatatcacgagcacgccaccgatgcgctttacaccacgatgcttaccgggatgggggcgcgacgtcagccactgatgtgggctatcaccaccgccgggtacaacattgaggggccgtgctacgacaagcggcgggaagtcatcgagatgctcaatggctcggtgcctaacgatgaactgttcgggatcatctataccgttgatgaaggtgacgactggaccgacccgcaggtgctggaaaaagccaatccaaatattggcgtgtcggtttatcgcgaatttttgttaagtcagcagcagcgtgcgaaaaataacgcccgtctggcaaacgtctttaaaacaaaacacctcaatatctgggtgtcggcgcgttcggcgtatttcaacctggtgagctggcagagctgcgaggataaatcactgacccttgagcagttcgaggggcagccgtgcattctggcctttgacctggcgcgtaagctggatatgaacagcatggcgcgactttatacccgcgagattgacggtaaaacgcattactacagtgtggccccgcgtttctgggtaccgtatgacacggtgtacagcgtcgagaaaaatgaagatcgacggacagccgaacgctttcagaaatgggtggaaatgggcgttctgaccgttaccgatggtgcggaggtggattatcgctacatcctcgaggaggccaaagcggcgaacaaaatcagcccggtcagtgagtcacccatcgaccccttcggggcgaccgggttgtcacatgaccttgctgatgaagacctgaaccccatcactatcattcagaactacaccaacatgtccgacccgatgaaagagctggaagcggcaattgaatcggggcgctttcatcatgatggcaatcccatcatgacctggtgtatcggcaacgtggtcggcaaaaccattccgggtaacgatgatgtggtgaaacccgtcaaagagcaggcggaaaacaaaatcgatggtgcagttgcgctgattatggcggttggcagagccatgttgtacgagaaagaagacacgctgtctgaccacattgagtcctacgggatccgctcgctttaactgaggtaattatgatcatgctgattctcgcgcctctggtgggcgtgctgggtgcgcttttgctggcatatggtgcctggctgatttatcccccggcgggttttgttgttgccggggcgctgtgcctgttctggtcgtggctggtggcgcgatatctcgatcgtacacagctgtctgtcggcggaggtaaatagtgttcttttcgggattatttcaacgaaaaagtgacgcgccggtgaccacgccagcagagctggcggaggctatcgggctgtcatacgacacctataccggaaagcagatcagcagccagcgggccatgcgactgacggcggttttttcctgcgtcagggtgctggcagagtcggtcgggatgttgccctgcaatctgtatcacctgaacggcagcctgaaacagagggccaccggcgaacgtctgcataagctgatctccacgcatcccaatggctatatgacgccgcaggagttctgggagctggtggtcacctgtctgtgcctgcggggaaacttttacgcctacaaagtgaaagcatttggcgaagtggctgaactgctgcccgtcgatcctggctgtgtggtaccgaagcttaacagtagctgggagccggtctatcaggtcacattctcggacggctccacggatgtgctgagccaggaagatatctggcatgtgcgcacgctgacgctggacggtctggtggggctgaatcccatcgcctatgcccgcgaggcaatatcgctggcagctgcgaccgaagagcacggggccagactgttcagcaatggtgcggtgacgtcgggtgtgttgcgtacagagcagacgctgtcagatcaggcttacgagcgcctgaagaaagattttgaggagcgtcacaccgggcttggtaatgctcaccgcccgatgatccttgagatggggctggactggaagtcgatggcgctgaacgccgaggacagccagttcctggaaacccgcaagtttcagcttgaagaaatctgtcgtctgttccgggtgccgttgcacatggtgcagaacaccgatcgcgccaccttcaacaatattgaagagctggggctgggatttatcaactattcactggtgccgtatctgacccgcatcgagcagcggatcaacaccggactggttcgaaaaagtaagcagggcgtttattacgccaaatttaacgccggggcgttactgcgcggggatatgaagtcccgttttgaagcctacgccaccgggattaactggggaatttactctcccaatgactgccgcgacctggaagatatgaatccccgtcccggtggggatgtctatctcacaccgatgaacatgaccacgaaaccctccgatggcagtaaagccggtaagcagaaggataacgccaatgcagacgaaacaacgtcttgatgtaccgctgagtctgaaatctgtcagtgactccggtgagtttgaagggtatggctccgtctttggtgtaaaggacagccacgatgatgtggtgatgtccggggcatttgctgcttccctgcgggcgtggagtgacagaaaagcgttacctgcgctgctctggcagcaccgcatggatgaacccatcggtgtttacaccgaaatgaaggaagacgatgtcgggctttacgtcaggggacggttgcttattgatgatgatcccctcgcaaaacgcgcacatgcacacatgaaggccggttcgttaaccggcctttctattgggtacgtcctgaaagactgggaatacgaccggagcaaagaagcctttctgctgaaagaaatcgacctctgggaagtcagcctggtgacgttcccgtctaacgacgaggcgcggatcagcgacgtcaagaacgcactggcccgcggggaaatccccgaacagaaaaaaatcgaaagagtcctgcgtgatgtcggactctcccgtacccaggccaaagcattcatggccgggggctatggcgcactgtccctgcgcgacgctgaggatgtgggctctgcactgaatgcactgaaaaatctgaacttctaatcaggagaaatacgatggcggttgatattaaagatgtcgaacaggtcgcgcaggagctgcagcagaagtttgacgacttcaaagcaaagaacgacaagcgcgtggatgcgattgagcaggaaaaaggcaaacttgccgggcaggtggaaaccctgaacgggaaactcagcgagctggaaaacctcaaaagcgatcttgaaaaagagctgcttgagctgaaacgtccggcaggtggtgcgcaaaataaactggccaccgagcataaagaagcgtttgtgggcttcctgcgtaaaggccgtgaagatggtctgcgcgatctggagcgcaaggcattgcaggtgggcaccgatgaagacggcggctatgccgtgccggaagcactggatcgcaacattctcaccctgctgaaagatgaagtggtgatgcgccaggaagccacggtgatcaccgttggtggttccgactacaaaaaactggtgaatctgggcggcacggcttccggatgggttggcgagactgacgcgcgctcccagactgccacctcaaaactgggcctgattgaacctttcatgggggaaatctacggtaacccgcaggccacccagaaaatgctggatgatgcctttttcaacgtggaagcatggatcaacagcgagctggcaaccgaatttgccgaacaggaagaaattgcctttaccaccggcgatggtaccaagaagccgaaagggttcctggcgtatgaatccactgatgaaaccgataaggtccgggcgttcggcaaacttcagcatattgtatccggcgaagcgacggcggtgaccgcagacgccattatcaaactgatttacacgctgcgtaaggcacaccgcactggcgcgaagttcatgatgaacaacaacagcctgtttgccatccgtctgcttaaagacagcgagggtaactatctgtggcgtccggggctggaactggggcagccgtcctctctggcgggttacggtatcgctgaaaacgaacagatgccggatatcgccgctgatgcgaaagccattgcatttggtaacttcaaacggggttacaccatcgttgaccgtatcggcacccgcattctgcgtgacccgtacaccaataaaccgtttgtcggtttttataccaccaagcgcaccggcgggatgctggtcgattcgcaggccatcaaactgctgaagattgcagcggcgtaatcactcaggggcgcggaaccgcgccccctgttctgacgggtgaagaatcatgatcctgaaacaagatctgaaatggtcaccggacggtatgcgtgttgaggtcattcgggccggtgagtatgacgatggggcgcttcctgcccgggtgcaggagattgcacttcaggccgggttagcagagcgcggaatcagtgcaaaaagcagtaaagcggcaaaagagaaaaaagccacgaccagtaaagagggctgagtatgcttctgacaatggaagagattaaagcccaactccggctggatgaggatttcgatgctgatgaccgccatctgcaactgctggcctgtgcggcacaaaagcggacggaaacgtatctgaaccggaagctctatgcaccggatgaaaccattccggacagcgatccggacgggctgcacctgccggatgatattcgtctggggatgctgatgcttatcagccatttttacgaaaaccgctcgtcggttacggaagtggagaaactcgacatgccgcagagttttggctggcttgtcggcccgtacaggtactttccgcaatgaaaattcgtcaggcgcagaccagcgcaacctacattctgccggaccccggtgaactgaataaacgcgtcctgatccgcctgcgggtggatatgcccgcggataactttggcgtggagcctcaatacctgattacgttccggacatgggcgaaggttatccagaccagtgccaccacctggcaggaaaccgcgcagaccggggacgccatcacccattacatcaccattcgttaccgccgggggattaccgctgattatgaggtggtctgcggtgacagtgtgtaccgggtgaaacgtcagcgcgatctgaacggggcgcggcgctttctgctgctggagtgtacggagctgggcgaatgtaggcagagtcacggaggcaacaatgacgacttcctttttgcacgttgattttcagcagcccgcggagatgcgctttaaccgcgcccgtgtccggcgggcgtttgtcacgattggtcagcgtcatatgcgtgatgcccgtcggctggtgatgcgccgtgcgcggtcggcaccgggtgaaaaccccggttatcagaccggacgcctggctcgttcgattggttacatggtacccagagccagtaaacatcgccctggttttatggcacgtatagcccctaaccagcgtaatggagagggaaaccgccgtatcaccggtgatttttatccggcttttttgttctatggcgtgaggcgaggggcaaagcgtcgtcgcagccatcatcgtggtgcatccggtggcagcggctggcgactggctccacgtaataactttatggtggaaacgcttgaaaagaaccgcagctggacacgctattttctggcgcgggaattacgtaaatcactgaagccggagcgacgacgcagatgaaactgacgcctgttattgctgcgctgcgtgcccgctgcccgtattttgaaaaccgggtggcaggcgcggcacagttcaaaaatctgccggaggtcggaaagctgagactcccggcggcatatgtggtaccgggtgatgactctccgggagaaaacaaaagccagaccgactactggcaggagctgaaagagggcttctccgtggttgtcatactgagtaacggacgtgatgagcgcggtcagtttgcctcgtatgatgtggtggacgatgtccggcagatgctctttaaggccctgctgggctggaacccggaagcgtgcggtaacccgattacctatgacggcggcacgctgctggatctgaatcgtcatgagctgatttatcagttcgatttttcggtcatcagagagctgaccgaagacgatacccgccagcaggatgacctgaacagtctggatgaactgcgaacgctggcgattgatgttgattatctcgatcccggtaacgggtctgacggcgatatcgaacatcacaccgaaataccccttccttcctgaggatcatcatgtttgtgaaacctgttaaagggcggtcagtgcctgaccctgcccgcggcgaccttttgcccgccgaagggcgaaatgttgatgagaacaactactggctgcgccgtgaagcagcgggtgatatccggcgcgtgaataaaaaggtgaacaccgatgacgataagctttaacaccattccgtcgaatacgctggttccgctgttttatgcggaaatggataaccaggctgcgaatactgcacaggacagcggagcatcgctgctgattggtcatgccaataacggtgcagagattgttgccaacagtctggtactgatgccgtcggcagactatgcacgccagatttgtggtgcgggaagtcagctggcgcgtatggtcgaggcttatcgccagactgacccgtttggcgagctgtatgtgattgccgttcctgaatccacaggcgcggcggcaacggttacgctgacggtgaccggggcggcaaccgaaaccggcacggtgaatgtgtatgtgggacgtacccgcgtgcaggtaccggtgactaacggcgataacgttacgatgattgccagcagtatccaggatgccatcaatgccgttccgaccctgccgtttacggcttcatcttcggcaggcgtggtcacactgaccgcgcgtcataaggggctttgcgggaatgaaattcctgtcagcctcaattactacggctttggtgggggcgaagtgctgccagcgggcgtacagattgccgtggtgacgggtaccgccggaacgggtgctccggttctcaccggcgctgtggctgcaatggcggatgagccgtttgattatatcggcctgccgttcaacgacacggcctccgttaacacgctggtgaccgagatgaacgataccagcggtcgctggagctatgcgcgtcagctgtatggtcatgtgtatacggcaaagaccggcacgctgtcagaactggtgaccgcaggtgaccagtttaaccagcagcacattaccctggcggggtacgaaaaagacacccagacgcctgccgacgagctggcggcaagccgtaccgcccgcgcagcggtgtttatccgcaacgatccggcacgtcccacgcagaccggtgagctggtgggtatgctgcctgcgccgaaggggaaacggttcacgatgaccgaacaaaagaccctgctgtctcatggcgtggcaacggcgtatgtcgaaagcggggtactgcgcattcagcgtgatgtcaccacgtacaggaaaaacgcttacggggttgcggataacagctacctcgacagcgagacgctgcataccagtgcgtatgtactgcgcaaactgaaatccgtcattaccagtaagtacgggcgtcacaagcttgccagcgacggtacccgctttggtcccggtcaggcgattgtcaccccggcggtgatcaaaggggaactgctggcaacctaccgtcagcttgagcgtgcggggatcgtggaaaactacgaactttttaagcagtacctggttgtggagcgtgatgccagcgatccgaaccgcctgaacacgctgttcccgcctgactatgttaaccagttgcgtgtctttgccgtggttaaccagttccgtcttcagtattcagaggagtccgcataatggcccgtatcgggggaacctgttatttcaaaattgacggtcagcagctatcgctgaccggcggcattgaggtgcccatgaacaggacggtcaatgatgacatcatcggcctggacggttcagtggaccgcaaggaaactcaccgtgcgccttatgttaaagggaccttcaaggtgccgaagaattttccggtgagcaaaatcacctcgtctgatgagatgaccatcactgccgagctggcgaacggtcaggtctatgtactgtcgtctgcctggctgcacggcgaagcgaaccataatgccgaagaagggacggttgatcttgagttccacggtgaagaaggggattaccagtaatgaaagagcttgagttaaagaaaccgattaccgctcatggcgagacactctccgtactggagtttgatgagcccaccgggaaagatgtccgcgagctggggtatccctaccagatgaatcaggatgagtccgtcagacttctggcgcatgtggtatcgaaatacattgtgcggctggcgaaagtgccgcaaaactctgtcgaccagatgtctccggcagacctgaatgctgcggcgtggcttgtggctggttttttcctccaggcctgacggctgaatacctcactgatcgcttctttgactgcgccagctactggcgcattaatcccttcgaattgctgaatatgccgatcagtgaaattcccttgctggtcagtcaggcaaacaggatagagcaggagaaacgcacacatggctgaatttgagcttaaggcgttgatcaccggtgtcgacaggctttctcccgcgctgtcgaaaatgcaaaagaaaatccggggatttaaacgccaggcggaagaagcgtcacagggtgggctggcgcttggtggcggactggctgcgggtctgacgctttccctgaaatcttatgccgatcaggaaaacgccgccaccgggctgaaagttgccatgatggatgcgaacggtgaggtcggaaagcgctttcaggacatcaataaactggctattggtctgggtaaccagctacccggtacaacggctgatttccagaacatgatgcagatgctggtgcgtcaggggatcccggcagaaaacattcttggcggtgtgggtaaagcgacagcttatcttgcggtacaactgaaaaaaacaccggaagcggctgccgagtttgccgcaaagatgcaggatgctaccggaacggcgtcagaagacatgatggggctgttcgacactatccagaaggcgttttatctgggcgttgacgataccaacatgttgtccttcttcactaaaaccagctctgttctgaagatggtgaacaaggacggtcttcaggctgcacagagccttgcccccatcagcgtcatgatggatcagatggggatgaacggggagtcggcaggtaacgccctgcgaaaagttatccagtccggattaagcgttaagaaaatcagggacgtcaataaagtcatggcccgccagaaactcggggtacagctcgattttactgacggcaaagggagttttggcggtcttgataacatgttcaggcaactggcaaagctgcgaaaactgaccgacgttaagcgaactggtgtacttaaggcaatatttggtgatgatgccgaaacccttcaggtggtcaatgcactaatcgataaaggaaaggatggctacgaccagatccagcagaagatgaataaacaggccagtctgaataaacgtgttcaggcacagcttggtacgctgtccaacctgtgggaggcaatgacagggaccgcaactaacggccttgcggctattggcggcgcattttctggtgacgctaaaaatatcacgcaatggctgggggagttgggggagaaattcacgaagtttgcggatgaaaatccccgggttattcgcggcgtcgtcgggcttgctgccggtcttgcgattctgaaactgggattgatgggcgttggcggtgccatcagtattgtcagcaggatcatgtcgatgacgccgattggcatgattgcgacggcgatagccctggctgcgggattaattatcactaactgggatgttgtcggaccttatttcaagaagctctgggaaaccattggtccttattttgaggctggccgggaacttctgaagaaggtttttgcctggtcgccgctggggatggtaatcaataactggggaccggttgttaagtggtttcaggatatgtgggacaagctgaagccaattattgagtggtttaccgacagttccggtgacacggtcgatgccattaactctgcgcagtggggcgcgggtgcttatgatgcttatgggacgggaataccggcacggggatacacaccttatcaggcggtggatccggctcagtcaaacaacgcctccggtgccacaggcccgaatcccttcatgattaacaaagcttctgcgccaaaagttgatggtgagatcaaggtctcttttgtgaattcacctccgggtatgcgggttatggaaacgcgatccagcggttttgatgtcagccatgatgttggctatacgcgctttggcaggtaatgaaaaattaatctgttaatgagtcccactccggtgggattttttatgtacggagtttatatgacgtggaaagacagacttcaggacgcgtcatttcgcggtgtgccgtttaaggttgaagaagaaagtgcgggaaccggtcgtcgtgtggaaacgcacgaatacccgaaccgcgacaaaccctataccgaagacctggggaaaatcactttccgcccgtccatcacagcttatgtggtgggagatgactgctttgaccagcgcgatcgcctgattgacgcgctgaataaacccggtcccggcacgcttgtccatccgacttacggtgagctgaaagtctgtgttgacggggaagttcgggtcagcacatcgaagagtgaagggcgtattgtccgctttgacctgaagtttgtcgaagcgggagaactctcttaccccacttcaggtgcggcgacggcgcagacgctgatgtcatcctgttctgcactggatgactgcatcagtgacagcttcagtggtttcagtatcgatggcgtggcagattttgtgcagaacgacgtcgtcggtaatgccagcacaatgcttgggtatgtttctgatgcgatgaaagtggtggattctgccgtatcggatgccgccaggctgttgcagggggatatctcggtacttctgccgccgccatcgtcaggcaaaaatttcgttgagcaggtgcagaaaatgtggcgtaccgggaaacgcctttatggtaacgccagcgacctggtcaccatgatcaaaacgctttccggtgtcagcctcggcagcgatctgcaaccgcgcggcgtctggaaaacggacagtaaaaccaccgccacggcgacgcagcagcgtaacgtggttgccagcacccttcgtacgaccgcaatcagcgaagcggcgtatgccgtcacacgattgcctgcgcccacaacttccgcggtgatgcagaatgccacagtggggcagtcaacaacacccgcgcagagcaccggctggccttctgtcacgcatccggcactgaacaatgcaccggcggtgaaaaacacggttgacctgccaacgtgggaagaactgaccgacattcgcgacacactgaatacggcaattgataaggagttgtcccgtacaaccagtgatgtgctgtttctggcgctgcgccgggtgaaagcagatctgaatgcggatatcaacacgcgccttgaacagtctgcacggatcattcagcgcacaccggatgaggttttacccgcgctggtgctggcggcgacctggtttgataacgcggcgcgtgacgcggacattatccggcgtaatgccattacgcatcccggctttgtgccggtgatccctctgaaggtgccagtgcaatgaacgataacgtcacgctacgggtaaatggccgggagtggaatggctggacatcggtgcgcatcggtgccggtattgaacggctggcgcgggatttcagtgtggagatcacccgccagtggccgggtgatgagggtatcaccacgcttcagccgcgcattaaaaacggttcaaaagtggaggtgctgattggtgatgagctggtgatcaccggctgggtggaggcgacgcccgttcgttacgatgcccgttcggtcagcaccggtattgccggacgcagtctgaccgctgacctgattgactgtgcagccgaaccgacacagtttaacggacgatcgctggtacagattgcgcaggcgcttgctgcgcctttcggcattgaggtggtgaacaacggtgcgccgtcgggtgttattcctgacgtccagcccgatcacggtgaaacggtgattgaggtaatcaacaaaatactcggtcagcagcaggcactggcttacgacgacccacacggcaggctggtgattggcggtattggctcaacgcgggcacatactgcgctggtactcggggaaaacatcctttcctgcgatacggagaagagtatccgggagcggttttctgtttaccaggtggcggggcagcgtgctggaaacgacgatgatttcggtgaggccaccaccagcgcgctgcgggcccgcacagaggacgcatttattgcccgttaccgtccgatgtatatcaggcagacagggcaggctacgggggcaggctgtattgcgcgtgctgactttgaagcccgacaacgggcggcgcggacggatgaaaccacctatgtggtgcagggctggcgacagggtaacggtacgctgtggcagcccaaccagcgggtgattgtcttcgatccggtctgtggtttcgacaataccgaactgcttgtctcggaagtcacgtttactcaggaccagaacggcaccctgacggaaatccgtgtcggcccacctgatgcttatctgcctgaacccgaagcccccggcgcgcggaaaaagaaaaaagccagagtacaggaggacccgttctgatgagtacgattgaagccatgcagcgacaactcctcggcctgattgggcgggcagtggtgaaaagcatcagtgccgccacgaaatgtcagaccgtggatgtgtccctgattgccggtgaacccaaagccggggttgaacatcttgaaccctacggttttaccgcaagggcaaacagcggtgcggaagcggtggtgttgtttccggatggtgaccgttctcatgcggtggttgttacggtgtcggaccggcgctaccgcctgaaagggctgcagacgggtgaggtggcggtctatgacgatcaggggcagtctgtgacgctgacccgggaggggatcgtggtggacggtgcaggtaaaacgatcacgtttcgcaatgcacctgaagcacgttttgaaatggacctggaagtgacaggacaggtgaaagacctgtgcgactccagcggcaccaccatgtcagcgatgcggcttgcctataacgggcatcgtcacagagagaacggtcagggcagtaacaccgacaaacctgataaagcgatggaggcatgatggaactgtggctgacggtgaacggtaaacgcacctgcgccagcgcaccgctggatccgctgacccgcgccgtggtgatttccctgtttacctggcggcgggcggagcctgatgacaacgccgacgtcccgatgggatggtggggggatacctggcctgcggtacagaatgaccgttacggctcccgactgtggctgcttcagcgcagcaaactgaccaatcagctggtgcagacggtaagggggtatatccgcgaatgcctgcaatggatgattgatgacggcgtggtgtcccgtattgatctggatatcctccgcaccgggattaatgaactgggtaacagtatcactctctggcgtcgtgacggaccggtaatgatttctttagatgatctgtggagtgcgataacgcatggcggacagtgaatttcagcgcccgacgctggcagaaaatatcagtatgctccgtaacgatttattcgccaggctggacgtcagcgacacgctccggcgcatggatgaagacgtgcgggcaaaggtgtatgcggcggcgctgcatacggtttacgggtacatcgattatctggcaatgaacatgctgcctgacctgtgcgatgagtcctggctggcgcgacatgctgcgatgaaacggtgtccgcgcaagggggccacgactgccagcgggtatatgcgctgggaaggcgtcagcgatggcctgaaggtgaccgccgggagtgttattcagcgcgatgacctgattcagtacacggcaactgccgatgcaaccagcgccggtggtgtcctgcgcgtgccgatcgcctgctcaagtgcaggcgcggtcggtaacgctgacgacggtacgtcattaatcctggtcacgccggttaatggtctgccgtcttccggcgtggcagacactctgacaggtggatttgatactgaagagctggaaacgtggcgcgcccgcgtcattgagcggtattactggacgcctcagggcggggctgacggggactatgttgtctgggctaaagaattgcccggcattacccgcgcatgggcataccgtcactggatgggaacggggactgtcggtgtgatgattgccagcagtgacctgattaatcccattccggaagaatcaacggaaacggcggcaagacaacatatcgggccactggccccggtggcaggctctgatttgtatgtgttcaggccggtggcgcatacggtggattttcatatccgtgtgacgccggatacaccggaaatacgggctgccatcaccgcggagttgcgttcgttcctgctgcgtgatggttatccgcagggagaactgaaggtgtcgcgtatcagtgaagcgatttccggtgcgaacggggaatacagccatcaattgcttgcaccggcggaaaatatctccattgcaaaaaatgaactggcggttctggggacgatttcatgggcgtgacaaacgatgattacatccgtctgttgtcggcactgctgccgcccggtccggcgtggtcagccagcgatccggcgattgccggtgcggcacagtcattaacccgcgttcatcagcgtgcggatgccctgatgcgggagctggatccgcgcaccaccaccgaactgataaatcgctgggagcgtctgtgcggcctgccggatgaatgtattcccgcaggaacacagacccttcgccagcgtcagcaacgactggatgcgaaggttaacctggcgggcggcatcaatgaggatttttaccttgcacagcttgctgccctgggcagaccagacgccaccatcacgcgatacgacaaaagcacgttcacctgctcatcggcctgtactgacgcggtgaatgcgccggaatggcggtattactggcaggtcaacatgccagccgccaccaacagcacctggatgacatgtggcgatccctgtgattccgcgctgcgtatctggggcgacaccgtcgtcgaatgtgtgcttaacaaactctgcccttcgcatacctacgtaatttttaaatatccggagtaatccatgcatcgtatagacacgaaaaccgcgcagaaggataagttcggcgcgggtaagaacggttttacccgtggtaacccccagacaggcacgcctgccaccgatctggatgatgactactttgacatgttgcaggaagaactctgcagcgtggtggaggcatccggtgccagtctggagaaggcgcggcacgaccagctgcttaccgcgcttcgtgcgctgctgttaagccgcaagaatccgtttagcgatatcaaatcggacggcacggtgaaaacggctctcgaaaaccttggtttgggagaaggctctgcattacctgttggtgtgcctgttccatggccttcagccacaccgccaacaggctggctgaaatgcaacggtgcggctttttctgctgaagaatacccggaactggcaaaggcttatccgacaaataaattgcctgatttacgtggtgagtttattcgtggctgggatgatgggcgcggcgttgattcaaggcgtgcggtgctgtcaacacaagagccaactgtaggtactttttatgtggagctagctatcatctcgggaactttgagcggctcaggtgctaaatttaccgattcagtagggattggatcaaccagtagtaacattaccgttagcaacggtaatgaccagtccgtgtcgggtacagtggccgttaaccccgtcgatacccgtccacgcaacattgcatttaactatatcgtgagagcagcataatggataaagcaatattaaatagtggacttgttgctacaaaggcaggggatattaccgtttataactatgatggtgaaactcgggaatatatttccacttcaagtgaatatcttgccgttggtgttggtatcccggcatattcctgtctggatgcaccaggtatacataaggcgggttatgctatctgtcgttctgtgaatttaaattcatgggaatatgtgccagaccatcgcggtgaaatcgtctataacaccgaaacgggagaatcaaaacaaatcacagcaccgggtgattaccccgaaaatacaaccactattgccccattaacgccatacgataaatgggatggtgagaaatgggtgaccgatactgaggcacagcatagcgccgcagtagacgcggcagaagcacagcgtcagtcactgattgatgctgcaatggcttccatcggtctgattcagctgaaattacaggccggacggaagctgatgcaggcagaaacaacccggcttaacgctgtgctggattacattgacgcggtgacggcaacaaataccagcacagcgccggatgtcatctggcctgaactgccggaggcgtaggccattcaatatctggcgcacaggaagtatcgaccagttccagtgcgtccagataatccagccacgaattatattgcgccagttcctcgcctttcagacgaccaatagcagctttgccaggccactgatgggtattgatgtaggtattgacttctgaaaccaaagatatttttttcatttcagccgtcaacacctcatcctcttttgaagggggtggggaattaatccatactggccgtcctgaactgtcagcgccaatttctttcccttctggatgcagaccaagaaattgctcatatgtttctctggtaatttcaataacatcatcaggaagcgttcccgcatcctcatattctggaaacaattcttgcagataaaaacttttacttccgggtgaaaagaatactgagttcattattaccgtccaatgattaacgctgagacgctggtatctgaaggaaaggctgcattcagtggtttgtcgactttgaacacaatcgtattattccccctgacagcggcaaaagaacaaaccgccgtcgcgtatgaacctgtaatattactggatacaccaccataagctgttgttgataccagagggataacgcccagcaccttattaggaaatacaaagggcaatgtggctgtggcaatataagacttattagaacctgtgatggcataagcattatcagtcattccattcatcgccactgggccgcttatacttacagtaaccatctgaatgattagcccgtcaggttgacgaatcacaaaatttccattgccaccagtaaccgtccagaaagacatatcagggatttggttttccccgttgcccacattccgttttgccgcttctcccaaaccaaggttttcgagagcnnnnncattccattcattaattaattaatgaatgaatgnnnnncgccattacctacaaagccctgcgcgacaaaaatgccagagaactgaagctggcgaacgcggcaattactgacatgcagatgcgtcagcgtgatgttgctgcgctcgatgcaaaatacacgaaggagttagctgatgcgaaagctgaaaatgatgctctgcgtgatgatgttgccgctggtcgtcgtcggttgcacatcaaagcagtctgtcagtcagtgcgtgaagccaccaccgcctccggcgtggataatgcagcctccccccgactggcagacaccgctgaacgggattatttcaccctcagagagaggctgatcactatgcaaaaacaactggaaggaacccagaagtatattaatgagcagtgcagatagagttgctcatatcgatgggcaactcatgcaattattttgagcaatacacccgcgcttccagcggagtataaatgcctaaagtaataaaaccgagcaatccatttacgaatgtttgctgggtttctgttttaacaacattttctgcaccaccacaaatttttgctgcatcgacagttttcttctgcccaattcccgaaacgaagaaatgatgggtgatggtttcctttggtgttactgctgtaggtttgtttccaacagtaaacgtctgttgagcacatcctgtaataagcattgccagagcggcagaaaacaacatttttttcatcttattatcctgcattgttaaaaacggcagaatcctatgtgacaacaattaaacgatagttaaatggattgatgaaaattaaaactacacaggtgggctcagactattggaggaagttggggacactcagaatcctgtggaatgaaataaaccggtctatccgtccattacccttttagctgcgctgtatcgtcgccgtattcccgcattaaccatgaccgtagcccgacggggaattccttctgcgtgagtgtgcgggaataattaaaaacgatgcacaccgggtttttaccgcgttaatgattcgcgggtttatcccggtgcgatggtggaagaaacaggaagctgtattacagaaagtgctactactgtatcccgatgcgatgtatgtaatgtgagtcagataatggcacaggatgtggtgatgtggcagtctggaacacaggatatattgtcagaataagacccgtaggaataaaaatgaaaagacgccttttactactttttctgttatctgtcctggcagtgggatgctcgcagcaaaaagctgatgagccccggcaattagtgacggtgtatccacgatatccggaatatgctgcagcaaattatatcaaggggctggttgaggttaagttcgatattggtgctgatgggactgtgacacggatcgtttttctccgctcagagcctcataatttgtttcgtgatgaagtggtgaaggccatggcgaaatggcgatttgaaaagaatcgcccctgtcagggagtgaagcgacaatttatctttacgccgtcacgtccctgatgcttccaggtagagaggggctggaagcaggagaaaaatgaaagagccagcggttatatttttgtcatggctgacgaggaatgatggaagaaggcgttgtatgccacacaacgcctcactgttcatttcttctttttctctagtggaacccgatgaataagagttgcactggtttccgatgagatggcgatatactcgggcaaagtatgctggcagttttccaactggtcaaaaatacctgctctcgtctgttgcaatgcctgcagcatgcggcggcaatgcgccttgcttttgctaaccatctttccttcctctatcagtcgctgcgtgaactcatcatggaataccaggtaaatgcggatgttatcggttttggctacgcagcatagtacaaaacggacaggtgcatcccgggacgggggaggcgtcacatgtccctgtgatggttgttccgggtaatgcactgtgtggggcataaaaatgtccgataattttactttctaccgcagttagttgattcgttggtcctggtagcacattgggcgaggatttaaatgccaggcaactgaaggatgatgttgcaagggagatagcgagaatatttctgattttcatttgatgatgcctctgtgtgaaatgacggtaaacgacgcacttgtgccggcacataatagcaagcaccataatagatcagattcgattcttgctgtaagtgataattattctcgtttttcgggtnnnnncattccattcattaattaattaatgaatgaatgnnnnntcagtgctgaccatcaataggaggtttttacaatatggtgacgaaaaccatcactgaacagcgtgcggaagtacgtatttttgccggtaatgatccggctcataccgccacaggcagcagcgggatttcctcgccaacaccggcactgacgcccctgatgctggatgaagccaccgggaaactggtggtctgggacggacagaaagccggtagtgcggttggcatactggtactgccgcttgaaggcacagagacggcgctgacgtattacaagtcgggaacctttgcgacggaggcaatccactggcctgaaagtgtggatgaacacaaaaaggccaacgcctttgctggcagtgccctgagtcacgcggcgctgccgtaacacgttatcaggccaccgcggtggcctgactgatttctgaatgaaaggaactgatttatgggattgtttacgacccgccagttactcggttataccgaacaaaaagttaaatttcgtgcgctgtttctggagctgtttttccgccgtacggtgaatttccataccgaagaggtgatgctggacaaaattaccggaaaaacgccggtggcggcctatgtctccccggttgttgaaggaaaagtgctgcgtcatcgtggtggtgaaacccgcgtgttgcgtccgggctacgtcaagccgaaacacgaatttaattaccagcaggcggttgagcgccttcctggtgaagatccatctcaactgaatgatccggcttaccgccgtctgcgtatcattaccgataacctcaaacaggaagagcacgcgattgtccaggtggaagaaatgcaggcggtaaatgctgtgttgtatggcaaatacaccatggaaggagaccagttcgagaaaattgaggtcgattttggcaggtcgacgaagaataacatcactcagggtagtggtaaggagtggtcaaaacaggatcgtgacacgttcgatcctacacatgatattgacctctactgcgacctggccagcggtcttgtgaatattgccattatggacggtaccgtctggcgtcttctgaatggttttaagctgttccgcgaaaaactggatacccgtcgcggttcaaattctcaactcgaaacggcagtgaaagatctgggcgcagtggtgtccttcaaggggtattacggcgatctggccattgtggtggcgaaaacgtcttatatagcagaagacggtatcgaaaaacgttatcttccagatggcatgctggttctggggaatactgctgcagatgggatccgttgttacggtgccattcaggatgctcaggcgttgtccgaaggtgtggtggcctcttcccgttatccgaaacactggctgacggtaggggatcccgcccgtgaatttaccatgacgcagtccgcgccgctgatggtgttgccggacccggatgagtttgtggtggtacaggtgaaataatccgtgagcgggggcgaaatgcccccgtgtcttttttcacagggggctgatatggcaacgaaagagcaaaatctgaaacggcttgatgaactggccctgattctggggcgtgagccggatatatccgggagtgccgcagagatagcgcagcgggtggcagaatgggaagaggaaatgcagtcatccggcgatgatgtacaggttatgaatatggatatccgggagcgggaaaccgcggctcatgatgttcgtgaggaaacatccggcgcgttaacgcgcatcagagttctgacctgcctccatctctgtggcgttgatggtgaaacgggggaatccgttgagcttgcggatgttggtcgggtgattctgattatgtcctcagatgcaaaaacacacgttgatggtggaatggctgtttatgcgtgattttcagaatgcctttgatgccgcccttgccggggtggacagtacgattgttgaagtgatgggcatcagtgcgcagttcacctccggtgcacagcgtggcggcgaggttcatggcgtttttgacgatccggagtcgctgggttttgccagtagtgggatccgtattgaaggaagtaacccgtcattatttgtgcttacggatacggtttgtgctgtacggcgtggtgacacgctgaccattaacggcgagatgttctgggtggaccgtgtttctccggatgacggagggagttgttatctctggctcaaccgggggcaaccacctgccgccagccgtcgccgctgaaagggggatgtatggccataaaaggtcttgagcaggccgttgaaaacctcagccgtatcagcaaaacggcagtgcctggtgccgccgcaatggccattaaccgcgttgcttcatccgcgatatcgcagtcggcgtcactggttgcccgtgagacaaaggtacgccggaaactggtaaaggaaagggccaggctgaaaagggccacggtcaaaaatccgcaggccagaatcaaagttaaccggggggatttgcccgtaatcaggctgggtaacgcgcgggttgtcctgtcccgacgcaggcgtcgtaaaaaggggcagcgttcatccctgaaaggtggcggcagcgtgcttgtggtgggaaaccgtcgtattcccggcgcgtttattcagcaactgaaaaatggccggtggcatgtcatgcagcgtgtggccgggaaaaaccgttaccccattgatgtggtgaaaatcccgatggcggtgccgctgaccacggcgtttaaacagaatattgagcggatacggcgtgagcgtcttccgaaagagctgggctatgcgctgcagcatcaactgagaatggtaataaagcgatgaaacatactgaactccgtgcagccgtactggatgcactggagaagcatgacaccggggcgacgctttttgatggtcgccctgctgtttttgatgaggaagattttccggcaannnnncattccattcattaattaattaatgaatgaatgnnnnnggccgttgaaaactcagccgtatcagcaaaacggcrgtgcccggtgccgccgcaatggccattaaccgcgttgcttcatccgcgatatcgcagtckgcgtcacwggttgcycgtgagacaaaggtacgccggaaactggtaaaggaaagggccaggctgaaaagggccacggtcaaaaatccgcaggccagaatcaaagttaaccggggggatttgcccgtaatcargctgggtaaygcgcgggttgtcctgtcccgmcgcaggcgtcgtaaaaaggggcagcgttcatccctgaaaggtggcggcagcgtgcttgtggtgggwaaccgtcgtattcccggcgcgtttattcagcaactgaaaaayggccggtggcatgtyatgcagcgtgtggccgggaaaaaccgttaccccattgatgtggtgaaaatcccgatggcggtgccgctgaccacggcgtttaaacagaatattgarcggatacggcgtgarcgtcttccgaaagagctgggctatgcgctgcagcatcaactgagaatggtaataaagcgatgaaacatactgaactccgtgcagccgtactggatgcactggagaagcatgacaccggggcgacgctttttgatggtcgcccygctgtttttgatgaggaagattttccggcaattgccgtttatctcaccggcgctgaatacacgggcgaagagctggacagcgatacctggcaggcggagctgcatattgaagttttcctgcctgctcaggtgccggattcagagctggattcgtggatggagtcccggatttatccggtgatgagcgatatcccggcactgtcagatttgatcaccagtatggtggccagyggctatgactaccggcgcgacggatgatgcgggcctgtggagtcagccgatctgactnnnnncattccattcattaattaattaatgaatgaatgnnnnncgcgggttgtcctgtcccgacgcaggcgtcgtaaaaaggggcagcgttcatccctgaaaggtggcggcagcgtgcttgtggtgggaaaccgtcgtattcccggcgcgtttattcagcaactgaaaaatggccggtggcatgtcatgcagcgtgtggccgggaaaaaccgttaccccattgatgtggtgaaaatcccgatggcggtgccgctgaccacggcgtttaaacagaatattgagcggatacggcgtgagcgtcttccgaaagagctgggctatgcgctgcagcatcaactgagaatggtaataaagcgatgaaacatactgaactccgtgcagccgtactggatgcactggagaagcatgacaccggggcgacgctttttgatggtcgccctgctgtttttgatgaggaagattttccggcaattgccgtttatctcaccggcgctgaatacacgggcgaagagctggacagcgatacctggcaggcggagctgcatattgaagttttcctgcctgctcaggtgccggattcagagctggattcgtggatggagtcccggatttatccggtgatgagcgatatcccggcactgtcagatttgatcaccagtatggtggccagtggctatgactaccggcgcgacgatgatgcgggcctgtggagttcagccgatctgacttatgtcattacctatgaaatgtgaggacgatatgccaacaccaaatcctctggcaccggtgaaaggggccgggaccacactgtgggtttataacgggagcggcgacccttatgcaaacccgctttcagacaatgactggtcgcgtctggcaaaaattaaagacctgacgcccggcgaactgaccgctgagtcctatgacgacagttatctcgatgatgaagatgcggactggaccgcgaccgggcaggggcagaaatccgccggagataccagcttcacgctggcgtggatgcccggagagcaggggcagcaggcgctgctggcgtggtttaatgaaggtgatacccgtgcctataaaatccgcttcccgaacggcacggtcgatgtgttccgtggctgggtcagcagtatcggtaaggcggtgacggcgaaggaagtgatcacccgtacggtgaaggtcaccaatgtgggccgtccgtcaatggcagaagatcgcagtacggtgacggcggcaaccggtatgaccgtgacgcctgccagctcctcggtggtgaaagggcagagcaccacgctgaccgtggccttccagccggagggcgcaactgacaagagcttccgtgcggtgtcagcggataaaacaaaagccaccgtgtcggtcagtggtatgaccatcaccgtgaacggcgttgctgcaggcaaggtcaacattccggttgtatccggtaatggtgaacttgctgcggttgcagaaatcactgtcaccgacagttaatccggagagtcagcgatgttcctgaaaaccgaatcatttgaacataacggcgtgaccgtcacgctttctgaactgtcagccctgcagcgtattgagcatctcgccctgatgaaacagcaggcagaacaggcggagtcagacagcaaccggcaggttactgtggaagacgccatcagaaccggtgcttttgtggtggcgatgtccctgtggcataaccatccgcagaagacaaagcagccttccatgaatgaagccgttaaacagattgagcaggaagtgcttaccacctggcccgcggaggcaatttctcatgctgaaaacgtggtgtaccggctgtccggtatgtatgggtttgtggtgaatgatgcccctgaccaggcagaggactccgggcctgcagagcctgtttctgcgggaaagtgttcgacggtgagctgagttttgccctgaaactggcgcgagagaaggggcgacctgactggcgcgccatgcttgccgggatgtcatccacggagtatgccgnnnnncattccattcattaattaattaatgaatgaatgnnnnntgcacttttccgggctgacgtacactgtgctcagctgtttttcagcgatccgggatatgcatccgctggatttcagtttgctgaaccggcgtgaggatgacgaagagcctgaagatgatgtgctgatgcagaaagcggcagggcttaccggaggcgtccgctttgacccggacggaaatgaagttatccccgcttccccggatatggcgggcatgacggaggatgacgtaatgctgatgacagtatcagaagggatcgcaggaggagtccggtatggctgaaccggtaggcgatctggtcgttgatttaagtctggatgcggccagatttgacgagcagatggccagagtcaggcgtcatttttccggtacggaaagtgatgcgaaaaaaacagcggcagtcgttgaacagtcgctgagccgacaggcgctggctgcacagaaagcggggatttccgtcgggcagtataaagccgccatgcgtatgctgcctgcacagttcaccgacgtggccacgcagcttgcaggcgggcaaagcccgtggctgatcctgctgcaacagggtggtcaggttaaggactccttcggcgggatgatccccatgttccgggggcttgccggtgcgatcaccctgccgatggtcggggccacctcgctggcggtggcgaccggtgcgctggcgtatgcctggtatcagggtaactcaaccctgtccgatttcaacaaaacgctggtcctttccggcaatcagtcgggtctgacggcagatcgtatgctggtcctgtccagagccgggcaggcggcagggctgacgtttaaccagaccagcgagtcactcagcgcactggttaaggcgggagtaagcggtgaggctcagattgcatccatcagccagagtgtggcgcgtttctcctctgcatccggcgtggaggtggacaaggtcgctgaagccttcgggaagctgaccactgacccgacgtcggggctgacggcgatggcgcgccagttccataacgtaacggcggagcagattgcgtatgttgctcagttgcagcgttccggcgatgaatccggggcattgcaggcggcgaacgaggccgcaacgaaagggtttgatgaccagacccgacgcctgaaagagaacatgggcacgctggaaacctgggcagacaggacagcacgggcattcaaatccatgtgggatgcggtgctggatattggtcgtcctgataccgctcaggagatgctgattaaggcagaggctgcgtttaagaaagcggacgacatctggaatctgcgcaaggatgattattttgttaacgatgaagcgcgggcgcgttactgggatgatcgtgaaaaggcccgtcttgcgcttgaagccgcccgaaagaaggctgaacagcagagtcaacaggacaaaaatgcgcagcagcagagcgataccgaagcatcacggctgaaatataccgaagaggcgcagaaggcttacgaacggctgcagacaccgctggagaaatataccgcccgtcaggaagaactgaacaaggcactgaaagacgggaaaatcctgcaggcagattacaacacgctgatggcggcggcgaaaaaggattatgaagcgacgctgaaaaagccgaaacagtccggcgtgaaggtgtctgcgggcgatcgtcaggaagacagtgctcatgctgccctgctgacgcttcaggctgaactccggacgctggagaagcatgccggagcaaatgagaaaatcagccagcagcgccgggatttgtggaaggcggagagtcagttcgcggtactggaggaggcggcgcaacgtcgccagctgtctgcacaggagaaatccctgctggcgcataaagatgagannnnncattccattcattaattaattaatgaatgaatgnnnnntgcacttttccgggctgacgtacactgtgctcagctgtttttcagcgatccgggatatgcatccgctggatttcagtttgctgaaccggcgtgaggatgacgaagagcctgaagatgatgtgctgatgcagaaagcggcagggcttaccggaggcgtccgctttgacccggacggaaatgaagttatccccgcttccccggatatggcgggcatgacggaggatgacgtaatgctgatgacagtatcagaagggatcgcaggaggagtccggtatggctgaaccggtaggcgatctggtcgttgatttaagtctggatgcggccagatttgacgagcagatggccagagtcaggcgtcatttttccggtacggaaagtgatgcgaaaaaaacagcggcagtcgttgaacagtcgctgagccgacaggcgctggctgcacagaaagcggggatttccgtcgggcagtataaagccgccatgcgtatgctgcctgcacagttcaccgacgtggccacgcagcttgcaggcgggcaaagcccgtggctgatcctgctgcaacagggtggtcaggttaaggactccttcggcgggatgatccccatgttccgggggcttgccggtgcgatcaccctgccgatggtcggggccacctcgctggcggtggcgaccggtgcgctggcgtatgcctggtatcagggtaactcaaccctgtccgatttcaacaaaacgctggtcctttccggcaatcagtcgggtctgacggcagatcgtatgctggtcctgtccagagccgggcaggcggcagggctgacgtttaaccagaccagcgagtcactcagcgcactggttaaggcgggagtaagcggtgaggctcagattgcatccatcagccagagtgtggcgcgtttctcctctgcatccggcgtggaggtggacaaggtcgctgaagccttcgggaagctgaccactgacccgacgtcggggctgacggcgatggcgcgccagttccataacgtaacggcggagcagattgcgtatgttgctcagttgcagcgttccggcgatgaatccggggcattgcaggcggcgaacgaggccgcaacgaaagggtttgatgaccagacccgacgcctgaaagagaacatgggcacgctggaaacctgggcagacaggacagcacgggcattcaaatccatgtgggatgcggtgctggatattggtcgtcctgataccgctcaggagatgctgattaaggcagaggctgcgtttaagaaagcggacgacatctggaatctgcgcaaggatgattattttgttaacgatgaagcgcgggcgcgttactgggatgatcgtgaaaaggcccgtcttgcgcttgaagccgcccgaaagaaggctgaacagcagagtcaacaggacaaaaatgcgcagcagcagagcgataccgaagcatcacggctgaaatataccgaagaggcgcagaaggcttacgaacggctgcagacaccgctggagaaatataccgcccgtcaggaagaactgaacaaggcactgaaagacgggaaaatcctgcaggcagattacaacacgctgatggcggcggcgaaaaaggatnnnnncattccattcattaattaattaatgaatgaatgnnnnncgtatgttgctcagttgcagcgttccggcgatgaatccggggcattgcaggcggcgaacgaggccgcaacgaaagggtttgatgaccagacccgacgcctgaaagagaacatgggcacgctggaaacctgggcagacaggacagcacgggcattcaaatccatgtgggatgcggtgctggatattggtcgtcctgataccgctcaggagatgctgattaaggcagaggctgcgtttaagaaagcggacgacatctggaatctgcgcaaggatgattattttgttaacgatgaagcgcgggcgcgttactgggatgatcgtgaaaaggcccgtcttgcgcttgaagccgcccgaaagaaggctgaacagcagagtcaacaggacaaaaatgcgcagcagcagagcgataccgaagcatcacggctgaaatataccgaagaggcgcagaaggcttacgaacggctgcagacaccgctggagaaatataccgcccgtcaggaagaactgaacaaggcactgaaagacgggaaaatcctgcaggcagattacaacacgctgatggcggcggcgaaaaaggattatgaagcgacgctgaaaaagccgaaacagtccggcgtgaaggtgtctgcgggcgatcgtcaggaagacagtgctcatgctgccctgctgacgcttcaggctgaactccggacgctggagaagcatgccggagcaaatgagaaaatcagccagcagcgccgggatttgtggaaggcggagagtcagttcgcggtactggaggaggcggcgcaacgtcgccagctgtctgcacaggagaaatccctgctggcgcataaagatgagacgctggagtacaaacgccagctggctgcacttggcgacaaggttacgtatcaggagcgcctgaacgcgctggcgcagcaggcggataaattcgcacagcagcaacgggcaaaacgggccgctattgatgcgaaaagccgggggctgactgaccggcaggcagaacgggaagccacggaacagcgcctgaaggaacagtatggcgataatcctctggcgctgaataacgtcatgtcagagcagaaaaagacctgggcggctgaagacctgcttcgcgggaactggatggcaggcctgaagtccggctggagtgagtgggaagagagtgccacggacagtatgtcgcaggttaaaagtgctgccacgcagaccttnnnnncattccattcattaattaattaatgaatgaatgnnnnngaaacctcattgctggaagcctggaaaaagtatcgggtgttgctgaaccgtgttgatacatcaactgcactgatattgagtggcstacgaaccctgtcagggagtaatcattgggattatgccgcagcacgtcttaagcaagaacgtgctgcggttggatgctattttttccctgaagcggaaaacattactacagtaccttgaaccttggttttaacattctcgaaatgctctgagagtatatgtgttaagccttcttcggaatcttttgtgtttgaaaagatgcctttctgattgtaaatgcgcatcagtttttgaccgaagctattgtgcacaactccatcgccaagaattgtggctccgtatagagttccatcgtcagttaaggcctgcgccgcattgcgtattacacagctttttgtagatatatttccaggcaggcagtgaagaaggtaaaacatggaaatggaatcaaattgaccatgtaacgccgcgggataaggttcaaaaacatcatggctaattttatgtttaatttttgattccccagcccttgtagatgccgcgttcaggctagcttcgttcaaatccattaaagatatcagactactctcaggtacgtgagtaaggtaaaacccagttccaacaccaatatccagatggttgttacctacatgttccagaaagtgtggaagaaggtgttcctttgtaggacatccccatgcaagccgatttgatactcccaaaacccaccagtcataaagctttagggtaagtggtgtgtaaattttagccccatcatctgtgttttttttcattgatttcaccatgttatagttttatttgtgaattaaatcaattatggcgatgaattacaaggggttaaatgctgccgcagcatagcgatattgaaatagcctggtatgcttcgatacagcaggagccgaatggctggaagaccgtcaccacacagttctnnnnncattccattcattaattaattaatgaatgaatgnnnnngaaacctcrttgctggaagcctgkaarawgtatcgggtgttgctgaaccgwgttgatacatcaactgccmctgatattgagtggcctrygaaccctgtcagrgagtaatcattgggattatgccgcagcacgtcttaagcaagaacgtgctgcggytggatgctattttttccctgaagcggaaaacattactacagtaccttgaaccttggttttaacattctcgaaatgctctgagagtatatgtgttaagccttcttcggaatcttttgtgtttgaaaagatgcctttctgattgtaaatgcgcatcagtttttgaccgaagctattgtgcacaackccrtcrccaagaattgtggctccgtatagagttccatcgtcagttaaggcctgcgccgcattgcgtattacacagctttttgtagatatatttccaggcaggcagtgaagaaggtaaaacatggaaatggaatcaaattgaccatgtaacgccgcgggataaggwtcaaaaacatcatggctaattttatgtttaatttttgattccccagcccttgtmgatgccgcgttcaggctagcttcgttcaaatccattaaagatatcagactactctcaggtacgtgagtaaggtaaaacccagttccaacaccaatatccagatggttgttacctamatgttccagaaagtgtggaagaaggtgttcctttgtaggacatccccatgcaagccgatttgatactcccaaaacccaccagtcataaagctttagggtaagtggtgtgtaaattttagccccatcatctgtgttttttttcattgatttcaccatgttatagttttatttgtgaattaaatcaattatggcgatgaattacaaggggttaaatgctgccgcagcatagcgatattgaaatagcctggtatgcttcgatacagcaggagccgaatggctggaagaccgtcactacacagttctacatccaggaattcagtgagtatattgcgccactgcaggatgctgtagatctggaaatcgcaacggaggaagaaagatcgttnnnnncattccattcattaattaattaatgaatgaatgnnnnnaacaaattccccggggctatacaataccaccggggagaaaatctrkttaacktygttaaaaggtgtacttaagaccagcagtagtgatgaagttatagttttctatgcctgcaccatttttgctgtagtcwgaagtgttatcattgtgatcataaagtgaagtattaccttttttattcgtaacccgattccatgcgccttcaacataaacytttgcgttaggtgttacgtaataacctgcattgactgcaacagaatagtaattttggtctttgactttactgcgataagtgattctttttcctgggtcatagtgctcatcgttatcagatgcttccacccagccgctgtatttaaatgtgccacctagctcaaaatcttcataacgataacttccagtcaagccaatgtagggmattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgyctactttcatcygtccaggttccggggttactggaatccatccagtcctgatcgaccatattgccacctcggctgycgagwgtwgtccagccmgcagccccratagatatctggggcatcaaatcccaattaattgcacctttaataattgcagcgttattgaatttccagtcragttgactgacttttcggcctccttcttcrgctagataaacrcgctcttttgtttttccgctcagagttccaagactaatgtccgcatttatgttgtcaggagtaaacgatawagtctcggtagaagcaaaagagctgatcgcaataggggktgtcagractattcccagaagttttgcccgcataaaagtctcnnnnncattccattcattaattaattaatgaatgaatgnnnnnaacaaattccccggggctatacaataccaccggggagaaaatctatttaacgttgttaaaaggtgtacttaagaccagcagtagtgatgaagttatagttttctatgcctgcaccatttttgctgtagtcagaagtgttatcattgtgatcataaagtgaagtattaccttttttattcgtaacccgattccatgcgccttcaacataaacttttgcgttaggtgttacgtaataacctgcattgactgcaacagaatagtaattttggtctttgactttactgcgataagtgattctttttcctgggtcatagtgctcatcgttatcagatgcttccacccagccgctgtatttaaatgtgccacctagctcaaaatcttcataacgataacttccagtcaagccaatgtagggaattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgtctactttcatccgtccaggttccggggttactggaatccatccagtcctgatcgaccatattgccacctcggctgccgagtgttgtccagccagcagccccgatagatatctggggcatcaaatcccaattaattgcacctttaataattgcagcgttattgaatttccagtcaagttgactgacttttcggcctccttcttcggctagataaacacgctcttttgtttttccgctcagagttccaagactaatgtccgcatttatgttgtcaggagtaaacgataaagtctcggtagaagcaaaagagctgatcgcaatagggggtgtcaggacnnnnncattccattcattaattaattaatgaatgaatgnnnnnggggagaaaatctggttaacttcgttaaaaggtgtacttaagaccagcagtagtgatgaagttatagttttctatgcctgcaccatttttgctgtagtctgaagtgttatcattgtgatcataaagtgaagtattaccttttttattcgtaacccgattccatgcgccttcaacataaacctttgcgttaggtgttacgtaataacctgcattgactgcaacagaatagtaattttggtctttgactttactgcgataagtgattctttttcctgggtcatagtgctcatcgttatcagatgcttccacccagccgctgtatttaaatgtgccacctagctcaaaatcttcataacgataacttccagtcaagccaatgtagggcattttaaaacgttgtttgtagccgattgctctttctccattcgggaaggagccgatatcatctctgaatccctcctcagaactgtagatataggaaccacctctggctgtaaagctataacggctttcctgatatccggccatgagtcccaggcggtaattgggttcgttgaggagccagcctttgatattcagatcaaattcgttggcataattgagttgtgtatcagggtgcctactttcatctgtccaggttccggggttactggaatccatccagtcctgatcgaccatattgccacctcggctgtcgagagtagtccagcccgcagccccaatagatatctggggcatcaaatcccaattaattgcacctttaataattgcagcgttattgaatttccagtcgagttgactgacttttcggcctccttcttcagctagataaacgcgctcttttgtttttccgctcagagttccaagactaatgtccgcatttatgttgtcaggagtaaacgatatagtctcggtagaagcaaaagagctgatcgcaataggggttgtcagaactattcccagaagttttgcccgcataaaagtctcnnnnncattccattcattaattaattaatgaatgaatgnnnnnacagggtctttgtgaatgtcgatcgggcgttcacggacaaggccaaaaatagtctggcggtcgtagcgaagggcatcaggctgtttgcgcattgatgccgagatacgcttccagtcttcgcggtcgttgtcgataacttcattttttgcccagcgatggatgctgccgtcaatgtttccggcatccacatcaccaggccagagagcgtaggccagttcgtcatccagtgttttccatgtctgcttgtattcgcgatgaatggcagcaatgaccgggctgatttttcctgttgaattttcagtgtrctgttgattggctctggcgcgggcgagatcaacaacagacgtgtattttccggtttccttgcgttcaccttcgcgacgttttttccagatgcgcatctctgcctgaatttcgggccatttrgcaccaggmwtacatttatgcttaacccacccratggcrtgcarcttaagctccggatacatggcgttaacttctggcattttcatcaacgcttcaacgatatgtccgtcgaatgttgccatgtcttcctgcaayarttcctgygcgctaatmaccatatcaacggtgatgttttcacatgtgtcgaacttaaccatgacagcgttctgtacttcaggggccagcttgtcaaaagtgacgttcatcggatckgattcagtctcraccggracaaaggaagcagackcctcatcccagcggttttcctgcatatattcagcatcccaggaatcgagggcagggcggggtataccrggtttatcctcgcaaacaagaaatttataagcgcagtcctgagcagccggataatgttccaggaattgccagtgaaattttgcgcgggcgcgacgttcatcaccggcttcaatggcagtggctacagcgackgcaccttcttcctttattrcctgttcgtccggaatggcggcgcaaataaagactttactcattttgttttacctcattacagannnnncattccattcattaattaattaatgaatgaatgnnnnnagctaatgcagccggtgcgatagctacagggcttttatctctcattattcctgttccactgacgacagttcagtgggccaataaacattattaccttcctaaagagtcgtcttataccccggggcgatgggaaacactgccgtttcaggttggcatcatgaactgtatgggcaacgatctgattcgcacggttaacctgattaaatctgcccgtgttggttatacaaagatgttgctgggagtggaggcttattttattgagcataaatcacgcaacagccttctttttcagcccacggactcagctgctgaagattttatgaaatctcatgttgagccaacgataagggatgttcctgcattgctggagctggctccatggttcggaagaaaacaccgcgataatacgctcaccctgaagcgtttttcctccggtgtgggtttctggtgtctggggggagcggcagcaaaaaactaccgtgaaaaatccgtggatgtggtctgttatgacgagctttcctcgttcgaaccggatgttgaaaaagagggttcgccaaccctgctgggggataaacgtattgagggctctgtatggccaaaatccattcgcggctcgacgcctaaaatcaaaggctcctgccagatcgaaaaagccgctaacgagtcggcacacttcatgcgtttttatgtgccctgtccgcactgtggggaggagcagtatctgaaatttggcgatgatgcctcgcctttcggtcttaagtgggagaagaataagccagaaagtgttttctacctttgtgagcatcatggctgtgtgatccatcagtctgagcttgaccagagtaacgggcggtggatctgtgaaaacacgggcatgtggacccgtgacggcctgatgtttttcagcgcccggggtgatgaaattccgccgccgcgctccatcactttccatatctggacggcgtacagtccgttcaccacctgggtacagattgtctatgactggctggatgcactgaaagatcccaacggcctgaaaacctttgtgaacaccacgctgggcgagacctgggaagaggctgtgggcgaaaaactcgatcaccaggtgctgatggataaggttgtgcgttacacggcggcggtgcctgcccgggtggtttatctgacggcgggcattgactcgcagcgaaaccgttttgagatgtatgtctggggatgggctccgggagaggaagcctttctggtggataaaatcatcattatggggcgtcccgatgaggaagagacgctgttacgtgtggatgcggcgatcaacaaaaaataccgccatgcagacggaaccgaaatgaccatttcccgtgtctgctgggacatcggggggatcgatggcgaaatcgtttatcagaggtcaaaaaaacacggtgttttccgggtgctgccggtaaaaggcgcatctgtctatggcaagccggtgatcaccatgccaaaaacccgcaatcagcggggcgtgtatctgtgtgaagtggggacggacaccgcaaaagaaattctctannnnncattccattcattaattaattaatgaatgaatgnnnnnagctaatgcagccggtgcgatagctacagggcttttatctctcattattcctgttccactgacgacagttcagtgggccaataaacattattaccttcctaaagagtcgtcttataccccggggcgatgggaaacactgccgtttcaggttggcatcatgaactgtatgggcaacgatctgattcgcacggttaacctgattaaatctgcccgtgttggttatacaaagatgttgctgggagtggaggcttattttattgagcataaatcacgcaacagccttctttttcagcccacggactcagctgctgaagattttatgaaatctcatgttgagccaacgataagggatgttcctgcattgctggagctggctccatggttcggaagaaaacaccgcgataatacgctcaccctgaagcgtttttcctccggtgtgggtttctggtgtctggggggagcggcagcaaaaaactaccgtgaaaaatccgtggatgtggtctgttatgacgagctttcctcgttcgaaccggatgttgaaaaagagggttcgccaaccctgctgggggataaacgtattgagggctctgtatggccaaaatccattcgcggctcgacgcctaaaatcaaaggctcctgccagatcgaaaaagccgctaacgagtcggcacacttcatgcgtttttatgtgccctgtccgcactgtggggaggagcagtatctgaaatttggcgatgatgcctcgcctttcggtcttaagtgggagaagaataagccagaaagtgttttctacctttgtgagcatcatggctgtgtgatccatcagtctgagcttgaccagagtaacgggcggtggatctgtgaaaacacgggcatgtggacccgtgacggcctgatgtttttcagcgcccggggtgatgaaattccgccgccgcgctccatcactttccatatctggacggcgtacagtccgttcaccacctgggtacagattgtctatgactggctggatgcactgaaagatcccaacggcctgaaaacctttgtgaacaccacgctgggcgagacctgggaagaggctgtgggcgaaaaactcgatcaccaggtgctgatggataaggttgtgcgttacacggcggcggtgcctgcccgggtggtttatctgacggcgggcattgactcgcagcgaaaccgttttgagatgtatgtctggggatgggcnnnnncattccattcattaattaattaatgaatgaatgnnnnngtgggtttctggtgtctggggggagcggcagcaaaaaactaccgtgaaaaatccgtggatgtggtctgttatgacgagctttcctcgttcgaaccggatgttgaaaaagagggttcgccaaccctgctgggggataaacgtattgagggctctgtatggccaaaatccattcgcggctcgacgcctaaaatcaaaggctcctgccagatcgaaaaagccgctaacgagtcggcacacttcatgcgtttttatgtgccctgtccgcactgtggggaggagcagtatctgaaatttggcgatgatgcctcgcctttcggtcttaagtgggagaagaataagccagaaagtgttttctacctttgtgagcatcatggctgtgtgatccatcagtctgagcttgaccagagtaacgggcggtggatctgtgaaaacacgggcatgtggacccgtgacggcctgatgtttttcagcgcccggggtgatgaaattccgccgccgcgctccatcactttccatatctggacggcgtacagtccgttcaccacctgggtacagattgtctatgactggctggatgcactgaaagatcccaacggcctgaaaacctttgtgaacaccacgctgggcgagacctgggaagaggctgtgggcgaaaaactcgatcaccaggtgctgatggataaggttgtgcgttacacggcggcggtgcctgcccgggtggtttatctgacggcgggcattgactcgcagcgaaaccgttttgagatgtatgtctggggatgggctccgggagaggaagcctttctggtggataaaatcatcattatggggcgtcccgatgaggaagagacgctgttacgtgtggatgcggcgatcaacaaaaaataccgccatgcagacggaaccgaaatgaccatttcccgtgtctgctgggacatcggggggatcgatggcgaaatcgtttatcagaggtcaaaaaaacacggtgttttccgggtgctgccggtaaaaggcgcatctgtctatggcaagccggtgatcaccatgccaaaaacccgcaatcagcggggcgtgtatctgtgtgaagtggggacggacaccgcaaaagaaattctctannnnncattccattcattaattaattaatgaatgaatgnnnnncacgggcacgttttgatttttatcaggcgcgatcagcctggtcacgggcagagtggattggtgccggaagaatggccattgacgggctcaaggaagtccaggaatcagtgatgcgcattgaggccggactgagcacgtatgagaaagagctggcgctgatgggcgaggattatcaggacattttccgccagcaggtcagggaatctgctgagcggcaaaaagccggactctcacgtccggtgtggatagagcaggcgtatcagcagcagatagcggagagtcgtaggccggaagaggagacaacaccacgtgagacgtaatctttcacacattattgccgcagcattcaatgaaccgctgcttctggagcccgcctatgcgcgggttttcttttgcgcgctcgggcgcgagatgggggcagcaagtctttcggtaccacaacagcaggtacagtttgatgctcccggaatgctggctgaaacggacgagtacatggccggaggtaaacgaccggcccgtgtttaccgggtggtgaacggtattgctgtactgccggtgaccggcacgctggtgcaccggctgggggggatgcggccattttccggaatgacaggctatgacggcattgtcgcctgtcttcagcaggcaatggcggcattgtcgcctgtcttcagcaggcaatggcggatagccaggtgcggggcgtactgctggacattgacagtccgggcgggcaggccgccggcgcgtttgactgcgctgacatgatttaccgcctccgtcagcagaagccggtctgggcactgtgcaatgacacggcctgttctgcagccatgctgctggcgtcggcctgctcccgacggctggttacccagacatcccgtatcggctccattggcgtgatgatgagccatgtcagctatgccggtcatctggcgcaggccggtgtggatatcacgctgatttactcaggggcgcacaaggtggatggcaatcagtttgaagcgttgccggcagaggttcgccaggacatgcagcagcggattgatgcggcgcgccggatgtttgccgaaaaagtggcgatgtataccggtctgtctgttgatgccgtcacgggaacagaggctgccgtttttgaaggtcagtccggcattgaggccgggctggcggatgaattaatcaatgcgtcggatgccatcagtgtgatggccacggcgctgaacagtaatgtcagaggaggcactatgccgcaattaactgcaacggaagccgccgcgcaggagaaccagcgagtgatggggatcctgacatgccaggaagcgaaaggacgtgaacagcttgccacgatgctggcaggacaacagggcatgagcgttgaacaggcccgggcgattctggccgcggcggcaccgcagcagccggtggcatccacgcagagtgaagccgatcgcattatggtgtgtgaagaagcgaacggtcgtgaacaactggcggcaacgctggcggcgatgccggagatgacggtggaaaaagcccgcccgatcctggctgcttcaccgcaggcggatgccggaccatcactccgtgatcagatcatggcactggatgaggcaaaaggggctgaggcgcaggctgaacagctggctgcctgcccgggaatgacagtggagagcgcccgggctgtgctggctgcgggatcaggtaaggcagaaccggtctctgcatccacaaccgccatgtttgaacatttcatggcgaaccattcaccggcagcggtacagggtggcgtggcacagacgtcagcagacggtgatgcggacgtgaaaatgctcatggccatgccatgaagtcagtgctgaccatcaataggaggtttttacaatatggtgacgaaaaccatcactgaacagcgtgcggaagtacgtatttttgccggtaatgatccggctcataccgccacaggcagcagcgggatttcctcgccaacaccggcactgacgcccctgatgctggatgaagccaccgggaaactggtggtctgggacggacagaaagccggtagtgcggttggcatactggtactgccgcttgaaggcacagagacggcgctgacgtattacaagtcgggaacctttgcgacggaggcaatccactggcctgaaagtgtggatgaacacaaaaaggccaacgcctttgctggcagtgccctgagtcacgcggcgctgccgtaacacgttatcaggccaccgcggtggcctgactgatttctgaatgaaaggaactgatttatgggattgtttacgacccgccagttactcggttataccgaacaaaaagttaaatttcgtgcgctgtttctggagctgtttttccgccgtacggtgaatttccataccgaagaggtgatgctggacaaaattaccggaaaaacgccggtggcggcctatgtctccccggttgttgaaggaaaagtgctgcgtcatcgtggtggtgaaacccgcgtgttgcgtccgggctacgtcaagccgaaacacgaatttaattaccagcaggcggttgagcgccttcctggtgaagatccatctcaactgaatgatccggcttaccgccgtctgcgtatcattaccgataacctcaaacaggaagagcacgcgattgtccaggtggaagaaatgcaggcggtaaatgctgtgttgtatggcaaatacaccatggaaggagaccagttcgagaaaattgaggtcgattttggcaggtcgacgaagaataacatcactcagggtagtggtaaggagtggtcaaaacaggatcgtgacacgttcgatcctacacatgatattgacctctactgcgacctggccagcggtcttgtgaatattgccattatggacggtaccgtctggcgtcttctgaatggttttaagctgttccgcgaaaaactggatacccgtcgcggttcaaattctcaactcgaaacggcagtgaaagatctgggcgcagtggtgtccttcaaggggtattacggcgatctggccattgtggtggcgaaaacgtcttatatagcagaagacggtatcgaaaaacgttatcttccagatggcatgctggttctggggaatactgctgcagatgggatccgttgttacggtgccattcaggatgctcaggcgttgtccgaaggtgtggtggcctcttcccgttatccgaaacactggctgacggtaggggatcccgcccgtgaatttaccatgacgcagtccgcgccgctgatggtgttgccggacccggatgagtttgtggtggtacaggtgaaataatccgtgagcgggggcgaaatgcccccgtgtcttttttcacagggggctgatatggcaacgaaagagcaaaatctgaaacggcttgatgaactggccctgattctggggcgtgagccggatatatccgggagtgccgcagagatagcgcagcgggtggcagaatgggaagaggaaatgcagtcatccggcgatgatgtacaggttatgaatatggatatccgggagcgggaaaccgcggctcatgatgttcgtgaggaaacatccggcgcgttaacgcgcatcagagttctgacctgcctccatctctgtggcgttgatggtgaaacgggggaatccgttgagcttgcggatgttggtcgggtgattctgattatgtcctcagatgcaaaaacacacgttgatggtggaatggctgtttatgcgtgattttcagaatgcctttgatgccgcccttgccggggtggacagtacgattgttgaagtgatgggcatcagtgcgcagttcacctccggtgcacagcgtggcggcgaggttcatggcgtttttgacgatccggagtcgctgggttttgccagtagtgggatccgtattgaaggaagtaacccgtcattatttgtgcttacggatacggtttgtgctgtacggcgtggtgacacgctgaccattaacggcgagatgttctgggtggaccgtgtttctccggatgacggagggagttgttatctctggctcaaccgggggcaaccacctgccgccagccgtcgccgctgaaagggggatgtatggccataaaaggtcttgagcaggccgttgaaaacctcagccgtatcagcaaaacggcagtgcctggtgccgccgcaatggccattaaccgcgttgcttcatccgcgatatcgcagtcggcgtcactggttgcccgtgagacaaaggtacgccggaaactggtaaaggaaagggccaggctgaaaagggccacggtcaaaaatccgcaggccagaatcaaagttaaccggggggatttgcccgtaatcaggctgggtaacgcgcgggttgtcctgtcccgacgcaggcgtcgtaaaaaggggcagcgttcatccctgaaaggtggcggcagcgtgcttgtggtgggaaaccgtcgtattcccggcgcgtttattcagcaactgaaaaatggccggtggcatgtcatgcagcgtgtggccgggaaaaaccgttaccccattgatgtggtgaaaatcccgatggcggtgccgctgaccacggcgtttaaacagaatattgagcggatacggcgtgagcgtcttccgaaagagctgggctatgcgctgcagcatcaactgagaatggtaataaagcgatgaaacatactgaactccgtgcagccgtactggatgcactggagaagcatgacaccggggcgacgctttttgatggtcgccctgctgtttttgatgaggaagattttccggcaattgccgtttatctcaccggcgctgaatacacgggcgaagagctggacagcgatacctggcaggcggagctgcatattgaagttttcctgcctgctcaggtgccggattcagagctggattcgtggatggagtcccggatttatccggtgatgagcgatatcccggcactgtcagatttgatcaccagtatggtggccagtggctatgactaccggcgcgacgatgatgcgggcctgtggagttcagccgatctgacttatgtcattacctatgaaatgtgaggacgatatgccaacaccaaatcctctggcaccggtgaaaggggccgggaccacactgtgggtttataacgggagcggcgacccttatgcaaacccgctttcagacaatgactggtcgcgtctggcaaaaattaaagacctgacgcccggcgaactgaccgctgagtcctatgacgacagttatctcgatgatgaagatgcggactggaccgcgaccgggcaggggcagaaatccgccggagataccagcttcacgctggcgtggatgcccggagagcaggggcagcaggcgctgctggcgtggtttaatgaaggtgatacccgtgcctataaaatccgcttcccgaacggcacggtcgatgtgttccgtggctgggtcagcagtatcggtaaggcggtgacggcgaaggaagtgatcacccgtacggtgaaggtcaccaatgtgggccgtccgtcaatggcagaagatcgcagtacggtgacggcggcaaccggtatgaccgtgacgcctgccagctcctcggtggtgaaagggcagagcaccacgctgaccgtggccttccagccggagggcgcaactgacaagagcttccgtgcggtgtcagcggataaaacaaaagccaccgtgtcggtcagtggtatgaccatcaccgtgaacggcgttgctgcaggcaaggtcaacattccggttgtatccggtaatggtgaacttgctgcggttgcagaaatcactgtcaccgacagttaatccggagagtcagcgatgttcctgaaaaccgaatcatttgaacataacggcgtgaccgtcacgctttctgaactgtcagccctgcagcgtattgagcatctcgccctgatgaaacagcaggcagaacaggcggagtcagacagcaaccggcaggttactgtggaagacgccatcagaaccggtgcttttgtggtggcgatgtccctgtggcataaccatccgcagaagacaaagcagccttccatgaatgaagccgttaaacagattgagcaggaagtgcttaccacctggcccgcggaggcaatttctcatgctgaaaacgtggtgtaccggctgtccggtatgtatgggtttgtggtgaatgatgcccctgaccaggcagaggactccgggcctgcagagcctgtttctgcgggaaagtgttcgacggtgagctgagttttgccctgaaactggcgcgagagaaggggcgacctgactggcgcgccatgcttgccgggatgtcatccacggagtatgccgnnnnncattccattcattaattaattaatgaatgaatgnnnnncacgggcacgttttgatttttatcaggcgcgatcagcctggtcacgggcagagtggattggtgccggaagaatggccattgacgggctcaaggaagtccaggaatcagtgatgcgcattgaggccggactgagcacgtatgagaaagagctggcgctgatgggcgaggattatcaggacattttccgccagcaggtcagggaatctgctgagcggcaaaaagccggactctcacgtccggtgtggatagagcaggcgtatcagcagcagatagcggagagtcgtaggccggaagaggagacaacaccacgtgagacgtaatctttcacacattattgccgcagcattcaatgaaccgctgcttctggagcccgcctatgcgcgggttttcttttgcgcgctcgggcgcgagatgggggcagcaagtctttcggtaccacaacagcaggtacagtttgatgctcccggaatgctggctgaaacggacgagtacatggccggaggtaaacgaccggcccgtgtttaccgggtggtgaacggtattgctgtactgccggtgaccggcacgctggtgcaccggctgggggggatgcggccattttccggaatgacaggctatgacggcattgtcgcctgtcttcagcaggcaatggcggcattgtcgcctgtcttcagcaggcaatggcggatagccaggtgcggggcgtactgctggacattgacagtccgggcgggcaggccgccggcgcgtttgactgcgctgacatgatttaccgcctccgtcagcagaagccggtctgggcactgtgcaatgacacggcctgttctgcagccatgctgctggcgtcggcctgctcccgacggctggttacccagacatcccgtatcggctccattggcgtgatgatgagccatgtcagctatgccggtcatctggcgcaggccggtgtggatatcacgctgatttactcaggggcgcacaaggtggatggcaatcagtttgaagcgttgccggcagaggttcgccaggacatgcagcagcggattgatgcggcgcgccggatgtttgccgaaaaagtggcgatgtataccggtctgtctgttgatgccgtcacgggaacagaggctgccgtttttgaaggtcagtccggcattgaggccgggctggcggatgaattaatcaatgcgtcggatgccatcagtgtgatggccacggcgctgaacagtaatgtcagaggaggcactatgccgcaattaactgcaacggaagccgccgcgcaggagaaccagcgagtgatggggatcctgacatgccaggaagcgaaaggacgtgaacagcttgccacgatgctggcaggacaacagggcatgagcgttgaacaggcccgggcgattctggccgcggcggcaccgcagcagccggtggcatccacgcagagtgaagccgatcgcattatggtgtgtgagagcgacggtcgtgacactggcggcacgctggcggcgannnnncattccattcattaattaattaatgaatgaatgnnnnncagctatgccggtcatctggcgcaggccggtgtggatatcacgctgatttactcaggggcgcacaaggtggatggcaatcagtttgaagcgttgccggcagaggttcgccaggacatgcagcagcggattgatgcggcgcgccggatgtttgccgaaaaagtggcgatgtataccggtctgtctgttgatgccgtcacgggaacagaggctgccgtttttgaaggtcagtccggcattgaggccgggctggcggatgaattaatcaatgcgtcggatgccatcagtgtgatggccacggcgctgaacagtaatgtcagaggaggcactatgccgcaattaactgcaacggaagccgccgcgcaggagaaccagcgagtgatggggatcctgacatgccaggaagcgaaaggacgtgaacagcttgccacgatgctggcaggacaacagggcatgagcgttgaacaggcccgggcgattctggccgcggcggcaccgcagcagccggtggcatccacgcagagtgaagccgatcgcattatggtgtgtgaagaagcgaacggtcgtgaacaactggcggcaacgctggcggcgatgccggagatgacggtggaaaaagcccgcccgatcctggctgcttcaccgcaggcggatgccggaccatcactccgtgatcagatcatggcactggatgaggcaaaaggggctgaggcgcaggctgaacagctggctgcctgcccgggaatgacagtggagagcgcccgggctgtgctggctgcgggatcaggtaaggcagaaccggtctctgcatccacaaccgccatgtttgaacatttcatggcgaaccattcaccggcagcggtacagggtggcgtggcacagacgtcagcagacggtgatgcggacgtgaaaatgctcatggccatgccatgaagtcagtgctgaccatcaataggaggtttttacaatatggtgacgaaaaccatcactgaacagcgtgcggaagtacgtatttttgccggtaatgatccggctcataccgccacaggcagcagcgggatttcctcgccaacaccggcactgacgcccctgatgctggatgaagccaccgggaaactggtggtctgggacggacagaaagccggtagtgcggttggcatactggtactgccgcttgaaggcacagagacggcgctgacgtattacaagtcgggaacctttgcgacggaggcaatccactggcctgaaagtgtggatgaacacaaaaaggccaacgcctttgctggcagtgccctgagtcacgcggcgctgccgtaacacgttatcaggccaccgcggtggcctgactgatttctgaatgaaaggaactgatttatgggattgtttacgacccgccagttactcggttatacnnnnncattccattcattaattaattaatgaatgaatgnnnnntcgccagctgtctgcacaggagaaatccctgctggcgcataaagatgagacgctggagtacaaacgccagctggctgcacttggcgacaaggttacgtatcaggagcgcctgaacgcgctggcgcagcaggcggataaattcgcacagcagcaacgggcaaaacgggccgctattgatgcgaaaagccgggggctgactgaccggcaggcagaacgggaagccacggaacagcgcctgaaggaacagtatggcgataatcctctggcgctgaataacgtcatgtcagagcagaaaaagacctgggcggctgaagacctgcttcgcgggaactggatggcaggcctgaagtccggctggagtgagtgggaagagagtgccacggacagtatgtcgcaggttaaaagtgctgccacgcagacctttgatggtattgcgcagaatatggcggcgatgctgaccggcagtgaacagaactggcgcagcttcacccgttccgtgctgtccatgatgacagaaattctgcttaagcaggcaatggtggggattgtcgggagtatcggcagcgctattggcggggctgttggtggcggcgcatccgcgtcaggcggtacagccattcaggccgctgcggcgaaactccattttgcaaccggaggatttacgggaaccggcggcaaatatgagccagcggggattgttcaccgtggtgaatttgtcttcacgaaggaggcaaccagccggattggcgtgggaaatctctaccggctgatgcgcggctatgccaccggcggttatgtcggtggcaccggaagtccggcgcaaatgcggcgttcagagggtatcaggtttgagcagaacaacaacgtggtgattcagaacgacggtacgaatggtctgccaggtccacagatgatgaaggcggtgtatgacatggcccgcaagggtgcccgtgatgaaatccaggcacagatgcgcgatggtggtctgttctccggaggtggacgatgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcgggtcagtatgctgcgtgttgagttcagcgcagagtttgaacaggtggtgaactgatgcaggatatccggcaggaaacattgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggcgacagtatcagccgtatcccattcaggggagtagttttgaactgaatggcaaaggcaccagtacgcgccccacgctgacggtttctaacctgtacggtatggtcaccgggatggtggaagatctgcagagtctggtcggcggaacggnnnnncattccattcattaattaattaatgaatgaatgnnnnnattaattttaatcagaacaatcacgtggtgattcagaacgacggtacgaatggtctgccaggtccacagatgatgaaggcggtgtatgacatggcccgcaagggtgcccgtgatgaaatccaggcacagatgcgcgatggtggtctgttctccggaggtggacgatgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcaggtcagtatgttgcgtgttgggttcagcgcagagtttaaacaggtggtgaactgatgcaggatatccggcaggaaacactgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggaggcagtatcaggcgtatcccattcaggggagcggttttgaactgaatggcaaaggcaccagtacgcggcccacgctggcagtctctaacctgtacggcatggtcaccggtatggtggaagatatgcagagtctggtcggcggaacggtggtccggcgtaaggtttacgcccgttttctggatgcggtgaacttcgtcaacggaaacagagacgccgatccggagcaggaggtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtnnnnncattccattcattaattaattaatgaatgaatgnnnnnattaattttaatcagaacaatcacgtggtgattcagaacgacggtacgaatggtctgccaggtccacagatgatgaaggcggtgtatgacatggcccgcaagggtgcccgtgatgaaatccaggcacagatgcgcgatggtggtctgttctccggaggtggacgatgaaaaccttccgctggaaagtgaaacccgggatggatgtgacatcggctccttccgtcagggaggtgcgctttggtgatggctattcccagcgtgcgcctgccgggctgaacgctgacctgaaaacgtacagcgtgacgctgtctgtctcccgtgaggaggccacggcgctggagtcgtttctggctgagcacgggggctggaaggcctttctgtggacgccgccttatggttacaggcagataaaggtgacctgcgcaaaatggtcgtcgcaggtcagtatgttgcgtgttgggttcagcgcagagtttaaacaggtggtgaactgatgcaggatatccggcaggaaacactgaatgaatgcacccgtgcggagcagtcggccagcgtggtgctctgggaaatcgatctgacagaggtcggtggagaacgttattttttctgtaatgagcagaacgaaaaaggtgagccggtcacctggcaggggaggcagtatcaggcgtatcccattcaggggagcggttttgaactgaatggcaaaggcaccagtacgcggcccacgctggcagtctctaacctgtacggcatggtcaccggtatggtggaagatatgcagagtctggtcggcggaacggtggtccggcgtaaggtttacgcccgttttctggatgcggtgaacttcgtcaacggaaacagagacgccgatccggagcaggaggtgatcagccgctggcgcatcgagcagtgcagcgaactgagcgcggtgagtgcctcctttgtactgtccacgccgacggaaacggatggcgctgtttttccggggcgtatcatgctggccaacacctgcacctggacctatcgcggtgatgagtnnnnncattccattcattaattaattaatgaatgaatgnnnnncgcgcactcaatggcctgacggataaaackgccgttgcgcacctgggccatggaaattttgttgacgtagctgccacgctgcggacgaatttgaatcagaccgttttccgccagtttaataaaggcttcacgaaccggctggcgtgacacattgaaacgaacagaaacttctttttccgacaacggtgtgcctggtgcaatcaggcaatggacaatgtcgcggcgaagaatacgataaatctgctgattgacaggctgtgtgggattaagttgcgtttcgacggtcattcgttcttgcttgtgagtgagttaactgcatgagtctaccacttttttgtgacaagcaataacccggcagttacgccgggtataaaaattactgacggtggacattcagtccggcatagctttgggtaaccggcatcatttccagggtattgatattgacgtgagcaggcagcgttgacacccaccagacggcttcgctgacatcttctggcgtcaatgcaacggtattttgataggttttttccgctttaccgtcatcgcctttaaagcggacattggaaaactcggtgccacccaccagacccggttcgatgtcggtgacgcgcaccgccgtaccatgcaggtccgtacgcagattcaggctaaactgacgaacaaacgctttcgtcgcaccgtaaacgttaccaccggcatacggccagctgcctgccgttgagccaatgttaataatatgaccatgattacgttcaaccatacccggtaagacggcgcgcgtcatatataccaggcctttgttgttggtatcaatcatcgtttcccagtcttcaacgctggctttatgcgcaggctccatgcccaacgccagaccggcattatttaccaggatatcaatattgctccactcggcaggaagcgatgccagcatctcttcaatagcggcgcggttgcgaacgtccagttgggcgatatacagattatctcccagttcgtcttttaactcctgcaaccgctcctggcgacggccagtggcgataactttatgcccttgttgaataaaacgacgagtaatgcattcaccaaaacctgccgttgctccagttactaaaacgatcatctcactgttcctcaacgcttttgtgtgtcaataacatagcacgtgatgcttaagagcgggtaatactggtttgcaagattgcactccgttatcagtaagcctacgctatggaacacctcgcgttcaggagaagaaaatgacaacaatgaatcctttccttgtgcaaagcacactgccgtatctggctccccattttgatcaaattgccaaccatcactatcgcccggcattcgatgagggaatacagcaaaagcgggcagaaattgctgccatcgcgcttaacccgcaaacacctgatttcaaaaatactattctggcactggaacaaagcggagaattacttacccgcgttaccagcgtcttttttgcgatgactgcggcgcataccaatgatgaattacagcgtcttgatgaacagttttccgctgaactggcggaacttgcgaatgatatctatctgaacggggaattattcgcgcgggtagatgctgtctggcaacgccgtgaatccttggggcttgatagtgaatccatccgcctggtggaggtgattcatcaacgttttgtccttgccggagccaaacttgagcaagctgataaagcaaaattaaaagtactgaatacagaagctgcgaccctgaccagccagtttaaccagcggttactggcagcaaataaatccggcggtctggttgtgaacgatatcgcgcagctggcaggaatgagtgaacaagagattgcgctggcggcagaggcggctcgcgagaaaggtctggataacaactggctgattccgctgctgaataccacccagcaaccagtgcttgctgaactgcgcgatcgcgcgacgcgtgaaaaactgtttactgcgggctggacgcgagcggaaaaaatgatgccaatgatacccgcgctatcattcaacgtctggtggagatccgcgtgcagcaggcgaaactgcttggttttcctcattatgccgcatggaaaatcgccgatcagatggcaaaaacgccagaagcagcactcaactttatgcgggaaattgttccagcggcgcgtcaacgtgcgagcgatgaattagcctccatacaggcggttatcgataagcagcagggcgggtttagcgcgcagccgtgggactgggcattttatgccgagcaggtaagacgtgagaaattcgatctcgatgaatcgcagctcaagccatattttgaattaaacacggtgttgaatgaaggtgtattctggaccgcgaatcagctcttcggtattaagtttgtcgaacgttttgatattcctgtctaccatcctgacgttcgagtgtgggaaatttttgatcataatggcgtggggctggcgttattttacggtgatttcttcgcccgtgattcaaaaagcggcggtgcatggatgggcaattttgttgagcaatcaacgctgaatgaaacgcacccggtaatttataacgtctgcaattatcagaaacccgctgccggtgagcctgcgttgttactctgggatgatgtaataaccttattccatgaatttggtcatacgctgcacggcctttttgcccgccagcgttatgccacgctttccggcaccaacacgccgcgtgattttgtcgaatttccgtcgcaaatcaacgaacactgggcaacacatccgcaggtatttgctcgctacgcccggcattatcagagcggggccgcaatgcctgacgaacttcaacagaaaatgcgtaatgccagtctgttcaataaagggtatgagatgagcgaactgcttagcgccgcacttctcgatatgcgctggcattgcctggaagaaaacgaagcaatgcaggacgtcgatgatttcgaattgcgggcgctggtggcggaaaatatggatcttcctgctataccgccacgctatcgcagcagttatttcgcccatatttttggtggcggatatgccgcaggttattacgcttatctgtggacgcaaatgttggccgatgatggttaccagtggtttgttgagcagggcggattaacgcgtgaaaatgggcggcgttttcgcgaggcgattctttccagaggtaacagcgaagatctggaacgcctgtatcgacaatggcgcggtaaggcacctcagattatgccgatgctgcaacatcgtggcttgaacgtataaacacaaccaatggctggcctggatttatcgccagaccagcctcgttatagcagtaattgcagcagctgggcgagggcaaacttcaccgctaatgcgaatgccgtttcgcagtcgccagcaaaattactttttttgtatacccttccgttataataattttcaaattcagccggaccagatgagcaacattagcggcagtctggataagaaaagcgcgccgaccgtcgttcgggtcactcatttgcagaaataaaaataaattagcctgatggcctgaactactgggccattaggttattgggttatgctatttgtcatccttttaattgcgataatgcaggcttaatttacagaattaaacacttttttatctgctgattttgtttcaaatcacaatgttatctcagagatgactcataacttcggatttctatgaaaatattgacgtaattttgcttttctctcgttagaatagcgcgcacaaggaactgtgaaaaaggagtggcaatgatcaagaagacaacggaaattgatgccatcttgttaaatctcaataaggctatcgatgcccactaccagtggctggtaagtatgtttcgcagcgtagtcgcgagagatgccagtaagccagaaataacggataaccattcttatggactgtgccagtttggtcggtggattgatcatctgggaccactcgataacgatgaattaccttatgttcggctaatggattctgcccatcaacatatgcataactgtggtcgggaattaatgctggctattgttgaaaatcactggcaggacgcgcatttcgacgcttttcaggaagggttgctttcttttactgcggcattaaccgattacaaaatttatttgctgacgatccgtagcagtatggatgttctgacgggattgccgggtcgtcgggttcttgatgaatccttcgatcatcagttacgcaatgctgaacctctgaatctttatttaatgttgttggatatagaccgatttaaattggttaatgatacctacgggcatttaatcggcgatgtagtattacgcaccctcgcaacttacttagccagttggacgcgcgattacgaaacggtttatcgctacgggggcgaagaatttatcattattgtcaaagcgactaatgatgaagaagcatgtcgtgcaggtgtcagaatttgccagttagtcgataaccatgccatcacacattctgaagggcatatcaacattaccgtgactgctggtgtgagtcgtgcatttcctgaagagcctctggatgtggtcattggaagagcggacagggcaatgtatgagggtaagcaaaccggaaggaatcgctgcatgtttattgacgaacaaaatgtgattaaccgagtttaagctccgtttaacattcattgagaaaactgatgctactgtgtcaacgatccgttatcagtgcaggaaaatgcctgttagcgtaaaagcaaaacacaaatctatccatgcaagcattcaccgccggtttactggcggttttttttcgccgtcataaaaatcaggccccttgtacacaactgtaacaaggggccggttaggtgagggattatctccgttcattagtcatcccatttgtggctgaaatacgcggccagaaacccagaaaataaaattattcccagtacggccataaaaacattcatattacccagcattatttgcctccgtttatggtgtggtgtgtttcctcgcttaccttaattttcatctcaatgagaaagatattagcagaggtaacctaaacgaaggctgaattaaattcttattgtgttcgacttaaatcaacaaagcgcgggctgcccccacggtcttgcacgaattccttttaacatcagcacccacgcaacaacgatcaccaacgctaagatgataaacagcgagaaaggcggcagactggtaagtactatgccactcactaatgggttaatcgcagcaccaagccagcctaaagactgggcggaaaaatagctggctttcattcctggcggcgcaatatggtcaatcaacatatactcgcccggcgcataaatgatttcaccgacagtaaataccgcagctgacataccccacaatagcaggctgttgccggaaaaaataaaaccgaccagcccgatgacgaaacagagggtgcctgctgtcatcagcgcgcggatgttagccgggttaaggcggcggcccacggaatattgcaacgtaaccaccatggcagcattcaccggaagaacaaccgcgaccaccttttcggcaaaatcaccatcagcaatcaccatcacatattgtgaaatgcatgaagcaaatgcgccgctaacaaaagaagccagaaagccagagcaggtaaaccacaacagtgctttatcttgtaataaaactttcggcgaccagacactgcctgtttccgtggcgatgattttctcgctgcgctttacccaaatttgaatgaaaagcatggggaacgcggaacagatagctgccagccagaagggcagattgatgctctgcatcaccaacagcgtgccgagtggcggaccgatggtccagccaatgttgagcatggtgtagttgattgagaaaatcttcgttttgctgttggacgaaagattgtcggcaaaccaggctttcagcacggtagcaaaaacggagtaggcgcagttaataagggcaaaaaagagcaccaccagcgtcacgttattcactaaaggaatggcaataaaaccgctagcgaaggcggtaattgccagtaacatatagcgtttcttgtcgaacttatccgccaggataccaaaaccgaggctaaaaatgacgccaatagtgagcgcaattgtcatcgcataaccgattagatcgacactcaggctgtactggcgactcaagtaaatggtcataaacggcagcgtagcgccgcgtccgatggttaataacaacgacgaggcaagaagggcgctggtagagcgtcgtagggataagttcatttgtctgtccggcagtgcgtttcgttatgttttgttttagagatgtaaaggaatagcatggcaaaaatccgaagtatagcgacttatttgcgcattaatgccgtcgtaaacggtgactaacgaatcaactgttaaagaaaagtaaattcagctaagttgattgcttacaaaagatgaaattcagaggcggtagaatgtcgcgaaaagatggggtgttggcgctactggtagtggttgtatgggggctaaattttgtggtcatcaaagtggggcttcataacatgccaccgctgatgctggccggtttgcgctttatgctggttgctttcccggccatcttttttgtcgcacgaccgaaagtaccactgaatttgctgctggggtatggattaaccatcagttttgcgcagtttgcctttctgttctgcgctattaactttggtatgcctgctggactggcctcgttggtgttacaggcacaagcgttttttactatcgtgcttggcgcgtttactttcggtgaacgactacatggcaaacaattggcggggatcgccttagcgatttttggcgtactggtgttaatcgaagatagtctgaacggtcagcatgtggcgatgctcggctttatgttgaccctggcggcagcatttagttgggcgtgtggcaacatcttcaataaaaagatcatgtcgcacgcaacgcgtccggcagtgatgtcgctggtaatctggagcgcattaatcccaatcattcccttctttgttgcctcgctgattctcgatggttccgcaaccatgattcacagtctggttactatcgatatgaccaccatcttgtctctgatgtatctggcgtttgtggcgacaattgttggttatgggatctgggggacgttactgggacgctatgaaacctggcgggttgcaccgttatcgttactggtgcctgtagttggactggcaagtgcggcactattgttggatgaacgcttaacgggtctgcaatttttcggtgcggtgctcattatgaccgggctgtatatcaatgtatttggcttgcggtggcgtaaagcggtaaaggtcagaggctaaaccatacgcacagaatgtgatgccagcactctgtgcgtctgcttttatcgcggaaaaaagtactttacctggaactcgaaaatattgctgtaaagtaacgaataatccagcggaatagagttactatccacagcctgggtctgaattttaagtatgggatcccgtgggctgatccgtaaaatactggcgatttctggggtaggaaaagtcggggagaaagtttcaaaggtgccaatgattttgatcccgcattcgttctcaatatacgaaaatttggatttttgcatatgcgatacggttaaatcaggaaaacgtgccactgacatccacgtttcttctaattgtgctgcattatcctcaatgaatcgcagtctctttatgtaataaacctgctcaccagtcactaaattcagctcagtcgcaatagtaggagaagcatcctgcacttcaaatttcataatctgacttcctgcctctttgccgcttttatgtgcaatttcactgaaactgttcatgtgatcaatgtgtgcaacaaaattctttttttgaatgtatgttcctgaaccatgctttctgtgaataattccttcgccttccagcagggataatgccttacgcagggtattacgcgaaacattataacgaacagcgagttccgcttctgacggcaacaaatcaccaacatgccatgaattgccattgatctcggatttaagtaagcgggcaatcttttgaaaaatcacttttgcaccttttaagagccattgaaaacaaggagttgagacctgattagtttatcgtatggccgagtcgtttaattatcaccctgttgttgaacaactttattgctgtattactgtgatcaatgtaccaggacgtgtagctactgtgggatatgatatttacacaatgtagtctgttatataccagtaaggaaaaatatgaaaaagatattgttagtttgcgctgcgggcatgtcaaccagtatgctggttaaacgtatgattgatcatgctaccgctatttcacttgaagttaatatttccgcattggcgattgcagaggctaaagggaaaattaaaaataacgaagttgacgttgttttacttggtccgcaagttcgctttcagaaaccagagattgaagccgttgcacaggggaaaatgcctgtagccgttatcgagatgaaagactatggcacaatgaacggacaggcagttcttgaatttgcgatgaaactactgcaagagtaataatctaatattattaaactattacctgaactaacttttcacacatcataaaatggatatggcatacatgctttattgggatgtataaatatccagaacaacaggtataaaaaaatgggattaatggcatcattcgaacgtggaatggaacgttttcttgttccagttgctatcaagttaaactcacaaaaacatgttgcagcggtgagagatggattcgtttttacgtttccaattatcatggcaagctcattaattatattaattaactttgccatattatcgcccgacggttttattgccggattactgcatctgaacagcattttccccaaccttgaaaaagcacaagctatttttactccggtaatgaatggttctgtaaatatcatgtcaattatgattgctttcctggtcgctaggaatgtggcgattagctatgagcaagatgatcttttatgcggattaacggcaataggagcattttttattgtttataccccataccagatgatagatgggcaggcattcctgacgaccaaatatctcggcgcgcaggggttgtttgttgctgttatcgttgcattgatcaccagtgaaatattttgtcgcttagctcgaaaccccaaaatcaccataacgatgccggcagctgtacctcctgcggtagcgcgttcatttaaagttttattgccaatattttttgtcatggtgttcttttccgcacttaattattgcctgacattgatatccccggcaggattaaatgatctcatttacacattaatccagacgccgctcaaacatatgggaacgaatatctttgcggtaattatcctgggggctgtgggtaatttcctctgggtgctggggatccacggacctaatacaacgtcggcaattcgagaaaccgttttttctgaggctaatctggagaatctctcctgggccgctcaacacggcactacctggggcgcgccatatccgattacctggacttctattaatgatgcattcgccaactgcggcggttcaggtatgacgttggggttattgttggctatttttatcgcttctaagcgtgcggaataccgtgatctggcaaaaatgtcatttatccccggtattttcaatatcaatgaaccgataatgttcggccttcctattgtacttaaccccatcatgatggtgccgtttattatggttcccattgttaactgtgccattggttacttctttgtttcgatggaaattattccaccggttgcttatgccgtgccctggactacgcccggacctttaattgctttcctcggaaccgggggaaactggctggcattactggttggttttttatgtttaggtgtggcgataatgatctatttaccttttgttatcgccgccaacaaagtcaataacatggcaactaacggataattccatttacccaggaaggagattgtgatgtttgcagatgaagaacttgttatggagttactgatcaacgcgggacaggctcgttctgatgcgatggaagccatacgttgtgccgggcaaaaagactggcagggcgcaactaaactaatggccagctctgaatctgcctgtcttcaggcgcataagattcagaccgcgttaattagtcaggatgaaggctgtggcaaaatagaagttaatttaattctgatacatgcacaggatcatttgatgaatgcaatattatgccaggatttagccagggaaattatttcattaagaaaagagctccatgcctgattttttctccagtgcgatatctggaggaaattactacactcttaaggataagtcatgaatataaagacgcttaacgtcagccttttgtctatttctattattacagcattgtttccgttgaacgcgatggcaacaaaattaaccatagagcagcgccttgaattgcttgaaaatgaattgtcgcaaaataaacaagagctgaaagcaacacagaatgaactgggagtatataaattccgactttcgacattacaaaaaagcatcacagaaaataaatatcaatcggcctcgcttgccgaaatatcagcgacatctcccgttgctgataacatcaaaaatgaaaacggtgaacagaactcgtttgccgcagcacatactataaatggatcgcagcaaattgccgttattgaaagtaaaggcgataaaaccactatcgaaagcgtgaccctgaaagatatcagtaaatatataaaggatgatattggattcagctatcaggggtacttccgctcaggctggggcaccggtaatcacggctcaccacaaacttatgcagcgggttctctgggacgttttggtaacaagatgagtggttggtttgacctgaccttaaatcagcgtgtttataatcaggacggtagaacggcaaatgcggtcgttacctatgatggaaacgtaggtcagcagtataacgatgcctggtttggtgacagtgccaatgaaaatatcatgcagttcagtgatatttatctgacaacgcgaggttttttacccttcgcacgagaggcagaattctgggtcggcaaacataaactcccgcaatatgagatccaaatgctggactggaaaaccttaaccacggatgttgccgcgggtgtggggattgaaaactgggcgcttggtgtagggctgtttgatatgtccttaagccgagatgatgtcgatgtttactctcgtgattttacgcgtaccagtcagatgaataccaattctgtggatgttcgttatcgcaatatcccgttatgggatgatgcgacgttgtcattaatggctaaatattccgcacctaataaaacggatcaacaacaagataatgaaaatgacgacagttattttgaaatgaaagatagctggatgctggcttctgttttacggcaaaacttgcaacgcgatacgtttaatgaatttacgttacaggttgccaataattcctatgccagcagttttgccagtttctcagatgccagtaatacgatggcgcatggtcgctattactatggtgaccataccaatgggatcgcctggcgtttaatctctcagggcgagatgtatctgactgacaatattattatggctaacgcgcttgtctattctcatggcgaagatgtttatagttatgaaagtggcgctcatagtgattttgacagtattcgcaccgtaataagaccggcctggatctggaatacatggaatcagacggggcttgaattaggctggtttaagcaacagaacaaaactcagcagggggtaacgctaaatgaatcggcttataaaacgacactctggcatgcattgaaagtgggtgaaagtattttaggttcacgaccagaaattcgcttctacgggacgtatatcaatattctggataacgaattatcgaattttaagtttaatgagaacagcaaagacgagtttatggccggcatccaggcggaagtctggtggtaatctatttagttaaggagttgtgtatgtcaggatttaaagaagattttttatggggcggtgcggtagccgcacatcaattggaaggtggctggaatgaaggaggaaaaggcatcagtatcgctgatgtaatgactgctggcgctcacggggtgccgcgtgaagtgacagaaggcgttatcgacggacttaattatcccaatcatgaagcaattgatttttatcatcgctataaaacagatattcagttatttgccgggatgggattcaaatgctttcgaacttccattgcctggacacgaatctttccgcaaggtgacgaacaggagccgaatgaagagggtttacaattttatgatgatctcttcgatgaatgcctgaagcagggaatggaacctgtggtgacgctttcgcattttgagatgccttatcatctggtgacaaaatatggtggctggcgaaaccgtaaactgatcgacttttttatccacttcgcatcaacggtcttcacgcgctataaagcaaaagtaaagtactggatgacgtttaacgaaatcaataatcaggtgaatttcagcgaaagcctgtgtccatttactaattccggtatcttgtattcgccagaggaagatctcaatgagcgcgaacaaataatgtaccaggcggtacattatgagttagttgccagtgccctggcggtacagactggaaaactgatcaatcctgaatttaatatcggctgtatgattgctatgtgccccatctatcctctgacgtgtgcacccaacgatatgatgatggccacgaaagcgatgcatcgtcgttactggtttactgatgttcatgctcgtggatattatccgcaacatatgctgaattactttgcaaggaaaggattcaacctcgatatcacaccagatgataacgcgattcttgccagaggttgtgtcgactttatcggctttagctactacatgtcttttacgacgcaattttcgccagataatccgcaactggattatgttgaaccacgagatttggtcagcaacccttatatcgatacatccgaatggggatggcaaattgatccggcagggctacgttattcactcaactggttctgggatcatttccagttgccgctgtttattgtcgaaaatggatttggtgcggttgaccagagacaagctgacggcacggtgaacgatcactatcgcattgattacttttcctcccatattcgggaaatgaaaaaagccgtagttgaagatggtgttgacttaattggctacaccccgtggggttgcattgacctggtttctgccggaacaggagaaatgaaaaaacgctacggaatgatttatgtcgataaagacaacgaagggaagggaacgctggaacggatacgtaaagcatcgttttactggtatcgggatctcatcgccaacaatggcgaaaatatatgagacttcaggaagatattacggaaatgtcaggctctgtgatcagagcctgacaataactacatagcgtgttgattataatagggcacgccgagcgcatccgacttatcactgccagtacccatgtgatttaaatcaaacggtggttgttcctgcgatgtgggaacaaccacgacattgccacaggaagtaacaaccggctgcgtggtttgttccgcaacgccctgcgcagaaaagagaataagcgcagttgctattgcggataaaagtggtttcatgattgcctcagtgacgttgtcacgttatcaactagttgttgtaatgatttaatggatgtaaaaagcgcgattcaccctgcatattggtcatccggtatttatgcggcggaacatcaaagtaatttttgaaggttcgggtcagagtttgttgggactcgaagccatatcgttccgccagatagagtatcggctcgttactttccttcagcttttgcgcgatttccgtcatcttacggctacggatgtattggcctaatgaatgaccggtttcttttttaaacatccgttgcaggtgccatttggagtaacccgaacgctctgacactttctccagtgacagtggcgattccaggttgtcctcgatccagtccaaaatgctatgaatggtaatagcgtcagtattgcgtctggacatcgtcatacctcttttttcgtttacggcaggactttcttaagcaaatgctcaagtgttgccacttcgtccgccgtcaggttttttgttaattcttgatgcaggtcctggccaactaattgatggcattgttcacatattgccgcgccgctggtggtaagttttaccagtacgccgcgcttatcattcgggttcggcaacctttccacccagcctttacagaccaggcgatccagcatacgggtcagtgcccccaggtcgaccgacaacacttttttcagttcaaccggagtaatacacgccgcgcagcggatagagcagagcaccttaaactgtgccgcggtaatatccagcggagacagatactcgttaagcaggcgatctttcttctgattaaccatatggattaagcgacccaatggaataatttcattgaacagatcgctggtatttttcacattagttgccctggcaagtaattagttgcaggggataatattgcccaggcaagtataagtcaaatgaatgaattgaccgatgccacgttttgctaaatcggttcaagttttggtcaatgcgatgcaaggttagctaaagagtgacactttatccttgtttaccccttatacttttcgctgataaaccagatacacaggataacaaccaccaatgttagatttgtttaaagcaataggcctggggctggtggtgttactgccgttagctaacccattgacaactgtcgcgttatttcttggcctggcaggcaacatgagcagtgccgaacgtaatcgtcagtcgttgatggcctcggtgtacgtatttgccatcatgatggtggcgtattacgccgggcaactggtgatggatacatttggcatttcgattcccggtctgcgaattgcaggcggcttaatcgtcgcgtttatcggttttcggatgctctttccgcaacagaaagcgattgattcaccggaagcgaaaagcaagtcggaagagctggaagatgaacccagtgccaatattgcttttgtaccactggcaatgccaagtaccgccggtccgggaaccattgcgatgattattagctcggcctccacagtgcgtcagagttcaaccttcgctgattgggtactgatggttgcgccgccgctgatctttttcctggtggcggttattttgtggggaagtctacgcagctctggcgcaattatgcggctggtgggcaaggggggtattgaagcgatctcccgtctgatgggattcctgctggtatgtatgggcgtgcagtttattattaacggcatcctggaaatcattaaaacgtatcattaaaaaaggcccgaatgggcctttcgactattgtgtctgttcttcgagtgtcactggccagcggcgaaaaatgatgattgaccatattaacgcagcaaaagcaggcaccgcgcccacataaccaatcatcgacattgaccagtgcagactcacctgattacctaccaacgcacccgcgccgattccaatattaaatatcccggagaatagcgccatcgcgacgtcggtggcatctggtgccagcgccagcactttaacctgcataccaagcccgatgatcatcatcgcgatcccccagaaaatactcagcaccccgaggtgtatttcactgttcgccgcaggtagcagcagcgccaggcacaccagcaatagcgcaatcgctgtactcaccaacgcagacgcatactgattacccagtttaccgaaaatcacgctgccaataatgcccgcaccaccgagtaataacagtaatgccgtggcaaagttggcgctgaatcccgcaatgttttgtacaaaaggctcgatatagctgtatgccgtgtaatgggcggtgacaaccaccacagttaacaaataaatgctcatcaatgccgggcggcggaacaatagcgggaggcttttcaatgaaccggaatgctcactgggcagcaagggaagtaacttaatcaggcacaaaagggtaataagcgccccgataccaatcgcgaagaaggtcattcgccagccaaaatactgccccacaatgcgcccgagaggtaaacctaataccattgccagtgctgtaccggtggcaattaaactcaatgcctgtgctcgcttcccggccggagccatacggatcgccagagacgccgtaatagaccagaaaatcgcatgtgcaaaagccacaccaatacgactgatcaccagaacggtaaaactccacgataaaaacgacagtacgtggctggcaataaacaccacaaacaggcagatcagtaatttgcggcgttcaacctggctggtcattaacataaaaggcaatgacattagcgccactacccatgcataaattgtcaacatgatgccgacctgagcggtttgcatgtgaaaactatgcgcaatgtcagagagcaggccaacagggacaaattcggtggtattgaagataaaggcggcgactgccagcgtaacgacccgtagccacgctactttgcgggaaacagtgtttgttgtcataacagattatcgggtgagttgcgaaaaagtgatgaaatgatcttaaaacggttaatgatgtgaatacaatgcatttgtgatctggatcgcatttccatctctctgacggttgttctgtcacgcatcagagagttgttaacatcacattttaatgacgatcaggaagggggcctgttcttcttttacttgaggtgcaatattacgaacgggaaaatcatcaggaagagatatgtaattgctgatgcttactggcgtaaccatatttgccccatatagtcataagtcatcggaacatcactatatagagcatattagccgcatgaactatcaaaaatagctcattggtaaccctgttttgccgagtcaggcgcatccagcagttgaataaatgcctcaagcggacgcgttttcgcaccacgacgccagaccagccaggttgttaaccaacgccattgctcagctaacggccacgcttcaacctggtgatgccccggcatactttccagcatagagcgtggaataagcgcaatgcctgctcctgcgaccacacaggccaacatcccgtgataagactccatctcgtgaatagttcccggagcggcaccgtcagcatgaaaccagctttcgaagtggcgacgatacgaacaattggcgcggaaggcataaatgttactgccattcacctgactggcacgggttactggcgcatgtccttgtggcgtgacgatcatcagttcctcgcggtataccggtatcccgtcaatggcagtatggttaatgggcccatcaataaacgccgcattcagttttccctccagcacaccttccagcatagtgccggaagggccggtggaaagtgaaaactgaattttgggataacgacggttaaattccgccagcgtggccggaatgcgcactgcagcggtgctttccagcgatcccagagaaaataaaccttgcggctcatcgccagcgacaacgctccgcgcttcatccactaacgtgagaatttgttggctatagcgtaaaaagttatgcccggcaggcgagagacgtaaacgctgattctcgcgaataaacagatcaacccccagttctgtttccagctggcgtagacgggtagtgagattcgacggcacgcgatgcacttttgctgcagcctgggtaatgctgccagcttcggcaaccgcgttgaacatctccagttgggtcagatccatagcattctcgattcgtgaataagtggcttaatattattcattttaaagcaagagtaaatctgcgtatcttcataccatgactcataaaggagataccccgatgaccattactccggcaactcatgcaatttcgataaatcctgccaccggtgaacaactttctgtgctgccgtgggctggtgttgacgatatcgaaaacgcgcttcagctggcggcagcaggctttcgcgactggcgcgagacaaatatagattatcgtgctgaaaaactgcgtgatatcggtaaggctctgcgcgcccgtagcgaagaaatggcgcaaatgatcacccgtgaaatgggcaaaccaatcaaccaggcgcgcgctgaagtggcgaaatcggcgaatttgtgtgactggtatgcagaacatggtccggcaatgctgaaggcagaacctacgctggtggaaaatcagcaggcggttattgagtatcgaccgttggggacgattctggcgattatgccgtggaattttccgttatggcaggtgatgcgtggcgctgttcccatcattcttgctggtaacggctacttacttaaacatgcgccgaatgtgatgggctgtgcacagctcattgcccaggtgtttaaagatgcgggtatcccacaaggcgtatatggctggctgaatgccgacaacgacggtgtcagtctgatgattaaagactcgcgcattgctgctgtcacagtgaccggaagtgttcgtgctggagcggctattggcgcacaggctggagcggcactgaaaaaatgcgtactggaactgggtggttcggatccgtttattgtgcttaacgatgccgatctggaactggcggtgaaagcggcggtagccggacgttatcagaataccggacaggtttgtgcagcggcaaaacgctttatcatcgaagagggaattgcttcggcatttaccgaacgttttgtggcagctgcggcagccttgaaaatgggcgatccccgtgatgaagagaacgctctcggaccaatggctcgttttgatttacgtgatgagctgcatcatcaggtggaaaaaacactggcgcagggtgcgcgtttgttactgggaggggaaaagattgctggggcaggtaactactatccgccaacggttctggcgaatgttaccccagaaatgaccgcgtttcgggaagaaatgtttggccccgttgcggcaatcaccattgcgaaagatgcagaacatgcgctggaactggctaatgatagtgagttcggcctttcagcgaccattttcaccaccgacgaaacacaggccagacagatggcggcacgtctggaatgcggtggggtgtttatcaatggttattgtgccagcgatgcgcgagtcgcctttggtggcgtgaagaagagtggctttgggcgtgagctttcccattttggcttacacgaattctgtaatatccagacggtgtggaaagaccggaactgacgctacatattcagctctgatatactcgcaggtcttttcagacctgcggtccaggagtagaaagtggcagtcgccatggataatgcaattttagaaaacatcttgcggcaagtgcggccgctcattggtcagggtaaagtcgcggattatattccggcgctggctacggtagacggttcccgattggggattgctatctgtaccgttgacggacagctttttcaggccggagacgcgcaagaacgtttttccattcagtctatttccaaagtgctgagtctcgttgtcgccatgcgtcattactccgaagaggaaatctggcaacgcgtcggcaaagatccgtctggatcaccgttcaattctttagtgcaactggaaatggagcagggtattccgcgtaatccgtttattaatgccggtgcgctggtggtctgcgatatgttgcaagggcgattaagcgctcctcggcaacgtatgctggaagtcgtgcgcggcttaagtggtgtgtctgatatttcctacgatacggtggtagcgcgttccgaatttgaacattccgcgcgaaatgcggctatcgcatggctgatgaagtcgtttggcaatttccatcatgacgtgacaaccgttctgcaaaactactttcattactgcgctctgaaaatgagctgtgtagagctggcccggacgtttgtctttctggcgaatcaggggaaagctattcatattgatgaacctgtggtgacgccaatgcaggcgcggcaaattaacgcgctgatggcgaccagcggtatgtaccagaacgcgggggagtttgcctggcgggtgggactaccggcaaaatctggcgttggtggcggtattgtggcgattgttccgcatgaaatggccatcgctgtctggagtccggaactggatgatgccggtaactcgcttgcgggcattgcagtccttgaacaattgacgaaacaattagggcgttcagtttattaatgcagtctctcgatccactcttcgcgcgtttatcccgttcaaaatttcgctctcgctttcgtttgggtgtgaaagagcgtcagtattgtctggagaaaggcgcgccagtcattgaacaacatgcggcggattttgtcgctaaacgtcttgctccggcattaccggctaacgacggtaagcaaacccccatgcgcgggcatccggtttttatcgctcaacacgccaccgcgacctgttgtcgcggttgtctggctaagtggcataacattcctcagggggaagcgttaagtgaggagcaacaacgttatattgtgacggtaatctaccactggctggttatacagatgaatcagccatgataattacggaaatcgataaaatggcattcattaggtatctttagttgccgccgttgtcagcgaacatgctatcctttctaagaatttacttattgcgttgagataattgccacccgcaattgtatggacagataattaatgcatgtacagcccatttcaactttccgtttgttccaggaaggtcatctgctacgtaatagcatcgctatttttgtgctaaccacgctgttctattttattggtgcagagttacgactggttcacgaactttctcttttctggccgctgaatggcgtaatggcgggggtgtttgcccgctatgtctggcttaatcgactgcattactatgcgatcagttatgtggcgatgctggtttatgatgccataaccaccgaatgggggctggtttcactggctatcaatttctccaatatgatgtttattgttaccgtcgccttactggtcgcgcgggataagagtctgggaaaaaataagtatgagccagtaagtgccttacggctatttaattactgtctgcttgccgcattattatgcgctattgtcggggcgattggttcggtcagtattgatagtctggatttctggcctttgcttgccgactggtttagtgagcaattctcaacgggcgtgttgatcgtgccttgtatgctgacgttggcaattcctggagtgctgccgcgctttaaagcagagcagatgatgcctgctatcgcgcttattgtgtcggttattgcctcggtagtcattggtggagcggggagtctggcgtttccgctccctgcattaatctggtgtgcagtgcgctatacgccgcaggtaacatgtctgttgacctttgtcaccggtgcggtggaagtcgtactggtggcaaattcggtgattgatatctcggtcggttcgccgttctctattccgcaaatgttctccgcacgtctcggtattgccacgatggcgatatgcccaattatggtttcctttagcgtggcagcgatccattcgctaatgaagcaagttgcgctgcgagccgactttgattttctgactcaggtttactcacggtctggtctttatgaggcgctgaaaagtccatcgctgaaacagacacaacatctgacggtcatgctgcttgatatcgactatttcaaaagcattaacgataactatggacatgaatgtggcgataaagtgttaagcgtgtttgcccagcatattcagaagattgtcggtgataaggggctggtggcgcgaatgggcggcgaagaatttgctgttgcagtgccgtcggtgaatcctgtcgatggcctgctaatggcggaaaaaatccgtaaaggcgtagaacttcaaccgttcacctggcaacaaaaaacgctttatctcacggtaagtattggcgtcggtagtggttgcgcatcgtaccgaacgctgaccgatgactttaataaattgatggtcgaagccgatacgtgtctgtatcgctcgaagaaagatgggcgcaaccgtaccagcactatgcgttacggtgaggaagttgtctgacatctttatttactcagagcgaattaaatgcaatatgttctaccactttatgatccaagaaaaggcctgtttcctcgattaaaccatgatccgcgccacacttttctcataaaactgctcattaatcatcaggagttgatcaaaacaggggttcggcgtattaaagtttgctaacctgtcgtaccaattcaaacaggttgtatgactaatcagaagggaacccattgtgaaaacactaaatcgtcgcgattttcccggtgcacagtatccagaacgtatcattcagtttggtgaaggtaacttcctgcgcgcctttgttgactggcaaatcgatctcctgaatgagcacaccgatctgaattctggcgtggtcgttgttcgtccgattgaaacttcattcccgccgtcactgagcacgcaggatggtctttataccaccattatccgtggcctgaatgagaagggtgaagcggtcagcgacgcgcgcctgattcgctcggttaatcgtgaaatcagcgtctacagtgaatacgatgaattcctgaaactggctcacaatccggaaatgcgctttgttttctctaacaccaccgaagcgggtatcagctaccatgcgggcgataaattcgatgacgcgccagcggtaagttatccggcaaaactgacccgtctgctgttcgaacgttttagccatttcaacggtgcgctggataaaggttggatcatcatcccgtgtgagttgattgactataatggcgacgcgttgcgtgaactggtgctgcgctatgcgcaagagtgggcactgccagaagcatttattcaatggctggatcaggctaacagcttctgttctacgctggtggaccgtatcgttaccggttatccgcgtgatgaagtggctaaactggaagaagaactgggctaccacgatggtttcctcgacaccgctgaacacttttacctgtttgtgattcaggggccgaaatccttagcgactgaacttcgtctggacaaatatccgctcaacgtgctgatcgttgacgatattaaaccgtataaagaacgcaaagtggcaatcctcaacggtgcgcacaccgcgctggtgccggtggcgttccaggcagggctggataccgtaggtgaagcgatgaacgatgctgaaatttgcgcattcgttgaaaaagccatctacgaagaaattattccggtactggatttgccacgcgatgagctggagtctttcgccagtgcagtcaccggacgtttccgtaacccgtacatcaagcatcaactgctgtctatcgcgctcaacggtatgaccaagttccgcacacgcatcctgccgcagctgctggcagggcagaaggcaaacggcacacttccggcgcgccttactttcgcattagcggcattgattgcgttctatcgcggtgagcgtaatggagaaacatatccggtacaggacgatgcacactggctggaacgttatcagcaactctggagccagtatcgtgaccgtgttatcgggacccaggaactggtagcgattgtgttggcagaaaaagaccactgggagcaggacctgacgcaagtgcctggtctggtcgagcaggttgctaatgacctggatgcgattctcgaaaaagggatgcgcgaagctgtacgcccgttgtgctaatactctgaacccggtttcgaccgggtttcttatttcgctatattagttacaacattctatgtgcctttatcattaacaggtgccacatgcagcacctgttaatgttgtaagcttgtaggtaatttgtaagtagcgtcttgagaatgtgatcgtaatcacgtttaatagggcgacttttccacgcctgaagataaccatgattgttcgtccacaacaacactggctgcgccgtatttttgtctggcacggttcagtattatccaagatatcctcgcgcttactactcaattttctcttttctatcgctgttattttcatgctgccctggtacacgcatttgggcattaaattcaccctcgcaccgttcagcattctcggtgtcgccatcgccatttttcttggttttcgtaataatgccgggtacgcccgttacgttgaagcgcgaaaactttgggggcagttgatgattgcctcacggtcgttactgcgcgaggtaaaaacgacattgccagattcggcaagtgtaagggagtttgcccggctgcaaatcgccttcgctcactgtttacgcatgacattacgcaaacaaccacaggcggaagtgctggctcaatatctcaagacggaagatcttcagcgtgtactggcttcgaactctccagctaaccgtatcttgttaataatgggggagtggttggcggttcagcgccgcaatgggcagctttcagatatcctgtttattagcctcaacgatcggcttaatgatatttcagcagttctggcaggctgcgagcgcattgcctacacgccaattccctttgcctacaccctgattttgcatcgtaccgtttatctgttttgtatcatgctgccgttcgcgctggtcgtggatctgcattacatgacgccttttatctctgtgctgatttcctacacttttatttcgctggattgtctggcggaagaactggaagatcccttcggtactgaaaacaatgatttaccgctggatgccatctgcaacgctattgaaattgacctgttacagatgaacgatgaagcagaaattccagcgaaaattcttcccgatcgccattaccagctgacgtgataattactccgtacggcgggcaacaataaacagacgcggaaatgccagcaatatctgtccgttctcctggaggggatattgctcttccagcatctgatggtagcgcgtaagaaaatgctgctgttcgctctcggtcagatcctgtaaccacggacgtaatccagtggcggtcacccaatcgataatcgcctggtgcgacggcatctggtgatagtaagtggttcgccagatatcgacctcacatccggcttcactcagaatatcgtagtaagcatgaacgccagccagcggctcacgcccgcgatccgggtagttttgttcccaggcaacttcgcgcatgagcacatgggtcggctccagccagttatctggcatctgtactgccagcacgcccagcggactgagtaacgaaaccaaatgaggaaacaattcgtagtggtcgggcagccattgcagcgaggcattagcaaaaatcagatcgagtgcctgttccggttgccagttgcggatatctgcttccacaaacaggcagtctggcaaagcactgcgcgcttcagcaatcatcgccggagatgagtcgatgcccgttatcctggcagcaggccaacgttggtgtagaagggcggtgctgttacctgggccacagccaagatcggcaatgtattcgatattctccagcgacaccctggcaagcagctccaccgccggacgcgatcgttcagcggcaaagtgtagatataaagaggggttccagtcagacatttttttactcccgtcagcgcgttaccccaattgtagataaaactgataaattcgcctcacggcatcaccccattgaacagacgttttttacgcggccaggtcattaagattacagattccggtagtcaaagaagccaccgcattaggatgtgcttttttaaatcctcctttttatccgcgatcgcggatatcgcagcgtttatcccgtagagcggataggatgtgtttccagattgactttatcctcactaaaggataaaactgataatatccccttaagcggataaatttgctgtggacgtatgacatgatgagctttcagaagatctatagcccaatgcaattggcgaatgcaatgaaactggttcgccagcaaaacggctggacgcagagcgagttggcgaaaaaaatcggcattaagcaggcgacaatttccaatttcgaaaacaatcctaacaatacctcgctcacgacattttttaagattttacagtcgcttgaactctcaatgacgctatgcgacgcaaaaaatgcctcgccagaagcaacagaacagcaagatctggagtggtgatgcctaaactagtcacttggatgaacaaccagcgggtaggcgagttaacgaagttagccaacggcgcgcacacctttaagtatgcacctgagtggttagccagccgttatgccagaccgttgtcactttcgctgccattgcagaggaggaatatcacctctgatgccgtatttaacttcttcgataacctgttacccgatagcccgattgtacgtgaccggatcgttaaacgttatcatgctaaatccagacaaccgtttgatttattgtcagaaatagggcgagacagcgttggtgccgtgacgttaatccccgaagatgaaaccgtaatgtgtccgataatggcatgggaaaagcttactgaagccagacttgaagaagtattaacggcttataaagcagatatcccgttaggcatgattagagaagaaaatgactttcgcatctcggttgctggcgcacaggagaagactgcgctgctcagaataggcaatgactggtgcattccgaagggaataacgccaacgacgcacattatcaaattgccgattggcgaaatcagacagcccaatgcgacgctcgatcttagccaaagcgttgataatgagtattactgtttgctgctggcgaaagaactcgggttgaatgttccggacgcagaaatcattaaagcgggaagggtgcgcgcgttagcggtcaaacgttttgacaggcgttggaatactgagcgaacggttttacttcgcttgccacaggaggatatgtgccagacattcggtttaccttcatcggtgaaatatgaatcagatggaggccccggtatcgcgcaaattatggcttttttgatggggtccagcgaggcgctgaaagatcgctatgattttatgaagtttcaggtcttccagtggttgattggcgcaacagatggccatgcaaaaaacttctccgtatttattcaggctggcggcagttatcggctcacaccattttatgacatcatttcggcatttccggtccttggcggtacgggaatacacatcagcgatctcaaactggcaatggggcttaacgcatccaaaggcaaaaaaacggcaatcgataaaatttatccgcgacattttctggcgacagcaaaggtgctgaaattcccggaagtgcagatgcatgaaatcctgagtgactttgccagaatgattccggcagcactggataacgtgaagacttcattaccgacagattttccggagaacgtggtgacggcagttgaaaccaatgtgttgaggttgcacggtcggttaagccgagaatacggtattaagtaagatatggggttttggtcgttgttaatgagcagaacaatcatgaaccgccaacgactggattctcccttggtttatgttggtgcgcataatgtatattatgttaaattgcctgtgaaggtcctttacttcaccattcacatccacacacagataaatcaatacgttgtgatttctgacttccctcccgtttcggtagaaaaattcaacctctgttcagtgatggcacaccatagaccatgagttggataattgcgttgtttacagcagccagcgctttgatggcactatatccctcacgcttctgaatatgtttgggtgtgcgtgggttttccagtagtactcgtagccctggcgatataacgcaaaaggtaatttagcgatctgttcatcagtcaggttggcatcaccggagtaaagcacttcgctaccggcgacttcctgagctcgtgcatctgaagcctgcttaagacgttgttgaatagatttccttgtagaagcattcccttcaaagcgcattcatgaagggtgttcatagacacaatcattttagcctcgttactggcaataatgataattgatattctggctgtatcaaaaataaggctgaattatcagaaggtttatcatgagaatactcgttgctggcgcaacaggaagtattggtattcatgttgtgaatactgctattgcaatgggccatcagcccgtgactctggtcaggaatcggcggaaaatcaagttactccctcgtggaacagatattttctatggcgatgtttcaatacctgaaacacttaccgatttaccgaaagatattgatgccatcatttttacactcggctctgatggtcagggacgtattggcgccagagcaatagattacggcggtgtacgtaacattttgcgaatattcatggatacacctgttcgcatcgccctgatgacaacgattggcgtaactgagcggctcagtagctggaatcaacgtactgaagttcatgactggaagagacgctctgaacgcctggtcagagccagtgggcatatctacactatcgtcagacccggctggtttgattacaacaatgatgatgagcacagaatcgtcatgcttcagggggacagacgccatgcgggaacgccggaagatggtgttatctcccgggagcaaatcgcccaggttcttgtaacagctctgagcaacgatgcggcaaaaaataaaacgttcgaactggtcgcagagcgaggagaagcacagcaggatctcactcctctgtttgcagagctgcggaatgataatccacaaaaaaatgatggggttttcgatatagacaatatgccccttactgaagaacctgagtgcgttattaacgacctgaatctgtattcgaaaaattcaaaaatctaacaacgttgtcatatgacagtcagtcttatgacagcttagaactgtatatttacagatcaagaaggaggaagctatttccgatattcgtcaactttcaaatatatcgtttaaaacaggtatcagatatgaaagcactactaattactgcattattcatggaattcatttcggtaaatactgcatctgctgctgaggagattcatcatgcagatagcaaagtcgacgatcaggtcctcatagctgagtaaaaagatggccagagttgactgctcgaggatgatatccgcgtttggtcatgtagtagccaggatagtccacgaggaactgtgctgcatcatccttcagtttatgattcaaagagagttacagcaatttggtgttagtttcaccaggcaaatattaatcatagctaatgtttatagccatataaactattagtacctcttgacctttcctgacacttcccttgttcgcaataatattctgtttagtcgctgtttataaataacatgcataatgaaatcgtcatgttatttagcgacataaaatgtttttacaaatactctctacaacaagtgcagcaataaacttgttgtgaataggtgtccttgtaatttaaagatattatcattcttcgtgaaatgtaataaccatggaaactatattctcagggcaacatccaatcaagaatgattcttgttttataagcaataacagaataacttaattgttaactctctttattcagctacttaaatataaattttggagaattatgaaactcaaacatgtcggtattattgtcgtttctgtgttggcgatgtcgtctgctgcggtaagcgcagccgagggtgatgaatcagtaacgaccactgttaatggcggtgtaattcattttaaaggtgaagtggtaaatgccgcttgtgcgattgattcagaatcaatgaaccaaacggttgagctgggtcaggttcgttcttctcgcctggctaaagcgggtgacctcagctccgccgttggcttcaatatcaagctgaatgattgtgataccaatgtttccagtaatgcagctgttgcattcctgggtactactgtcaccagtaatgacgatacattagcgctgcagagttcagcggcaggctctgcccaaaatgtcggtatccaaattttggaccgtacaggggaggtattagtacttgatggtgctacttttagcgctaaaactgacttgattgatggcacgaatatactgccgttccaggctcgttatattgctctcgggcagtcagtagctggtactgcaaacgctgatgcgaccttcaaagttcaatatctataattcactcttaaggtgactatgtgtcatctgaaattgaaacagggtgtgtgtggcatggctacgcacacccgagaaattcaccaatgttcatctcattattaatgaaaaatggtttgtattttggagcggtatgaaaaatcacataatatctaaacgatcaataaacaacagtagttaaacttgctgttatttaaaatatttacttggtagcaaggttttcctatcaaaagagaaccaacatttattacaaacgcattaagtctggaaaaccggcgactcgccaatgcattagcaatatttaccgattgtctgatgtaacggtttccccgcttatcctcttaacacatggagaatgcatcagatgcaaactacgcgtaccccctactctgtttcctttatggcgacagtgttacttttattgctctttgcttgccatagcaccattgccaacgcagctgtcgcacttggtgcgacgcgggtaatttatccggcaaaccagaaacaggttttattgcctgtcacgaataatgatcctgccagtgtctatctcattcagtcatggatagaaaatgcgggtgaccagaaagatacccagtttgtcattaccccaccgcttttttccatgcaaggtaaaaaagagaatacgcttcggataatcaacgccactaatcatcagttaccaggcgaccgtgaaagcctgttctgggttaatgttaaagctatccctgctatggaaaaagaccagaagaatgagaatacattacagctggcaattattagccgcataaaaatgttttatcgccccacgcatctggcaatggcacctgaagaagcgcctgcaatgcttcggtttcgtcgcagcggtagcaaactcactcttattaatccaacgccctacttcattaccgtaacaaatatgaaagcaggaaatagcaatctcccaaacaccatggtgccgccaaaaggtgaagtatcggtggatatcccgcatgctgtaaccggggatatcagttttcagacaatcaatgattacggtgcattaactccgcgtattaaggcaaccatgcagtaagccagtgacctaattaataataaactcaatcgggattaaaaatgacagcctttcgtgccgcatttaaggcatatcgtatgcatcaggtgttaatactgcctcgctttgcacggcttacctttgcccttggcttagcaactgcggtttttcccgttgacgcagagtattattttaatccacggtttttaagcaatgaccttgctgaatctgtcgatttatctgcctttactaagggacgcgaggccccacctggtacatatcgggtcgacatttatttgaacgacgaatttatggctagtcgggatattacttttattgcagatgataataacgcagatctcatcccatgcctgagtacagaccttcttgtcagtcttggcataaaaaaatcagcattattagacaacaaggaacattcggcagataaacatgtgccggacaacagcgcatgcacaccacttcaggatcgtttggctgatgcatcatctgagtttgatgttggtcagcaacatctgtcactctccgttccgcaaatatatgtcggcagaatggctcacggctatgtttctcctgatctgtgggaagaaggaataaatgcagggctactaaactatagttttaatggtaattctattaataaccgtagtaaccataatgcaggaaaatccaactatgcatatttgaatttacagagtggcatcaacattggtagttggcgactgcgcgataactcaacgtggagttataacagtgggagtagcaattcatctgacagcaataaatggcagcatatcaatacgtcggctgaacgtgacattattccgttacgctcacggttaacagtgggtgatagttataccgatggcgatatttttgacagtgtgaactttcgtggccttaaaataaattcaacagaagcgatgttgcccgatagccaacatggtttcgctccggtgattcatggtattgctcgtggcaccgcacaagtgagtgtaaaacagaatggatacgatgtttatcagactactgtcccacccggcccttttactattgatgatatcaactctgcggccaatggtggtaatctgcaagtaaccataaaagaggcagacggcagtattcagacattatatgttccttattcgtctgttccggttctccaacgtgctggatatacgcgttatgcacttgccatgggggaatatcgtagtggaaataacctgcaaagcacccccaagttcgtacaagcaagcttgatgcatggtctgaaaggaaactggacaccttatggcggaatgcaaattgcagaagattatcaggccttcaaccttggtattggtaaagatttaggactttttggtgccttttctttcgatattacgcaggccaatacgacacttgcagatgacacccgtcacagcggacaatcggttaaatccgtctacagcaaatccttctaccagacgggaaccaatatccaggtcgcaggatatcgctattctacgcaaggtttttataacttatccgacagtgcatacagtcgaatgagtggttacaccgtcaagcctcctaccggagacaccagtgagcagacactatttattgattattttaatctgttctacagtaagcgtggtcaggaacaaataagcatctctcagcagcttggaaattatggtacgacatttttcagtgccagtcgccaaagttactggaacacgtcacgcagcgaccagcaaatatcatttggattaaatgtgccgtttggtgatattacgacttcgctgaattacagctattccaataatatatggcaaaacgatcgggatcatttactcgcttttacgcttaatgttccctttagtcattggatgcgtacagacagtcagtcggcatttcataattcaaacgccagttacagtatgtcaaacgatttgaaaggcggcatgaccaacctatcaggggtttatggcactctgctaccggataataacctgaattatagtgttcaggtcggtaacacccaagggggtaatacatcgtctggcaccagtggttacagttctcttaattatcgtggtgcttacggtaatacgaatgtcggttacagtcggagtggtgacagcagccagatttattacggaatgagtggtgggattattgctcatgctgatggcatcacctttggacagccgctgggcgacacaatggttctggttaaggctcctggcgctgataatgtcaaaatagagaaccagaccggaattcataccgactggcgtggctatgccatattaccatttgcgacagaatatagagaaaatcgtgtcgctcttaacgcgaattcccttgcagataatgttgaactggatgaaaccgtagtcactgtcatcccaactcacggtgctattgccagagcaacatttaatgcacaaatcggcgggaaagtattaatgacgttgaagtacggtaataaaagcgttccattcggtgcaattgtcactcacggagagaataaaaatggcagcattgtcgcggaaaatggtcaggtttatctgactggacttccacagtcagggaaattacaggtttcatggggcaaagataaaaactcaaactgtattgtcgattacaagcttcctgtagtctctcctggaaccttgctgaaccagcagacagcaatctgtcgctaaggaacaatagattatgaaatacaataacattattttcctcggtttatgtctggggttaaccacctattctgctttatccgcagatagtgttattaaaattagcgggcgcgtcctcgattatggctgcacagtctcatcggattcgcttaattttaccgtagatctccaaaaaaacagtgccagacaatttccaacgaccggtagcacaagtccagtcgtcccttttcagattacattaagtgaatgcagcaaagggacaacgggagttcgggttgcatttaacggtattgaggatgcagaaaataatactctgttgaaactagatgaaggaagcaatacggcctccggtttgggtatagaaatactggacggaaatatgcgtccggtgaaattgaatgaccttcatgctgggatgcagtggatcccattggtaccagaacagaacaatattttgccttactccgctcgtttgaagtcaactcagaagtccgtcaatccaggactggtgagcgcttcggcaacctttacccttgaatttcaataatcagagtcagatatgaaaagacttcacaagaggttcctgttagctacgttttgcacattattcacagcaactctccaggccgccgatgtcactatcactgttaatggtcgggtagtcgctaaaccatgcactattcaaaccaaagaagctaacgttaatctcggggatctttatacacgcaatctgcaacaacctggttctgcatctggctggcacaatattactttgtcattaaccgattgtccgattgaaacaagtgcagtgacggcaatcgtgacaggttcaactgacaatacgggttattacaaaaatgaaggtactgccgaaaatattcagatagagctaagggatgaccaggatgcgacgttaaaaaatggcgatagcaaaacggttattgttgatgtgatcactcgtaatgcacagtttccacttaaggcaagagctatcacggtgaatggaaacgcaagccagggtacgatcgaggcgctaatcaatgtgatctatacctggcaataacatcaatttgattttattttcctcctttttaaatcaattttttaaccttaggatatatcatgggtaaaacattcagtataaaggtcctgttcggtatttatcttctattaatggcaggcaaagtttttgccttcagttgtaatgtcgatggcgggtcaagtattgggagcaggtacaacctctgtttatgttaatctcgatcctgtaatacaaccgggccagaatctggttgtagacttgtctcagcatataagttgttggaatgattacggcggctggtacgacactgatcatataaacctggtacaaggttcagctttcgcaggctccctacagtcatataaaggatcactgtactggaataatgtgacctaccctttcccgttgacgacaaataccaacgtattggatattggtgataagacaccgatgccattaccgttaaaactctatattaccccagtcggagcggccggtggagttgtcataaaagcaggggaagttattgcccgtattcatatgtataaaattgccacgttaggaagcggaaatccgcgtaattttacgtggaatattatttcaaataacagtgttgttatgccaacaggcggttgcaccgttgatagtcgtaatgtcaccgtgaatctcccggactttcctggaagcgcagaaataccccttggtgtatattgctctagcgaacaaaagctctcattttatctttcgggtgccaccactgacagtgcccgacaagtgtttgctaacgcagcaccagatgcaacaaaagcatcgggcgtgggtgtctctctgatacgtaatggaaaaatactggcaaccggagaaaatgtctccctggggacagtaaataaaagcaaagtacctctgggtttaagcgcaacctatggacaaacaggaaacaaggttgcagccggagccgtccagtcagtcattggtgtcacttttatctatgaataattgtgattttgacattagtctatgcgctccattcacgaaaattgcgcggataattattttgtgaaggctattatcctacacttgtaagaaaatccgcgcacaattgaagccagagtcttattttttatattgagaatcatgttaatttaaaccctatgagagatgatgcttaacttatcgtatttatactactctattatttaacgataatagagtaaaaatagtaagagagtagtcccctactcttatatattcatgttgacgataaatcctttgtatatactttgcatcatcgctattacaaatcctaataattcatttccacacaggataagcagatgaagaaaaaaattgaatcctaccagggagctgccggtggttggggtgctgttaaatccgtagcgaatgcagtacgtaagcagatggatatacgccaggatgttattgccatgtttgacatgaataagccagagggctttgactgtccgggatgtgcatggccagatcctaagcacagtgcgtcattcgacatttgtgaaaacggcgcaaaagcaatcgcctgggaagtcacggataagcaggtaaatgcctctttctttgctgagaatacggttcaatcattacttacctggggagatcacgagcttgaggctgcgggacgtctcactcagcctttgaaatatgatgacgtcagcgactgttacaagccattaagctggcaacaagctttcgacgaaattggcgctcgccttcaaagctatagtgatcccaatcaggttgaattctatacttcggggcgcacttccaatgaagctgcctttctttatcagctttttgcccgtgaatacgggagcaataactttcccgactgctccaacatgtgccatgaaccgaccagtgtgggattggcagcgagtatcggtgtgggtaaagggaccgtgttgctggaagactttgagaaatgcgatttagtcatttgcattgggcataaccctggtacaaaccaccctcgcatgctgacttcgttgcgcgctttagtgaaacggggagcgaaaatgatcgccatcaatcctctacaggaacgtggcctggagcgatttaccgcaccgcaaaacccgtttgaaatgctgacgaactctgagactcagttggccagtgcctactataacgtgcgcattggtggcgatatggcattgctcaaggggatgatgcgcctgttaattgagcgcgatgatgctgcaagcgccgcaggtcggccctcattgctggatgacgaatttattcaaacgcataccgtcggctttgacgagctacgccgtgacgtgctcaattccgagtggaaagatatcgaacgtatttctggactaagtcagacacaaatcgccgaacttgctgatgcatatgccgctgccgaacgaaccattatctgttacggaatggggatcactcagcacgaacatggtacccagaacgtacagcaactggtcaatctgctgttgatgaaaggtaacattggcaagcctggtgcgggtatctgcccactacgaggtcactctaatgtacagggcgaccgaaccgtcggtatcaccgagaaaccgtctgcagagtttctggatcgcctgtgtgagcgctatggcttcaccccacctcatgcacctggacatgctgcaatcgccagcatgcaagctatatgtacggggcaagctcgagcattgatctgcatggggggcaactttgcactggcaatgccagatcgggaagcgagcgctgtaccgttaacgcaattagatctggcggtacacgtagccactaagcttaaccgctctcatctgctgaccgcacggcatagctatattctgccggttctgggacgtagcgagattgacatgcaaaaaagcggtgcgcaggcggtaaccgttgaagattcaatgtcgatgattcatgcctcgcgtggtgtgttaaaacccgccggtgtaatgctgaaatcagagtgtgcagtggtcgcgggaatcgcgcaagcagcactaccccagagcgtggtagcctgggagtatctggtggaagattatgatcgcattcgcaatgacattgaagctgtgctgccagagtttgccgactataaccagcgcatccgtcatcctggtggttttcacctgataaacgcagcagctgaaaggcgctggatgacgtcgtcaggtaaggctaatttcattaccagtaaagggctgttagaagatccctcttcagcgtttaacagtaagctggtcatggcgacagtacgcagtcacgatcagtacaacacgacgatttatggtatggatgatcgctatcgaggggtattcggtcaacgagatgtggtctttatgagtgctaaacaagctaaaatttgccgtgtaaaaaacggcgaaagagttaatcttattgcactcacgccagacggtaaacgtagctcacgccgcatggatagattaaaagtggtcatttaccctatggctgaccgctcactggtgacctattttccagaatcgaatcacatgctaacacttgataaccacgatccattaagtggcattcctggctataaaagtattccggttgaattagaaccatcaaattaattcgcctcctcatttcttctgctgtcatccgcacagcagaagaattcctcattgactattatcgcgcgatttgctcacatggattaaattaaaccacacactataagatataaacttctgcctacagctgtaagaaactccgctcagtactgaagtgccagtcctatttcctcttttatccagcctgttatattaatcatactgattaacgatttttaacgttatccgctaaataaacacatttgaaatgcatgcgaccacagtgaaaaacaaaatcacgcaaagagacaactataaagaaatcatgtctgtaattgtggttgtcttgttactgacacttacgttgatagccattttttcggcaattgatcagctgggcatttcagaaatgggtcgcatggcaagagatcttacacatttcattatcaatagtttgctagactgaaaataaacagcaaattataaatgtgaaatgttaaaaaagtatcgatataaactttattgttttaaggagataaaatgtcgctcgtttgttctattatatttattcatcatgccttcaacgctaacattttagataaagattacgccttctctgacggcgagatcctaatggtagataacgctgttcgtacgcattttgaaccttatgagcggcatttcaaagaaatcggatttaatgaaaataccattaaaaaatatctacaatgcactaacatccagacagtgacgatgcctgttcctgcgaagtttttacgtgcttcaaatgtaccgactggattgcttaatgaaatgattgcttatctcaactcggaagaacgcaatcatcataatttttcagagcttttgcttttttcttgcctgtctatttttgccgcatgcaaaggtttcattacactattaactaacggtgtgctatccgtttccgggaaagtgagaaatattgtcaacatgaagctggcgcacccatggaagctgaaagatatttgtgactgcctgtacatcagtgaaagcctgttgaagaaaaaactaaagcaagagcaaacgacattctcacagattcttttagatgccagaatgcagcacgcaaaaaatttgatacgcgtagaaggttcagtcaataaaattgccgaacaatgtggttatgcgagtacatcttattttatttatgcgttccgcaaacatttcggcaacagtccaaagagagtttctaaggagtaccgttgtcaaaggcacacgggtatgaacacggacaacacgatgaatgctttagctatttgattatttgctaacgagtagtcaaccacacacgctgcgtaagaattaaatggggcagccattccctgccccgcgttgtttttaggcgatatatttcttgaaataaataagtgacagtcatcacatatttatgcatttgcataacctgttgcatgattatttatgatctcagttcggcattttggcagtaaaatacaataatttattaaatatcaatagattagttgtttatcggcgagaaattacttagtagaacagaaagtaatgtcaatgcgttatggactgttatttccctttttttagctaaatttgctatctatttatgtgactaacttcacttacattaacttatttctcttcgtaaaattactttggaattaagtacaataagaagaggaacatttatgaagtctgcattaaagaaaagtgtcgtaagtacctcgatatctttgatactggcatctggtatggctgcatttgctgctcatgcggcagatgatgtaaagctgaaagcaaccaaaacaaacgttgctttctcagactttacgccgactgaatacagtaccaaaggaaagccaaatattatcgtactgaccatggatgatcttggttatggacaacttccttttgataagggatcttttgacccaaaaacaatggaaaatcgtgaagttgtcgatacctacaaaatagggatagataaagccattgaagctgcgcaaaaatcaacgccgacgctcctttcattaatggatgaaggcgtacgttttactaacggctatgtggcgcacggtgtttccggcccgtcccgcgccgcaataatgaccggtcgagcgcccgcccgctttggtgtctattccaatactgatgctcaggatggtattccgctaacagaaactttcttgcctgaattattccagaatcatggttattacactgcagcagtaggtaaatggcacttgtcaaaaatcagtaatgtgccagtgccggaagataaacaaacgcgtgactatcatgacaacttcactaccttttctgcggaagaatggcaaccgcaaaaccgtggctttgattactttatgggattccatgctgcgggaacggcatattacaactccccttcactgttcaaaaaccgtgaacgcgtccccgcaaaaggttatatcagcgatcagttaaccgatgaggcaattggcgttgttgatcgtgccaaaacacttgaccagccttttatgctttacctggcttataatgctccgcatctgccaaatgataatcctgctccggagcaatatcagaagcaatttaataccggcagtcaaacagcagataattactacgcttccgtttattctgttgatcagggtgtaaaacgcattctcgaacaactgaagaaaaacggacagtatgacaatacaattattctctttacctccgataatggtgcagttatcgatggtcctctgccgctgaacggggcgcaaaaaggctataagagtcagacctatcctggcggtactcacaccccaatgtttatgtggtggaaaggaaaacttcaacccggtaattatgacaagctgatttccgcaatggatttctacccgacagctcttgatgcagccgatatcagcattccaaaagaccttaagctggatggcgtttccttgctgccctggttgcaaaataagaaacagggcgagccacataaaaatctgacctggataacatcttattctcactggtttgatgaggaaaacattccattctgggataattaccacaaatttgtccgccatcagtcagacgattacccgcataaccccaacaccgaggacttaagccaattctcttatacggtgagaaataacgattattcgctcgtctatacagtagaaaataatcagttaggtctatacaaactgacggatctacagcaaaaagataaccttgccgccgccaatccgcaggtcgttaaagagatgcaaggcgtggtaagagagtttatcgataacagccagccaccgcttagcgaggtaaatcaggagaagtttaacaatatcaagaaagcattaagcgaagcgaaataacttaaccttcatgcggcggatttttccgccgccttattgagcgagatagcgatgcacgttacagccaagccctccagttttcaatgtaatctcaaatgtgattactgtttttaccttgaaaaagagtcgcagtttactcatgaaaaatggatggatgacagcactctgaaagagttcatcaaacaatatatcgcagcgtctggcaatcaggtctattttacttggcaaggcggtgaacccactctggctggcctggattttttccgtaaagttattcactatcaacaacgctatgcaggccaaaaacgaatttttaatgcattacaaacgaatggcattttattgaataatgaatggtgtgcctttctcaaagaacatgagtttctggttggtatctcgatcgatggaccccaagaactacatgactgctacagacgcagtaattcaggtaacggtacttttgcaaaagtgatagcagccatcgagcgtctgaaatcatatcaaatagagtttaatacgttaaccgtcattaataacattaatgtccattaccctcttgaggtttatcattttttaaaatctatcggcagtaaacatatgcaatttatcgaattgctcgaaaccgggacgccgaatattgatttcagtggtcatagtgagaacacattccgtatcattgatttttctgtgcctcccacggcttatggcaagtttatgtcaaccatttttatgcaatgggttaaaaacgatgtgggtgaaattttcatccgtcagtttgaaagctttgtcagccgttttttggggaatgggcataccagttgtattttccaggagtcctgcaaggataatctggttgttgaaagcaatggagacatttacgaatgcgaccattttgtctatccacagtacaaaattggaaacattaataaatcggaactcaaaacgatgaacagtgtacaactgacagcgcaaaaaaaacggatttcagcgaaatgtcagcaatgtgtatataaacctatctgcaatggtggttgccctaagcatcgtattactaaagtaaacaatgagactgtttcctatttttgcgaaggttataaaatccttttttcaaccatggtaccttatatgaacgccatggtagagttagctaagaacagagtaccgctttaccacattatggatgttgcaaaacaaatggagaataattaataacgctcccccttagctccattcttagcctccttcttatgaccttaacaaggcacccgacataaattcctgtcgggtgtttcgtcttcatcatcttcctttgcgaaaatcctggcttacgaggtatgcgtcagggcattagcaatacccttgattatcaatagtataaccataaccactgaaaattaaatatttctttatatttcatattgttaaatgatacttaaataaatttcatcagtatatcattgccatagataatcattgggtggcacaatcaattttcgctaatgataaccattcccattacgttttgtatgttgatagcaaagtatctctgtctgctgaagcccttttggctgcgtaagaataataaaacttcagtgttgttaatcattattatcctcgccatgatccttggcgtggttaaaattcaggtctggttaaacgactggaataatgattttttcaatgcgctaagccagaaagaaactgataagctttggcagcttgtcctttggttccctgccctgctggggatctttgtattaatatccgtaaacaaaacatggttaattaaactactgactattcgctggcgcgaatggttaacagattactaccttaatcgctggtttgcagataaaaactactacttcacgcagatctacggcgagcataaaaatacagataaccctgaccaacgtatcgctgaagacattctcttactgatcagcaaaacgctcagcctttcatttggcttcatccagtcacttagcatgctgatcacctttaccgttattctttggcaaagcgcgggtacgctctcattcactgttggtggaactgaatggagtatccaggggtatatggtctataccgtcgtgctcattgtgatcggtggaactttatttacccataaggttggtaaacgtattcgtccacttaatgtggaaaaacaacgtagcgaagcgacatttcgaactaatcttgtgcagcataataagcaggcagaactgattgcgctaagcaatgctgagtctctacaacgccaggagttgagcgaaaattttcataccattaaagagaactggcatcgtttaatgaatcgtcagcggtggcttgattactggcagaatatttattcgcgctcgcttagcgttcttccctactttctgttattgccgcagtttattagcgggcagatcaatctgggcggactgatgaaatcgcgccaggcatttatgctggtatcgaacaatttaagctggtttatttataaatatgatgaacttgctgaactggctgcggttatcgatcgcttgtatgagttccatcaactcaccgaacagcgccctacgaataagcctaaaaattgtcaacatgcggtacaagtggctgacgcgagtattcgtactcctgataataagatcatattagagaacctgaactttcatgtttcgccaggcaaatggctattgctgaaaggttactctggtgcgggaaaaaccacactgcttaaaacattatcccactgctggccgtggtttaaaggtgatatttcttctcctgctgacagttggtatgtgtcacaaacaccgttaatcaaaaccggcttactgaaagagattatttgtaaagcacttcccctgtccgtagacgataaatcgttgagcgaagtactgcatcaggttggtctggggaaattggctgcgcgtattcatgatcacgatcgctggggagatattctttccagcggcgaaaaacaacgtatcgccctggctcgattaattttacgacgtccgaaatggatatttcttgacgaaactacctctcatcttgaggaacaagaggcaatccgcttactgcgtttagtgcgagaaaaactccccacaagcggcgtcattatggttacacatcaacccggtgtctggaacctggtcgatgatatttgtgacattagcgcggttatataaaaacaataaaagccctgctgtacggagatataaataaatgaagcgagttcttattcctggcgtcattttatgtggcgctgatgtggcgcaggccgtcgatgacaaaaatatgtacatgcatgtttttgaagagatgacggtctatgctcctgtccctgtacccgtaaacggcaacacgcattacaccagtgaaagcatcgagcgtttaccgaccgggaatggcaatatcagcgatctgctgagaaccaaccctgcggtacgcatggattcaacgcaaagtacctcattgaaccagggagatattcgcccggagaaaatctctattcacggtgcgtcgccctaccagaatgcctatttgattgacggtattagtgcaacgaataacctgaacccagcgaatgagtccgatgccagtagtgcaaccaatattagcgggatgtcacaggggtattatcttgatgtcagcttactggacaatgtgacgctttatgacagttttgtgccagttgaattcggtcgcttcaatggcggggtaattgatgcaaagatcaaacgcttcaacgctgatgatagcagcgtgaaactgggttatcgcactacgcgttcggactggttaacatcgcatatcgatgagaataacaagagcgcatttaatcaaggttcttcaggaagtacttattactctcccagattttaaaaagaacttttatacctttgtcgtttaatcaggaactcgctgataactttggcgttaccgctggtttatcgcgccgccagtctgatatcacccgcgcggattatgtttcgaatgacggcattgtcgccggcagggcacagtataaaaacgttatcgatactgcattgagcaaatttacctggtttgccagcgaccgctttacccacgatttaaccttaaaatataccggctccagccgtgattataataccagcaccttcccggagtctgatcgcgaaatgggtaataaatcctatggtctggcatgggatatggatacccagctcgcatgggccaaactgcgtaccaccgttggttgggatcatattagtgattatacccgtcacgatcatgacatctggtacaccgaactttcatgtacatatggtgatatttcagggcgttgcacccgtggcggattaggacacatttcccaggctgtagataattacaccttcaaaacacgcctggactggcaaaaattcgccgtgggtaatgtttcgcatcaaccctacttcggcgcggaatacatctattccgatgcatggactgaacgccataaccagtctgaatcctatgtgattaatgctgccggaaagaaaactaaccatacaatttaccataaaggtaaaggtagtctgggaattgacaattacacgctgtatatggcggatcgcattagctggcgtaatgtgtcgttaatgcccggcgtgcggtatgactatgataactatctgtcaaaccacaatatctccccgcgctttatgacggaatgggatatttttgctgatcaaacctcaatgattactgcaggttataaccgttactatggcgggaatattcttgatatgggattacgtgatatccgcaatagctggacggaatcggtatcaggcaataaaaccctgacgcgttatcaggatttgaaaacgccttataacgatgaactggcaatgggattgcagcagaaaatcggtaagaacgttattgcgcgtgcaaactatgtttaccgtgaagcgcatgatcaaatcagcaaaagcagtcgtaccgacagcgcgactaaaaccaccattactgaatataacaacgatggcaaaaccaaaacacattcgtttaacctcagttttgaactggccgaacccctgcatatcagccaggtagatattaacccgcaaattgtctttagctatatcaagagcaagggcaacttgtcgttaaacaatggttatgaggagagcaataccggtgataaccgggtggtttataacggtaatctggtctcttacgatagcgttccagtggcggattttaataatccattaaagatctccttaaacatggatttcacgcatcaaccgagcgggttggtgtgggcgaatacgctgacctggcaagaagcgcgtaaagctcgcattatcctgggtaagacgaatgcgcaatacatcagcgaatattcagattacaagcagtatgttgacgagaaactggatagcagcctgacctgggacacccgcttgtcctggacgccacaatttctgaaacaacaaaacctgacgatcagtgccgatattctcaatgtactggatagcaaaaccgctgttgatacaacgaatactggcgtggcgacctacgccagtggccgtactttctggcttgatgtcagcatgaaattttaatagttcggattttactttaccgggtaaattcgcccggttttcgcatggagataattatgagaaacctctgtttcttactgacgttagtggcaactctgttgctccccgggcgactgattgccgccgccttaccgcaggatgaaaagttaattaccgggcaactggacaatggcttgcgatatatgatttatccgcatgctcaaccaaaggatcaggtaaatttatggctgcaaattcataccggttcattgcaggaagaagacaatgagcgcggcgtggctcattttgtagaacatatgatgtttaacggcacaaaaacatggccgggtaataaagtcatcgaaacatttgagtcaatgggcctgcgttttggtcgcgatgttaatgcctataccagctatgacgaaacagtgtatcaggtgagtttgccgactacgcagaaacaaaatctgcaacaagtgatggcaatcttcagtgaatggagtaatgccgcaacctttgaaaaactcgaagtagacgctgaacgcggcgtaattactgaggaatggcgtgcccatcaggatgcgaaatggcgcacctctcaggcgcgccgccctttcctgctggcaaatacccgtaatttagaccgtgaacctatcggcctgatggataccgtcgccacggtcacaccggcacaattgcgccaattttatcaacgctggtatcaaccaaataatatgacctttattgtggtcggcgatatcgacagtaaagaagcgctggcgctgataaaggataatttaagtaagcttccggctaacaaagcagctgaaaatcgcgtctggccgacaaaagccgaaaaccacctgcgctttaatatcatcaatgataaagaaaaccgggtgaacggcatcgcactctattatcgcctgccaatggtacaagtgaacgatgagcaaagctttatcgaacaagctgaatggagcatgttggttcagctgttcaaccaacgtctgcaggaacgcatacagtcgggcgagttgaagactatttctggcggcactgcgcgcagcgtcaaaattgcacccgattatcagtcgctatttttccgtgtaaatgcacgagacgataatatgcaggatgctgcgaatgcattaatggcagagttggcaaccattgatcagcatggtttttctgctgaagaactcgatgatgttaaatctacccgccttacctggctgaaaaatgcggttgatcagcaagctgagcgtgatttacgtatgctgaccagtcgcctagcatccagctcattaaataatacgccgttcttgtcgccggaagagacatatcaactttcgaaacgtctgtggcagcaaattaccgtgcaaagtctggcggaaaaatggcagcagttaagaaagaaccaggacgcattttgggagcaaatggtaaacaatgaagttgccgccaaaaaagcattgtctcctgcggctatcctggcgctggaaaaagagtacgccaataaaaagctggcagcttacatcttcccaggcagaaatttatcgttaacagtagacgctgacccacaggcggaaattagcagcaaagaaacgctggctgagaatctgacatcattaacactttccaatggtgccagggttattctggcaaaatccgcgggtgaagagcaaaagctacaaattactgccgtatctaataaaggcgatttaagtttccctgcgcagcaaaaatcacttatcgcgctggcaaataaagcagtaagcggaagcggcgttggtgaactctcctcttccagcctgaaacgctggagtgcggaaaactcggtaaccatgagcagtaaagtcagtggcatgaatacattgctctccgttagcgcgcggactaataaccctgaacctggtttccagttgattaaccagcgaatcaaccacagcacgattaacgacaatatttgggcatcgctacaaaatgctcaaattcaggcgttgaaaacgctcgaccagcgtccagcggagaaattcgcccagcagatgtatgagacgcgctatgccgatggccgcacgaaattaccgcaagaaaatcagattgcacagtttactgccgcagatgcgctggctgccgatcgccagttgttttcatctccagcggatatcacgtttgtcattgtcggtaatgtcgcagaagacaaactcgtggcgttaattacgcgttacttaggatcaatcaaacactctgattcgccattagccgcaggtaaaccattaactcgcgcgacggacaacgcatcggttactgtaaaagaacaaaatgaaccagtggcacaggtttcacagtggaagcgttataattcccggactcctgttaatctggcgacgcgtatggcgctcgatgcttttaacgtcgcactggcaaaagatctacgcattaatattcgtgaacaggcatctggagcatacagcgtttcttctcgcctctcggttgatcctcaggccaaagatatcagtcatttgctggcttttacttgtcaaccagaacgacatgatgaactgttaacgttagcgaatgaagtgatggttaagcgtctggccaaagggattagtgagcaagaactgaacgaataccagcaaaacgttcagcgcagcctcgatatccaacagcgtagcgttcaacaattagcgaataccattgtaaatagtcttattcaatatgacgatcctgcagcatggactgagcaggagcaattgttgaaacaaatgacggtagagaatgttaacactgctgttaaacaatatctttctcatccggtgaatacctataccggagtattattgccaaaataatcacagccccgtcaacacatcgttggcggggattttatcaatattcgctatttttatgtaataatttataaatgtgttcaaagtaaataaccgtgtactaataatgatattataaggtctgatttttacgtgataattcaggagacgatagaaaacacataaaataacaacataaaacaccttacctccacacagaattctctattatgttgttttttaataaaaatacattattcacgcaatatctcgcgataaataacattaggattttgttatttaaaaccgagtcctttgcacttgcttactttatcgataaatcctacttttttaatgcgatccaatcattttaaggagtttaaaatggataagaagcaagtaacggatttaaggtcggaactactcgattcacgttttggtgcgaagtctatttccactatcgcagaatcaaaacgttttccgctgcacgaaatgcgtgatgatgtcgcattccagattatcaatgatgaattatatcttgatggcaacgctcgtcagaacctggccactttctgccagacctgggacgacgataatgtccataagttgatggatttatccattaacaaaaactggatcgacaaagaagaatatccgcaatctgcagcaatcgatctgcgttgcgtaaacatggttgccgatctgtggcatgcgcctgcaccgaaaaatggtcaggccgttggcaccaacaccattggttcttccgaggcctgtatgctcggcgggatggcgatgaaatggcgttggcgcaagcgtatggaagctgcaggtaagccgactaacaaaccgaacctggtgtgcggtccggtacaaatctgctggcataaattcgcccgctactgggatgtggagttgcgtgagatccctatgcgccccggtcagttgtttatggacccgaaacgcatgattgaagcctgcgacgaaaacaccatcggcgtggtgccgactttcggcgtgacctacaccggtaactatgagttcccgcagccgctgcacgatgcgctggataaataccaggccgacaccggtatcgacatcgacatgcacatcgacgccgccagcggtggcttcctggcaccgttcgtcgccccggatatcgtctgggacttccgcctgccgcgtgtgaaatcgatcagtgcttcaggccataaattcggtctggctccgctgggctgcggctgggttatctggcgtgatgaagaagcgctgccgcaggaactggtgttcaacgttgactacctcggcggtcagattggtactttcgccatcaacttctcccgcccggcgggtcaggtgattgcacagtactatgaattcctgcgcctcggtcgtgaaggctataccaaagtacagaacgcttcctaccaggttgctgcttatctggcggatgaaatcgccaaactggggccgtatgagttcatctgtaccggtcgcccggacgaaggcatcccggcggtttgcttcaaactgaaagatggtgaagatccgggatacaccctgtatgacctctctgaacgtctgcgtctgcgcggctggcaggttccggccttcactctcggcggtgaagccaccgacatcgtggtgatgcgcattatgtgtcgtcgcggcttcgaaatggactttgctgaactgttgctggaagactacaaagcctccctgaaatatctcagcgaccacccgaaactgcagggtattgcccagcagaacagctttaaacacacctgataacgtttaacggtaacggtgtcccgaaacgaagccgtttcgggacaatttccaaagtctgttcactggcattagcaacggaaaatattgttctgaatacgcttcagaacaaaacaggtgcggttccgacaggaataccgttttagggggataatatggctacatcagtacagacaggtaaagctaagcagctcacattactcggattttttgccataacggcatcgatggtaatggctgtttatgaataccctaccttcgcaacatcgggcttttcattagtcttcttcctgctattaggcgggattttatggtttattcccgtgggactttgtgctgcggaaatggctaccgtcgacggctgggaagaaggtggcgtcttcgcctgggtatcaaatactctggggccgagatggggatttgcagcgatctcatttggctatctgcaaatcgccattggttttattccgatgctctatttcgtgttaggggcactctcctacatcctgaaatggccagcgctgaatgaagaccccattaccaaaactattgcagcactcatcattctttgggcgctggcattaacgcagtttggtggcacgaaatacacggcgcgaattgctaaagttggcttcttcgccggtatcctgttacctgcatttattttgatcgcattagcggctatttatctgcactccggtgcccccgttgctatcgaaatggatgcgaagaccttcttccctgacttctctaaagtgggcaccctggttgtatttgttgccttcattttgagttatatgggcgttgaagcttccgcaacccacgtcaatgaaatgagcaaccccgggcgcgactatccactggctatgttactgctgatggtggcggcaatctgcttaagctctgttggcggtttgtctattgcgatggtcattccgggtaatgaaatcaacctctccgcaggggtaatgcaaacctttaccgttctgatgtcacatgtggcaccggaaattgagtggacggttcgcgtgatctccgcactgctgttgctgggtgttctggcggaaatcgcttcctggattgttggtccttctcgcgggatgtatgtcacagcgcagaaaaacctgctgccagcggcattcgctaaaatgaacaaaaatggcgtaccggtaacgctggtcatttcgcagttggtgattacttctatcgcgttgatcatcctcaccaataccggtggcggtaacaacatgtccttcctgatcgcactggcgctgacggtggtgatttatctgtgtgcttatttcatgctgtttattggctacattgtgttggttcttaaacatcctgacttaaaacgcacatttaatatccctggtggtaaaggggtgaaactggtcgtggctattgtcggtctgctgacttcaattatggcgtttattgtttccttcctgccgccggataacatccagggtgactctaccgatatgtatgttgaattactggtcgttagtttcctggtggtacttgccctgccctttattctctatgctgttcatgatcgtaaaagcaaagcgaataccggcgtcactctggagccaatcaacagtcagaacgcaccaaaaggtcacttcttcctgcacccgcgtgcacgttcaccacactatattgtgatgaatgacaagaaacactaaccatgtctgaatggttataagacaagggagcgataattcatcgctccctttttcgtgcttgttgtcgtattgacttaaccgggataagtacgagaatgagcgcacatctgtttaccggaaaccagcacatatggatatctgctcccgaaacgagaaattagcgattagaagaccagcgatactggttgcactggcacttttactgtgtagttgtaaaagcacgcctccagagtccatggtgacaccaccagcgggctcaaagccaccagccacgacgcaacaatcgtcacaaccgatgcgtggcatctggctggccacggtgtctcgcctcgactggccaccggtttcctcggttaacattagtaaccccaccagccgggcacgtgtacaacaacaggcgatgatcgacaaactggatcatctgcaacgtctcggcataaacacggtctttttccaggtcaagccggatggtactgccctgtggccatcgaaaattttgccgtggtccgatcttatgaccggtaagattggtgaaaatccgggttacgatccgctgcaatttatgctcgacgaagcccacaagcgtgggatgaaagtacacgcctggtttaacccctatcgcgtatcggttaatacgaagcccggtactatcagggaactgaatagcactctgtctcaacaaccggcgagcgtctatgtgcaacaccgcgactggatcagaacgtccggcgatcgctttgtcctcgacccgggcatccctgaggttcaggactggatcacatcaatagtcgcggaagtggtttcccgctatccagtagatggcgtgcagtttgatgactatttctatactgagtcaccaggttcacggctaaatgataacgaaacgtaccgcaaatacggcggcgcatttgcgtcaaaagcagactggcggcgcaacaatactcagcagttaattgcgaaggtatcgcacaccattaaaagcattaagccggaagtcgaatttggcgttagcccggcaggcgtgtggcgtaaccgatcacacgatccgctcggttccgatacccgaggtgcggcagcctatgacgaatcctacgctgatacccgtcgatgggtggaacaagggttgctggattacattgctccccaaatttactggccattctcacggagtgccgcgcgttatgacgtgttggcaaaatggtgggcggatgtcgttaaaccgaccaggacccgcctgtatatcggtatcgccttctataaagtgggtgaaccttcaaagatagagccagactggatgattaacggcggcgtaccggaactgaaaaagcagctcgatcttaacgatgctgtgccggaaattagcggcacaatcttgttccgtgaggactatctgaataaaccgcagacgcaacaagcggtcagctatctgcaaagtcgttggggcagttaaactcccattcttactttgtaacaagccggtgctttacccactggcttgttaccctcttgaactatcccactagcaatcatgcataaatacgtcaaattaaccacgcaattaaccacacttagttaaacagccataatccccctaataaaaatgtatgaatatgaaaaaacatacgatattcgctgtcaccgaaaaataattacgatgggctatactcttctgaagaacagtagcgtagattgaaactgtcctaagtcgcttatttcttttcagtatatcttcatatttcaggaaaatatggtgcagttagtcgatctcgcacgttgtgtttggttgattttggcctgcggtttaaccataaaggtcgacattattttaaagccgcaaacggcgaggatattgccctctcactttccatcggtgccgccatgtttaatggtcatcctgactatgagcgcctcattcaaatagccgatgaagctctgtatatcgccaaaagacgaggtagaaaccgtgttgaactctgtaaagccagtctttagatgcgccaggatgcagaggtaatcatgaagctaaccgatgcggatactgccgccgatggcatttttttccccgcccttgagcaaaatatgatgggcgcggtgttaattaacgaaaatgatgaagtgatgtttttcaaccccgccgcagagaagctctgggggtacaaacgtgaagaagtcattggcaataacattgatatgctgattccgcgggatttgcgtcctgcgcatcctgaatacattcgtcacaaccgtgaaggtggtaaagcgcgcgtcgaggggatgagtcgagagctgcagctggagaaaaaagacggcagtaaagtctggacccgttttgcgctatcgaaagtgagcgccgaggggaaagtttattacctggcgctggtacgggatgccagcgtagaaatggcgcaaaaagaacagacccgacaattgattattgccgttgaccatctcgaccgaccggtgattgtcctcgatccggaacgccatattgtgcagtgcaatcgcgcatttaccgaaatgtttggttactgcattaacgaagccagcggtatgcagcccgatacactcctgaacattccagaattccctgctgataaccgtattcgtttacagcagttgctatggaaaaccgcccgcgatcaggacgaatttctgctgttgacgcgcaccggtgaaaaaatctggattaaagcctctatcagcccggtttatgacgtgctcgcgcatctgcagaacctggtaatgacattctcggatatcaccgaagaaaggcaaatccgccagcttgaaggcaatattctcgccgccatgtgcagcagcccaccatttcatgaaatgggggaaatcatttgtcgtaacatcgaatctgttctcaacgaatcgcatgtttcgctgttcgcgctgcgcaacgggatgccgatacactgggcgtcatcttcgcacggtgcagaagttcaaaatgcgcaaagctggtcagcgaccattcgtcagcgcgatggcgcgcctgcggggatcctgcaaattaaaacctcgtcaggagcagaaaccagcgcctttatcgaacgcgtggcagatatcagccagcatatggccgcgctggcgctggaacaggaaaaaagccgtcagcatattgaacaactcatccaatttgatccgatgaccggtctgccaaatcgcaataacctgcacaattacctcgatgacctggtcgacaaagccgtctctccggtggtgtatctcatcggtgttgaccatattcaggatgtgattgatagccttggctatgcgtgggccgatcaggcattgctggaagtggtcaatcgctttcgtgaaaaactcaaaccggatcagtatctctgtcgtattgaaggtgcgtcttttgtcctcgtgagcctggaaaacgatgtcagtaacattacccagatcgccgatgagctacggaatgtggtcagcaagccgataatgattgacgataaaccattcccgctcaccttgagcattggcatcagctacgacgagggtaaaaaccgcgattacctgctctccactgctcacaatgcaatggattttattcgcaaaaatggcggtaacggctggcagttcttcagcccggcgatgaacgaaatggtaaaagagcgtttggttttaggcgcagcgctaaaagaagcgattagcaataaccaacttaaactggtttatcagccgcaaatcttcgcagaaacgggtgaactgtacggcatcgaagcccttgctcgctggtacgatcctctgcatggtcatgtgcccccttcacggtttattcctctcgcagaagagattggtgaaatcgaaaatattgggcgctgggtcatcgcggaagcttgccgtcagttagcagaatggcgtagccagaatattcatatcccggcgttatccgttaacttgtctgcgctgcactttcgcagtaatcagctgcctaatcaggtatctgatgcaatgcacgcctggggtattgacggccaccagctgacggtggaaatcacggaaagcatgatgatggaacacgataccgaaatctttaagcgcattcagatcctgcgcgatatgggcatcggtttatcggtagatgattttggtacaggcttttccggattatcccgcttagtcagtcttccggtaacggaaatcaaaattgataaaagttttgtcgatcgttgtctgaccgaaaaacgcatccttgccttactcgaagccattaccagcattgggcaaagcctcaatttaaccgtcgtggcggaaggcatcgaaaccaaagagcaatttgagatgctacgcaagatccactgtcgcgttattcagggatatttcttttcccgccccctgcccgccgaagaaattccaggctggatgagcagcgtgttaccgctgaaaatctgataaattcctctcgcccgcactcgcgggtttttatttaacgtgacactgtcacttaaatactgtgatttccgctacgtttagttggacaacgacaacgcatagccatgtcacaacaatcccttctcagcctgatgtgattgtgctgacgcatcaggcattcacgcgcctgacgcgtcatccggcaacgctttacgatttcaactggtaatccagcgtaatttccgctttcagtacctgagaaaccgggcatcctgcttttgctttctggataatgccgtcaaaggtggaggcatcaatacccggcaccgcaacttcgctcttcagtgcgattttagtaatcgcaaaaccggcatccactctatccagcgagacatcggcggtggtatcaatcgatgttggcgtgaatcccgcttcccccagcattaatgaaagcgccattgagaaacatgcggcatgcgctgcgccaatcagttcttcagggttggttcctttttcgccttcaaaacgcgtgttaaatccatacggctgttggttcagcacgccgctctcagtagatactgttcccttcccgcgtttgatatcgccttcccagtgtgcctgacctttcttatggattgtcattgttgctctcctgtgggcttaaaaaggaaattatagactacgtgagaaacagcacgaggataagcaggataatccgaataaaatccggcgaaaatataattcctgcacttaaattaaatttccacaatagataaccggaaatatataactcaagagatattgcatcaatatcaatcaactcatcacaataataatacctatcaatatcatggagttaaaatataaaaatcatcaaccaggactaatcttaacaacgaagcggcaaatatttgccatgctgaatgtgctttataaatctgcgatccgtagcagacaccataaatacacagacacggagaatcactatgtttacttattatcaggcagaaaattcaacagcagaacccgctctggttaatgccattgagcaaggccttcgggcagagcacggtgttgtcactgaagatgacattctcatggagctgaccaaatgggtggaagcttctgataacgacatcctcagtgatatctaccagcaaacgatcaattatgtggtcagtggtcagcaccctacgctttaaggtgctatgcttgatcggcaacctaatttaggggtttagcacgtgtttcttcgctacggcgatgttgtccttaaaactagcaacaggattgaggagttaaaatgaaatcgaaccgtcaggcacgtcatattcttggactggaccataaaatttctaaccagcgcaaaatagttaccgaaggtgacaaatccagcgtggtaaataatcccaccggcagaaaacgccccgctgaaaagtaattcataaccatcagtcctcaatgacgattaaacaccattgcctgcgcaatggtgtttttgtttttatctgctttatacttggtgccgacgccctggcggtaatgcaaagacgataaaagcccccagggatggatattcaaaaaagagtgagtgacatggaaccaaaaacaaaaaaacagcgttcgctttatatcccttacgctggccctgtattgctggaatttccgttgttgaataaaggcagcgccttcagcatggaagaacgccgtaacttcaacctgctggggttactgccggaagtggtcgaaaccatcgaagaacaagcggaacgagcatggatccagtatcagggattcaaaaccgaaatcgacaaacacatctacctgcgtaacattcaggacactaacgaaaccctcttctaccgtctggtaaacaatcatcttgatgaaatgatgccagtcatttacaccccaaccgtcggcgcagcctgtgagcgtttttctgagatctaccgccgttcacgcggtgtgtttatctcttaccagaaccgccacaatatggacgatattctgcaaaacgtaccaaaccataatatcaaagtgattgtggtgactgacggcgaacgtattctggggcttggtgaccagggcatcggcgggatgggcattccgatcggtaaactgtcgctctataccgcctgtggcggcatcagtccggcctatacccttccggtggtgctggatgtcggcactaacaaccaacagctacttaacgatccgctgtatatgggctggcgtaatccgcgtatcactgacgacgaatactatgaattcgttgatgaatttatccaggctgtgaaacaacgctggccggacgtactgttgcagtttgaagacttcgcacaaaaaaatgcgatgccgttacttaaccgctatcgcaatgaaatttgttcttttaacgatgacattcagggcaccgcggcggtaacagtcggcacactgatcgcagccagccgcgcggcaggtggtcagttaagcgagaaaaaaatcgtcttccttggcgcaggttcagcgggatgcggcattgccgaaatgatcatcgcccagacccagcgcgaaggattaagcgaggaagcggcgcggcagaaagtctttatggtcgatcgctttggcctgctgaccgacaagatgccgaacctgctgcctttccagaccaaactggtgcagaagcgcgaaaatctcagtgactgggataccgacagcgatgtgctgtcactgctggatgtggtgcgtaatgtaaaaccagatattctgattggcgtctcaggacagaccgggctgtttacggaagagatcatccgtgagatgcataaacactgtccgcgtccgatcgtgatgccgctgtctaacccgacgtcacgcgtggaagccacaccgcaggacattatcgcctggactgaaggtaacgcgctggtcgccactggcagtccgtttaatccagtggtatggaaagataaaatctaccctatagcccagtgcaacaacgcctttattttcccgggcatcgggctgggtgttattgcttccggcgcgtcacgtatcaccgatgagatgctgatgtcggcaagtgaaacgcttgctcagtattcgccgctggtcctgaacggcgaaggtctggtactaccggaactgaaagatattcagaaagtctcccgcgcaattgcctttgcggttggcaaaatggcgcagcagcaaggcgtggcggtgaaaacgtctgccgaagctctgcaacaggccattgatgataatttctggcacgccgaataccgcgactaccgccgtacctccatctaagcctgcgcccggtagtgaaggctaccgggcaattttcctctccctttttcagatctcatccatactgggtagtggcgaataaatctcatttgcctcacctgctatgcagaacatcatccgaaaaggaggaactatgaaggctgcagttgttacgaaggatcatcatgttgacgttacggataaaacactgcgctcactgaaacatggcgaagccctgctgaaaatggagtgttgtggtgtatgtcataccgatcttcatgttaagaatggcgattttggtgacaaaaccggcgtgattctgggacacgaaggtattggtgtggtggcagaagttggccctggtgttacttcattaaaaccaggcgatcgtgccagcgtggcgtggttctatgaaggatgcggtcattgcgaatactgtaacagtggtaacgaaacgctctgccgttcagttaaaaatgccggatacagcgttgatggcgggatggcggaagagtgcatcgtggtcgccgattacgcggtaaaagtgccagatggtctggactcggcggcggccagcagcattacctgtgcgggggtcactacctacaaagccgttaagctgtcaaaaattcgtccaggacagtggattgctatctacggtcttggcggtctgggtaacctcgccctgcaatacgcgaagaatgtctttaacgccaaagtgatcgccattgatgtcaatgatgaacagttaaaactggcaaccgaaatgggtgcagatttagcgattaactcacgcaccgaagacgccgccagaattgtgcaggagaaagccggtggcgctcacgcagcggtggtgacagcggtagctaaagctgcgtttaactcggcggtggatgctgtccgtgcaggtggtcgtgtcgtggctgtcggtctgccgccggagtctatgagcctggacatcccacggctggtgctggatggtattgaagtggtcggttcgctggtcggcacgcgtcaggatctaaccgaagccttccagtttgccgccgaaggcaaagtggtgccgaaagtcgccctgcgtccgttagcggacatcaacaccatatttaccgagatggaagaaggcaaaatccgtggccgtatggtgattgatttccgtcgctaagaggtctttgctgcgactgccatgttcgggtcgcagcctgttttgcgagacgctttccgcaatttcactcttcttcttttcctcccccatctttcccctcacaattcgcgaaaacgtagcgaaatttgttgcgctgtacggaacaatagtgatagtgttcctttcgagggaacaaggatgaagagatgataatgaatttcagacacaagggattgcgtgacttgtttcttctcggcaaaacctccggcgttataccgacgcaagtcaaacgattacgccaccgactcgctgtgattgatgcagcatgctgtcttgctgatatcgatatgcccggttaccgactacatccgttaagcggcgatcgcgatggaatttgggcgatatctgtctcgggcaactggcgaatcacatttgaattcgtcaatggcgatgcatacatactggattacgaggactatcactgatgaaaatggccaatcatccccgcccgggggacattattcaggaatcactggacgaacttaatgtcagcctgcgcgagtttgccagagcaatggaaattgcgccctcaacggcaagccgattgctgaccggaaaagcagctttgacgccagaaatggcaataaaactttccgtggtgatcggcagttcgccgcaaatgtggctgaatctgcaaaatgcctggagtctggcagaggcggaaaaaacggtggatgtgtcgcgactgcgccgtctggttacgcaataaaaaaatggcaccttataaagcgccatttgaaactgatgacaaacgcaacattgcccgatgcgctacgcttatcaggtctacacgttcactgcaatctattggatttgaacggtttgtaggccggataaggcgttcacgccgcatccggcatgaacaaagtgcacgttgtctacaataaaaaaatggcgccttttacagcgccattttcagcttaaagctcaaaagagattataacccttcttcactctcttttttcgcttctgccttctcgatttctcgataccagcgcggatggtgtttcttcgcccagcgacggctcaccttcccttcgatcatccctttaatcgatcctttcacccagaatgccatatacatatggatcaggatggcgtggatcaggatgatacccgcagccgcatggatcagcaggctataacggacaacctgtatcgggaagtactgtgcaaagtacggacgccagataatcactccggtcaccagcagcacgaaaatcatgctcatgattgaccagaacatcatcttttgcccggcgttgtacttaccgacatccgccactttgtgctcattgccttttaatacttcgacaatgttcaacagccacggaatatctttcttatccgggatgttgtgatgcacaaaacgcacaaacataaacatcagcgcgacgaaaatcgcaatgccgaagaacgggtgcaaaatgcgtcccatctgcggcgtaccgaaggtttgcgtcagccattgcagcgtcgggaagaagaacgaaatcccggacagcgccaccaggaagaagcaaatcaccacggtccagtgacaggcgcgatcaataaatttggtgcgcacaatcattttcgacttactcatgatttccctcctcgtcatcgtccacttccttattcgggccaataccgatgtagtggaaaatcaacccggcaaaagtggcaataaagccagccgctgccagcggtttcaacgcgcctttccacaggcttaccgaggtatcgatcttcggatctttcggcagaccatgatacagctccggctgatcggcatgatgcagcacgtacataacgtgcgtaccaccgaccccttccgggttgtagacgccagcatgttcgtaaccacgcgctttcagtttcgctacgcgctgttccgccagctccagcatctccttcttggtgccgaagtggatagccccggtcggacaggttttcacacaagccggttcctggccgacgctgacgcgatcgacgcagagcgtgcatttatatacccggttatcctctttgttgaggcgcggaatattaaacggacacccggcaatgcagtaaccacagccgatgcagttttccgactggaaatcgacaatcccgttagcgtactgaatgattgcaccagcagacgggcacgccttcaggcagcccggatcttcacagtgcatacagccgtctttacggatcagccactccagcttgccgttctgttcggtttcgctaaagcgcatcaccgtccaggacttggcgctcagatcggcggggttatcgtaaaccccgacgcagtgccccacttcatcacggatgtcgttccactccgaacacgccacctgacaggctttacagccgatacaggtggaaacgtcgataagtttcgcgacttctgctttgtaatcacgcacctgagaaggcggcgtgatggagttagttgcggaccttttgataatgtcctgcgtttccatagccatctgttcgcccccttacgccttctcgatgttgactaagaacgctttatattccggcgtttgcgagtttgcatcaccgacattcggcgtcagagtgttagcgatataacctttacgcgcgacaccctcaaagccccagtggattggaatacccaccgtttcaacctgctgaccgtttacattcagcggtttcagacggcgcgttaccacagccaccgcgcggataaagccacgcttgctggagacagtgacacgatcgccattggcaatgcctttcgccgccgccagcgtttcgctgatttccacaaactgttccggctgagcaattgcgttgagcaatgcgtgcttggtccaggtgtggaagtgctccgtcagacgataggtcgtacccacatacgggaactgctcttttttacccatccgcagcgcgtcttgttcatacagacgaacaaccgggttagacaccacgttcggatgcaacgggttagtgcccagcggcgtttcaattggctcgtagtgttccgggaacggaccttccgccattttgttgatggcaaacaggcgtcccatcccttccggctgcatgataaacggcccggttggcgtacccggtgcggcattgccgaagtccggaatatcgttacccgtccacttgctaccgttccactggatcagcatccgtttcggatcccacggtttaccgttgatatccgccgaagcacggttgtagagtacgcgacggttgagcggccacgcccaggcccatcccagcgtattccccagaccggacgggtcggagttatcgcggttagccatctggttgccctgctctgtccagctaccggtgtagatccagcaagacgatgcggttgtaccgtcatcacgcagatgcgcaaagctactcagcaactgacctttcttcgcaatcagcacgccattggcatcatagagatcttccagcgcatagccgttgttctctttagctacttcgtcagattgcggttcgtgcggctgcttgtagttccagctcatcttcatcagcggttctacgcctttaccaccttcggcctggtacagctcgcgcagatgatggtagatacccgccagaatttcgccgtcgttacgcgcttcgcccggcgcgtcctgacctttccagtgccactgcaaccagcgaccggagttagcgatagaaccatcttcttcagcaaagcaggtcgaaggcagacggaatacttcagtctgaatagatgccggatcgacatcgttcgactcgccgtggttctgccagaaggtagaggtttcagtcaccagcggatcgataaccaccatgtacttcagcttgctcaggcagctcaccactttgtttttgtccgggaaggacgcaaccgggttaaagccctggcagaaataaccggtgactttaccttcatccatcatgttgaaatacttgatgacgtcgtaggtctggtcccacttcggcagccagtcgtagccccagttgttctctttctgcgcggcatcgccgtagaaagatttcatcaggctaacgaaaaacttcggatagttgctccagtagttcacctgatcagccagcgtcgctttcggcgtgttcgcttccagatacgactgcaaatcaacctgtttttctgacggcagcgtcaggtaacctggcaggctggtagagagcaggcctaagtcagtcaggcccctgaatgttggagtgaccacgcaatgcgttcacgccgccaccggccatacccatgttaccgagcagtaactggatcatcgccatcgtacggatgttctgcgcacccacggtgtgctgcgtccagcccagcgcgtacaggaaggtggttgtgcgatccggtgcgctggtggaggccagcacttcacacactttcaggaagtcggcttttggcgtaccgcaaatgttttctactacgtccggcgtgtagcgggaaacgtgcgctttcagcaggttccatacacagcgcggatgagtcagcgtgtcatcgcgtttcgcatagccgttttcatcgaactgatagttccaggacgacttatcgtattgacgtttttcagcgtcgtagccgctgaacagaccgtcttcgaaagcaaaatcatcacgcaccagcaggctggcgttggtgtaatgcttaacgtattcggcgttgattttgttgttttcgatcaggtagcgcaaaacgccagacaggaacgtaatgtccgtaccggaacgaataggtgcgtaaatatccgccacagaagcggtacgcgtaaaacggggatcgacaacgatcaaggttgcatcgttgttgtttttcgcttccatcgcccagcggaaaccgacgggatgcgcttcagcagcgttaccgcccatcaccattacgacgttagcgtttttgatatccacccagtggttggtcatcgcaccgcgaccaaatgttggagcaagacttgctaccgttggtccgtgtcagacgcgcgcctggttgtctaccgccagcatcccgagggagcgggcaaatttttgagtcagcatcccggtttcgttgctggcaccggaagcacacagcataccggtagaaagccaacggtttaccgttacgccctgctcgttcttttcaataaagttagcgtcacggtcggctttcatcagcttcgcaatacgggagaatgcttcttcccagctaatgcgctgccatttgtcagaacctggcgcacgatattccgggtagcgcagacggttttcgctgttgacgtaatccagcaaaccggcccctttcgggcacagcgcaccacggcttaccggatgatccgggtcaccttcaatgtgataaatcgcttctctggcgtttttcgcgccatcacccaggctatacatcaatagcccgcaacctacggaacagtatgtgcaggtgttacggatctctttcgcgcgtaataatttgtagtttcgcgcctgagccagtgcttgcttcggggcaaagcccaatgctgctactgttgttcccgccataccgcccgcgcagattttaaaaaattgtctgcgactgacgtccattgctttcctcttttttcaggggtattactgcgcgaggaaactaacagtaaaattctgaatctttttgcgcgaaatcaaaaagaacacgtgtttgccacaaaataatccgcctgcgcaaattgacctacctcaatagcggtagaaaaacgccccactgcctgacagggcagttaaaaaaatgctataaaattcagcttaatttttaacggcaagagagacaaaacagcgagcatgacacgacaaaaagcaacgctcatagggctaatagcgatcgtcctgtggagcacgatggtaggattgattcgcggtgtcagtgagggactcggcccggtcggcggcgcagctgctatctattcattaagcgggctgctgttaatcttcacggttggatttccgcgtattcgacagatcccgaaaggctatttactcgccgggagtctgttattcgtcagctatgaaatctgtctggcgctttccttagggtatgcggcgacccgtcatcaggcgattgaagtgggtatggtgaactatctgtggcccagcctgacaattctctttgccattctgtttaatggtcagaaaaccaactggctgattgtaccaggattattattagccctggtcggcgtctgctgggtgttaggcggtgacaatgggttacattatgatcaaattattaataatatcaccaccagcccattgagttatttcctggcgttcattggggcgtttatctgggcagcctactgcacagtaacgaataaatacgcacgcggatttaacggaattaccgtttttgtcctgctaacgggagcaagtctgtgggtttactattttcttacgccacaaccagaaatggtatttagcacgcccgtcatgattaaactcatctctgcggcatttaccttaggatttgcttatgctgcatggaatgtcggtatattacatggcaacgtcaccataatggcggtaggttcgtattttacgcccgtcctttcctcagcgcttgcagccgtgctgctcagcgccccgctgtcgttctcgttctggcaaggcgcgctaatggtctgcggcggttccctgctctgctggctggcgacacgtcgtggctaaaataattgtcgggtctacggcccggcagttaatcagataaattctgacaatattaaaaaataaatttcaaataccagaaagccattttagttacatttagtaacacatatctgtctgtttaatccacattctgcccccgcagttacgctttcttatctattcttctaatcagcacttcacctgattcatccttaattctaataactggctattgcgccttacctcctgttttgtctttttttcattaccaatgtgtgcatgtgaggaacaatatggcactgcaaaatgagaaaaatagtcgttatcttttacgcgactggaaaccagaaaatccggccttctgggaaaataaaggaaagcatattgcacgaagaaacctctggatatcagtcagttgcctacttcttgccttctgtgtctggatgctatttagcgcagttactgttaatctcaataaaatcggttttaatttcactaccgatcaactctttttattaaccgcattaccctccgtttctggcgcattattgcgtgtcccctactcctttatggtgcctatattcggtggacgccgatggacggtttttagtactgcaatcctgattattccttgcgtctggctcggaattgccgtgcaaaatccgaataccccttttgggatatttatcgttatcgctttgctatgcggttttgcaggtgcgaactttgcttcgagcatgggcaatatcagtttcttctttccaaaagccaaacaagggagcgctcttgggattaatggcggattaggaaacttaggtgtaagtgtgatgcagctggttgcaccgctggtcatttttgtacccgtatttgcctttctcggcgtcaatggcgtaccgcaggccgacggttcggtgatgtcgctggcgaatgccgcatggatttgggtgccattactggcgattgccacgatcgccgcctggtcagggatgaatgatatcgccagttcacgcgcctcaattgccgaccagctccctgtcttacaacgcctgcatctctggctgctgagcctgctttatcttgccaccttcggttcgtttatcggtttttctgcgggttttgccatgctggcaaaaacccagttcccggatgtgaatattctgcgcctggcgttctttggcccatttatcggtgccatcgcgcgatcggttggtggtgctatttccgataaattcggcggcgtgcgggtgacgttgatcaacttcatttttatggcgattttcagcgccctgctgttccttaccttaccgggcacaggctccggtaatttcatcgcattttacgccgtatttatggggctgtttctgaccgcgggtctgggaagtggttctactttccagatgatcgccgtcatctttcgccagataacaatttatcgggtgaagatgaaaggcggtagtgatgagcaagctcaaagagaagccgtcaccgaaacggcagccgctctgggctttatctcagccattggcgcagtgggcggcttttttattccgcaggcgtttggcatgtcgctcaatatgaccggctctccggtgggcgcgatgaaagtgtttttaatcttctacatcgtttgtgtgctactgacctggctggtttatggtcggcggaagttcagccaaaaataagagatcgatgcctgacacgtcttatcaggctacaaccgtgtctcatccgacaaggcatcagatcccaattcattcctggagcaggagttatgtcatgagtaaacttttggatcgctttcgctacttcaaacaaaagggcgaaacctttgccgatggtcacggacaggtgatgcatagcaaccgcgactgggaggacagctatcgccagcgttggcagttcgacaaaatcgtgcgttccacccacggtgttaactgtacaggctcctgcagctggaaaatctacgttaaaaatggtctggtgacctgggaaatccaacagaccgactacccgcgcactcgccctgacctgccaaatcatgaacctcgcggctgcccgcgtggcgcaagttactcctggtatctctacagcgctaaccgcctgaaatacccgctcattcgtaaacgactgattgaactgtggcgcgaagccctcaaacaacacagcgatccggtactggcgtgggcatcgattatgaacgatccgcaaaagagcctgagctacaaacaagtgcgtggacgcggtggctttatccgctccaactggcaggagctaaatcagctgattgccgccgctaacgtctggaccatcaaaacttacggcccggatcgcgttgccggtttctcgccgattccggcgatgtcgatggtttcttacgccgccggaacacgctatctgtcgttgttaggtggcacctgtttaagcttctacgactggtattgcgacctgccgcccgcctcgccgatgacctggggcgagcaaaccgacgtaccggaatctgccgactggtataactccagttacatcatcgcctgggggtctaacgtaccgcagacacgtacgccggacgcccatttctttaccgaagtacgctacaaaggcactaaaaccatcgccattacccctgactactctgaagtggccaaattgtgcgaccagtggctggcaccgaaacaaggcactgatagtgccctggcaatggcaatgggccatgtcattttaaaagagtttcatctcgataatcccagcgattattttatcaactactgccgccgctacagcgacatgccgatgctggtaatgctggaacctcgcgacgacggcagctacgttcccgggcgcatggtccgcgcatctgacctggtggatggactgggcgaaagcaataatccgcagtggaaaaccgtggcagttaataccgcaggtgaattggtagtgccgaacggttcgattggttttcgctggggagaaaaaggcaaatggaacctggaatccattgccgccggtacggaaaccgaattgtcgttaaccctgctcggtcaacatgacgccgttgcaggcgtggccttcccctactttggcggcattgaaaatccacattttcgcagcgtaaaacacaatcctgtcctggtgcgccaattgcccgttaaaaacctgacattagccgatggtagcacctgtccggtggtcagcgtttatgatttggtactggcgaattacggcctcgatcgcgggctggaagatgaaaacagcgcgaaagattacgctgaaatcaaaccttatacccctgcctggggcgagcaaattaccggcgttccgcgccagtatattgaaaccatcgcccgtgaatttgccgataccgcccataaaacgcatgggcgctcgatgattattctcggcgcaggtgttaaccactggtatcacatggacatgaactaccgcgggatgatcaatatgctgatcttctgcggttgtgtcgggcaaagcggtggcggctgggcacactatgtcggtcaggaaaaactgcgcccgcaaaccggctggctgcctctggcctttgcgctcgactggaaccgaccaccgcgccagatgaacagcacctcgtttttctacaatcactccagccagtggcgctatgaaaaagtcaccgcgcaggaattgctctcaccgctcgccgatgccagtaaatacagcggtcacctgattgatttcaacgttcgcgccgaacgtatgggctggctaccttctgcgccgcagctggggcgtaacccgctctccctgaaagccgaagccgacaaggccggattgtcacccgccgaatttaccgtccaggcactgaagtcaggcgaattacgcatggcctgcgaacagccggacaacggcagcaaccatccgcgtaacctgtttgtctggcgttcaaacctgcttggctcttccggcaagggccacgagtatatgcagaagtatctgctgggtacgaaaagtggcattcagggggaagaacttggaccgacggagggaatccaaccagaagaagtcgagtggcaaactgcggcgattgaaggcaagctcgacctgctggtgacgctcgacttccgcatgtccagtacctgcctgttctccgatatcgttctgcccaccgccacctggtacgaaaaagacgatatgaatacctcggatatgcatccatttattcatccgctttctgcggcggtcgatccggcgtgggaatcacgcagcgactgggaaatctacaaaggtatcgctaaagccttttcgcaagtgtgcatagggcatctcggcaaagaaaccgacgtggtattacaaccactgctgcatgactccccggcagagctttcacagccgtgtgaagtgctcgactggcgcaaaggcgagtgcgatctgattccaggcaaaaccgcgccgaatattgtggcggtggagcgcgactaccctgctacctatgaacgctttacctcactcgggccattgatggacaaacttggcaacggcggtaaagggatttcgtggaatacccaggatgaaattgatttcctcggtaaactcaattacaccaagcgtgatggcccggcaaaggggcgtccgctgattgacaccgccattgacgcatcagaagtgattctggcactggcaccggaaaccaacggccatgttgcagtcaaagcgtggcaagcgctgggcgagatcaccggacgcgaacatacccatctggcgctgcacaaagaggacgagaagattcgctttcgcgatattcaggcgcagccgcgtaaaattatctccagccccacatggtctggtctggaaagcgatcacgtttcctataacgcgggatacaccaacgttcatgagttaattccgtggcgcacgctgtcaggacgccagcaactctatcaggatcatccgtggatgcgtgcttttggtgaaagtctggtggcttatcgcccgcctatcgacacccgtagcgtcagtgaaatgcgccagataccgccaaacggcttcccggagaaagcccttaacttcctgacgccgcaccagaaatggggcattcactcaacctacagtgaaaacctgctaatgctgacgctctctcgcggtggaccgattgtctggctcagcgaaaccgatgcccgtgaactgaccattgtcgataacgactgggtggaagtgtttaacgccaatggcgcgctgactgcccgcgcggtggtcagccagcgtgtaccgccgggcatgaccatgatgtatcacgctcaggaacgcattatgaatattcctggttcggaagtaactggcatgcgcggcggcattcataactcggtcacccgcgtttgtccgaaaccaacgcatatgattggcggttacgcgcagctggcctggggctttaactactacggcaccgtcggctcaaaccgcgacgaattcatcatgatccgcaagatgaagaacgttaactggctggatgatgaaggtcgcgatcaggtacaggaggcgaaaaaatgaaaatacgttcgcaagtcggcatggtgcttaacctcgataaatgtatcggctgccatacctgttcggtgacctgtaaaaacgtctggaccggacgcgaaggcatggagtacgcatggtttaacaacgtcgaaaccaaaccgggcattggttatccgaaaaactgggaagatcaggaagaatggcaaggcggctgggtgcgtgatgtgaatggcaagatacgcccgcgtctgggcagcaaaatgggcgtgattaccaaaattttcgccaacccggtagtgccgcagattgacgattactacgaacctttcaccttcgactacgaacatttgcatagcgcgccggaaggcaaacatattcccaccgcccgtccgcgttcactgattgacggcaaacggatggacaaagtgatctggggcccaaactgggaagaactgctgggcggcgaatttgaaaaacgagcccgcgaccgcaacttcgaggccatgcaaaaggagatgtacgggcagtttgaaaacaccttcatgatgtacctgccgcgcttgtgcgaacactgccttaaccccagttgtgtagcgacctgccccagcggcgctatctacaaacgcgaagaagacggcattgtgctgatcgatcaggataaatgccgtggctggcgtttgtgcattagcggttgcccatacaaaaaaatctacttcaactggaaaagcggtaagtcagaaaaatgtattttctgttatccgcgaattgagtccggtcagccaacagtctgctccgaaacctgcgtgggtcgcatccggtatctgggcgtgctgctctacgacgccgaccgcatcgaagaagcagcgagtaccgaacgagaggtcgatctctatgaacgccagtgcgaagtgttcctcgatccgcacgatccctcggtgatcgaagaagccctgaaacaaggtattccacaaaacgtgattgacgctgcccagcgttcgcctgtctacaaaatggcgatggactggaaactggcgctaccgctgcaccctgaataccgcaccctgccgatggtctggtacgttcctccgctgtcaccgattcagtcctacgctgatgcgggcggcttgccgaaaagcgaaggcgtgctgcccgccatcgaaagcctgcgtattccggtgcaatatctcgccaatatgttgagtgccggtgataccggtccggtactgcgggcgctgaaacggatgatggcgatgcgccactatatgcgttcacaaaccgtggaaggcgttactgatactcgtgccatcgacgaagtaggcctgagcgtcgcccaggtcgaagagatgtatcgttacctcgccattgccaactatgaagatcgtttcgtcatcccgacaagccatcgggaaatggcgggcgatgccttcgcagaacgcaacggctgcggttttacctttggcgacggttgccacggttcggacagcaaattcaacctgttcaacagtagccgtatcgatgccatcaacatcaccgaagtgcgcgacaaagcggagggcgaataatgcagatcctcaaagtgatcggcctgttgatggagtacccagacgagttgttgtgggagtgtaaggacgacgcgctggcgcttatccgccgcgacgcgccgatgctcaccgattttgcactcgacctgctcaacgccccgctgctggataaacaggccgaatggtgtgaagtgtttgaccgcgggcgcaccacgtcgctgctgctgtttgaacatgttcatgccgagtcccgcgatcgcggccaggcaatggtggacctgctggcggagtatgaaaaggtcggtctgcaactgaattgtagggaactgcccgattatctaccgctgtatctggagtatttaagcgtacttccggacgatcaggcgaaagaaggattactcaacgttgcgccgatcctcgccctgcttggcggacgcttaaaacaacgcgaggcaccgtggtacgcgttatttgacgccctgttgcaactggcaggaagccctctgtcaagtgacagtgtcataaaacagattcgcagtgaagagcgtgacgacacccaccaggcgctggatgcggtgtgggaagaagaacaggtgaagtttattgaagataacgccacggcgtgtgacagctcgccgcttaatcaatatcagcgacgctttagccaggatgtcgcgccgcagtatgtcgacatcagtgcgggaggtgggaaatgattcagtatctgaacgtctttttttacgatatctacccgtacttgtgcggcacggtttttatccttggaagctggctgcgctacgaccacgggcagtacacctggcgcgccgcctccagccagatgctggataaacgcgggatggtgctgtggtcgaacttgttccatatcggcattttggggattttcttcgggcacctgttcggcatgttaacgccacactggatgtacgcgtggtttctgccggtggcggtaaaacagcagatggcgatgatcctcggcggaatatgcggggtattgacgctgattggcggtgcggggctactggtgcgtcgtttaacaaatccgcgtatcagggcgacgtcttctggtgcggatatcctgatcctcgccattttgttaattcagtgcattcttgggttaaccaccattcctttttcagcacaacatccggacggcagtgaaatgatgaagttggtgggctgggcgcaaagcatcgtcactttccagggcggtgcatctacgcatcttgatggtgtcgcctttatattccgcgttcatctggtgcttggaatgaccatcttcctgctcttcccgttcacccgactggtgcatgtctggagcgcgccgtttgagtactttactcgtcggtatcagattgtgcgttcgcggcgttaattctcacgcgggccggatagcccttcgctctccggccacttgcaggctatgatagttctccagccacaggagaacattaatgaaaccgcaggtttaccacgtcgatgcttttacctctcaaccatttcgcggcaattctgccggtgttgttttccccgccgataatctcagtgaagcgcaaatgcagcttatcgcccgcgagttaggtcattcggaaactgcttttctgctgcacagcgacgacagcgatgtgcgcatccgctactttacgccaacggttgaagttccgatttgtggtcacgcgacagtagctgcgcactatgtacgtgcaaaggtgttaggtttaggaaattgcacggtctggcaaacatcgctggcaggaaaacatcgtgtgactatcgaaaagcaaaatgatgattatcgtatttcgctggaacaaggtactccaggctttgagccaccactgacaggtgaaacacgagcggcaattatcaacgcgcttcatctcactgaagacgatattttgcaaggcttgccaatccaggtggctaccaccggacactcaaaagtgatgattccactgaagccggaagtggatatcgacgccctttcgcctgaccttgctgcgctgaccgcaatcagcaagcagattggctgcaatggtttcttcccgttccagatccgcccaggcaaaagcgaaaccgacggtcgcatgttctcgcctgcgattggtattgtggaagatccggtgaccgggaatgccaatggtccgatgggcgcatggttagtacatcacaacgtattatcccacgatggcaacgtgttgcgtgttaaaggccatcaggggcgcgcattggggcgtgatggtgtaattgatgtgacggtgacaattcgagataaccaaccggagaaagtcaccatttctggcgcggcggtgattttgtttcatgccgaatgggcaattgaactctgaaaccgttgcctgatgcgcttcgcttatcaggtctacaaccgggctaatgtaggccggataaggcgtttacgccacatccggcaacctgacataaattattttcccgcctccgggtgcgtatcaaacgccgccatcaccagcgctaactcatccacagtaaagccatgtttcgcatcatctacgcccagaccaaactgttcctgcatcacggcatataacgacgccacatctggtagatttcgctgctcaactgcgtgcccattttcataatgggtaaaatgaaaattggtcagcgttagcttgccaccgtccggcaaatggcgacacatcagcaaatgatggcgaaaatgcgactgcggccagtgcgccgaccagaaattgcccatcacataatcgctttgttgctgctcgcagagatcaaaacggtacatcgactgccagtgctgatgatgattaaactgcaatacccaatcatcaccctcttgcaacaaccgatactctccgtgtggcgtggtttgcatgatatccggcattaaacgaatcggcgcggttagcgtctgcccaccgaaaccgacatcagcaatccatttttccccttccagttccaccaacagcaaacgatgggtgcgcggcggtaatgctggcggatttgataacactacgcgacctaacaagctgcgaacgttaaaccccagctcgcgtaacacccgctcaaacacgccattctgctcaaaacagtaaccgccacgacgggctatcaccagtttatcttccagcgattgatcatcaagctgtatttccctcggcagcaaaacgtcgagattttcaaacggaatggtgcaattgtgtttcaggtgcaatgcacgcagcgtatcaatattggccgcagcagctcccaaccagttaatacgggcaaaataatgattcagaatgggcgtcatcaggcgtttcccttagtggttttctcaacttataacctggaatagacgccgcactggctattttgtgcgatcgcggacatgcatcacgttcgcaaatcgccaatcccgttaatttcgttacttattgcgttacgagctacgcttttaaaacacccttcatagcgaggcgatatcgtgagccaattcattcccgtcgaattacaccatgccagccgtctgttaaatcatggcccaactgtcatgatcaccagtttcgatgagcaatcccagcggcgtaacattatggcagcagcctggtcgatgcccgtagagtttgaaccgccacgcgtggcgattgtggtagataaatcgacatggaccagggagttgattgaacgtaacggtaagtttggcatcgttatcccgggcgttgcggcgactaactggacgtgggcggtgggaagtgtgtcgggtcgtgaagaagataaatttaattgctacggcattccggtagtgagaggcccggtgcttggtttgccgctggtcgaggaaaaatgtctggcgtggatggagtgtcgcctgctacctgcaacttccgcgcaagaaaaatacgatacgctatttggcgaagtggtatcagcagcggcagacgcacgggtatttgtcgaaggccgctggcagtttgatgatgataagctcaatacgttgcatcatttaggtgctggcacgtttgttaccagtggtaagcgagttacggcgggctaaagaatcatatgcagcaaccaagttgtttaagcaatgtttccatatgagttaaagcatattttatctcacgattgcatatttttagtgaagattaatttatcctcaccaacatcatagtaattgcgtattatcgcctcattgataaagccctgttttgtataaaatgcgcgggcggcactaaaatcgatatggctggcggtctctactaatagtagtcttgcctgtttaattgtgagctcttttctatttcgttaatcagcagatgtctcactccctggcgctgatgggaaggactgatccagagcattaataaatttcagacatcatttgtcatcatttcagaagcacagtaggcaatccctgccagtcccaagtgttctgcactaaaccataaatcggcagattgacctgagaaataatgtgttagtgttttttgtacatgatgaaggccatcttgatcaaattgatccctgtcaagcagcatatccattaatggttcaacatctgaaggtttgactggtcgtataaacatggaactccttatttattgatgaatatttgaaaattgtttgcatggaacgcggttaacctgaattttcagcggaagtttcactcaaaggctttattaatccgctccttatgtccttttacagcaaataaataattacctccctgtttttgtatcttctctgcaatatctttctggcaacccatcgcatcagttgtgataatttcacctttaatatccaacatgttagtatcaattattgaacataaaatgtaaattatttagtgcaaaaaagcggcgcaccgtgttctttcccatattcctaatatggcaactttaagttatcgccgtctatacttatagaaatttcatcaggggtgacgtaaatagaatttttttcatcctcaattgcccataactgattaataaaaaagtgtttttttcatccaataacaaattattacatgtagtaaaattattaatatcaaaaaaatcatcagcacaattaatttttaaatttaaaaaataaagaaaaatattattgattgatttgagtgtaaaccacttgtcattaacaaatttatagccagatgattttataaaataataattatctcctggtataaaggcatacatatcatttaaggttatactcaacaaaaaactacgacctggtttaatagtattccaccgttcaggattcgtattaatttcaaaaggacatgaaccacctaagtagtccaacgtgatattcccagagttgattctgaatggttttttgcatatcgcatcatattcatctccttttccatcttttactttcataggtagataatatttagaaaaaaaatacgtggtagagctattgttagtaaaggttatgttagcaaaaatcctgttattttttttactcatagctaattgagcattgacatccgctatataattcatatgattgcattttttcttacactcatcataattttcgataggataaattaatggccttcctttgatatctctctcaagcccaaacccgtatttttttattaaaaccatttcatccgcagtcgattgaaaggaatagaaaaatataatatttacgattgtcattattatgattttttttatagcttgcagcattaatatatttctcgacttattagttaatggagaagtgctttttctaattccgctattttttcttaactgaattgcttaatatttcatcatcaatcgagtctatctcactttcaattaatcttatttcaaaatatctttctatgttatatgcattctcaaatatttgatctttttgtttagagatcagtttagttgcaatacggatatgttcgtcatatgaaacttcatcctctttgcacgttgaatatttatcagtagttgtataatcctgtgaccacataccaccttttttattatccccataataccactgaatatgagacatttcatgacataaagtagcaacatgagaatcctttcccgttactggattttttttgccatctctatactcaaattttgcgcctatgttaattatatagggcatatccttacttgggctgacgaatgctgcaaattcattacaacctgtataatttataaaactgctcattgttaaatcattagctataatcattaatcttctcacaccatccatcataagaaatctagcattcatgcgcctacctgtattatgtccatattttcttatattaacctccttatttcctttaacaccaaagatcttactgaaatcatattcctcctgtgctccccatctcaaaagatcatctgctctttttatcaaaaccaacttttgtgccttacgagccttatcaatcattattttaaaatgatctgttattttttgctctttcacacattcttctggctctggctttggttgtccagaagtttgattattatcgtccatagtgtccttccattgagagaaaatcatcattcgcaaatagcaacttcactttaatttcatgtttgctagatacaaaaaaacgctctgtatacccctcttcatccgtttctccgtgggtctgcgtgccatcctcaaagaaggcaatgtagcgggtttctgaatacggtatcccgtcatcgtctgtaaaatggaactggagagtatatttttcaggttcatcctcatcgtcacctcgatcatcaccaccacttccggtcacgcagttccctccagagtcttcattttcttctccggaatcactgccatcaccactcttctcatcccccagtgtcttcagcaccgtcggttgcagcgccggcaccggcgtccccggactaccgccgctattgagactgattttcggcccgacgatgtccacgccccctgaatggatgaccacaaacgagccacccaccttcaggcttatccggctgctgctctccagcacgatatccccgtcgacctttatccccagcgcgccactcaccttcctcgccaggtcccccttcaccaccaggctgtgctttccctccaccaggctgacatggttccccgtcgtcttatgctcctgcttcccttccaccgtcactttacggtcatttctgacgtacaggccgtcatcattactcacgctcaccgtccggtcattcgtcacctgcagcgtctggtcattacgtaccgtgatgcaccggtcgttcgccaccgtgatactctggtcgtggcccccttcttttctggtcccgacctgaaccgtctgccccttcaccaccgttatcttctggtcgttcccgatggtctccgtatggtcatgtttcacatccgtcgtccggtcgttaagtacctccgtgtccatgttcttctgcgcgtggatatagacctgttccttatccgtcgcatcctcaaagcgcaactcattaaaaccgcttcctttataggtcttcgaccgtatcgtcatctgcgtcttcgttcccggcaggtcccccggcgaacggttgtcctcatggtacgtccggcccatgaccagcggctggtccgggtccccgttcagaaaatcaacaatcacctcctggcccacccgcggtatcgccagattaccaaatcccggccccgcccacgcctgcgacacacgcacccagcacgaactctcctccgtcatcccgtgataacggtcccagtgaaacttcacccgtacccggccatgttcatcacagaagatttcctctcccgcaggcccggtgacaatggcgctctgtggcccgtccaccttcggtttgctttgcagccgtggacgccacgtccggtccgccggtatcacctctaactgatttcccagcgtggttcctctcccctggctgccgtgaagcgcctgcggctggtctcctgacagaatgctctgtaccacctgccattcacggttcagcatcttctgcggatgccccgtcagcgtaaaccacgtccccggccacagcttcggcgaattactctgccctgtggccttttccgcatcactgcgcaggctctccatccggtacagcgtgaaatccttgccgtgctgttcatccttgtaccttcccggataatcaaatatttcatactgttcaagctgtccgttcaggctctcaccctgctgctcatacatccccggccagtccggcaccttaaacgtgtaatcctggctctgcaccgatgacgggcggacatgcgcctcataacggaacatactgacacactccgtctccgctcctgccgatgtgtccgggttaaacggaagctcccccgcctgtgacagccccgccacatcgtcgcacagcgtcagcttctgctccggactgtccgccgcaaaccgctcaaagaagaaaatcccctcctccgcccacagccgcgccagaaacgccaggtcgctttccccgtactggacacagaattcccgcgccggatggtcctcataaaacagcggcgtccactccgtgacgccgttctcgttcagtaatgtggccgatatcgtccggatatcctgctgctggaagatacggaagttccgccgcagcccgcaccgccataacggcggctcaatacgcaggtgataacgcatctgccagccgttgttctcctgcataccaaaccctgccaccacgcctgtgacataacgcagcgggatgacaccctgccagatagtcagcgttgcgttcttctccagcagcatctccgccgtctgcataaaagaatcgctggcgacatccacactcatcacaaacggataagactggttctggattaaccggaagctcaccactgcaaaggtgtccggctcctggccgtcaacctccagcgtaaagcgaagaccttttaaggacataaatacctctcagacatatcagcctatatttaccgtgccgccaccaataaccacgccgccgcagtcaatagcatcaccggttctggcggcgggcaggccgtcaataaagacggttgacgagcctctggcgatttttcggggatgaggtggatgcttcggtttagcatgcggcgtcagcggatctccctgacgggctgcggggagaccatcgataaaaacggtggatgacccggcggtgatgacggtctcgtaataaccgtcgtgctgggtgcctttgtcggtaagtttggctgctaaaggcataattcctcctgttcagaatttctacagcagcaggtttcaaaaatccggagaaatattcaacgaaatattaatcacttcaccggatattctgatacgtaccttcactggtctatttaagtaatacaaattgttggcgtgtattaagtttcattttgttctccttaattatgtaaggagtatttgatcatgtataagcaatgaaaaacagtttcaggaaataaggagtatctcaatttttaaacataaaatgagaatcgtccagtacaaaaaagcagtgttacgtaatctttccctgattaaatacgctaccgcccagccctgataacatgatctgcactgcgctatcatatcgacatgtttctctacatgcgaaaagatgttttattttcagattatattaaattgatatttaatataaaaaccgaaatcacatcaaccatatgaatagttgtgccaacattaattgctattcatagcaaacaaatggacgtccagttaactacgccagtgattcattaacattaacctccggcattattgttaaataatgacattcctttttaatacttcttgtaatttcggtatctgacatacagcatcagcaatcgcattaatattcggggcattatcctgaaaccattcgtgtcccggtccccatgtgcgcatggtgcagagataacagtccaccagcgttagttgctctccaaacacatacggttcagcagtcaattgcgaattcagccagatataaagcgatttgcgatattcaattacaggtgcgtcagatgcccaacgcttagggtaatcggcgaaagtgaacgttggatagacattagcaaccagccagaccaatagccgttgaaactgttgacgttcggcgcgcccaagaggtggcgcaaggtccgggcgacgatcgagaaccatcaatgcaatcgccgctgtctccgtcataatctcgttatttttacagcgccagtgtcggaacctgacacaacggattcagggtttttaataaatcgcgtgaagttccctcgtggtcaaaaccactgacatcaacgaactgataaggaatatcagccagtgttagcatcagctcactgattgtagagccccagccgggtacgccatacaccttaatcatatgcccctcacaatcttttaaagattaagtgtaggacagcacacaggttatccagcaaaaggatttatcattttttcgtcagttgtataaatccccttcaggattgtaaggggatgttttgcatcgtttatcgataacgggtaggatgctgcgccgatagttttatacccataaagaataatggtgataactatcatcgccaggatgaataaacattgttcatggcaacttatatgactttttcattaaagcaatcagggagagcaatgagtaaacacaacaccgacacttcagatcaacacgccgcgaaacgccgctggcttaatgcccacgaagaggggtatcacaaagcgatgggcaatcgccaggtacagatgatcgccattggcggcgcgattggtacgggtttgtttttaggcgcgggagcgcgactgcaaatggcggggcccgcactggcactggtctatttgatctgcggcctgttttcgttttttattctgcgtgcattgggtgagctggtgttacaccgcccttccagtggcagttttgtctcttatgcccgtgagtttttgggtgagaaggccgcttatgttgctggctggatgtacttcatcaactgggcgatgacggggattgttgatattaccgccgtcgctctgtatatgcattactggggcgcgtttggcggcgtgccgcagtgggtctttgcgctcgctgcactgaccatcgttggcaccatgaatatgatcggtgtgaaatggtttgcggagatggagttctggtttgcgcttattaaagtgctcgccattgtaacctttttggtcgtgggtacagtgttcctcggtagtggtcagccgctggatggcaacaccactggctttcatttaatcaccgataatggcggcttcttcccccacggtttgctgcctgcgctggtgttgattcagggcgtagtgtttgcttttgcctccattgaaatggtgggtacagcggccggagaatgtaaagatccgcagaccatggtgcctaaagcgattaacagtgtgatttggcgtattggtctgttttacgtcggctccgtggtgttgctggttatgttattgccgtggagcgcgtatcaggcggggcaaagtccgttcgtgacgtttttctctaaactgggtgtgccgtacatcggcagcattatgaacattgtggtgctgaccgctgccctctccagcctgaattcaggtctgtactgcaccgggcgtattctgcgctcgatggcgatgggcggttccgcaccgagttttatggcgaaaatgagtcgtcagcatgtgccgtatgccgggattctggcgacactggttgtgtatgtcgtcggcgtattcctcaactatctggtgccgtcacgcgtatttgagattgtgttgaacttcgcgtcgctgggaatcatcgcttcatgggcgtttatcatcgtttgccagatgcgcctgcgtaaagcgattaaagaaggcaaagcagcggatgtcagttttaaactgcctggcgcgcccttcacttcctggctgacattactgtttttactgagtgtcctggtgctgatggcgttcgattacccgaacgggacttataccatcgcggcgctgccgattatcggtattctgctggttataggttggtttggtgtgcgcaaacgcgttgctgaaattcacagcactgcgccagtcgtcgaggaagatgaagaaaaacaggaaattgtgtttaagcctgaaacatcgagttaattgcaaaattgcccggctacgtgccgggcaaattcagactactgacgaaggtgccggatgcggcgtgataaaagtcaggcaattctttccgttttcaccctcgccatatctattacagcgcaatacgaatcacatcgtccggctgggtagcttcctgctgtttagtggatttttgtttcacactgacatacagcgttttgccatcggcagacagcgccaggctgttcggatgagtcggcgtatcgaacgttttcaccactttatagcttttcgcgtcaatcacactgactttacctgcctgacgatgcgtcacgtaggcttcattacgcgctgggttaaacagcacagccagtgattccggtgccgcaaccttcgccagaatattgccattacgggtatcgaccactaacacttctgccgctttagaatcggtgataaatgcacgctcattggcggtatcaaggctgatgttaataaagaagtgctctttgccgtcatccagcagctttttacggctgaggattttattgtcggcggtgtcgatggtaatcaattcgccgtcagcgttagtggtgtaaagacgtttgcctttgctatccagcgccagaccggtactcattttaccggtgttctggatggcggttttcagtttgatattctcgccatcaacgacccaaatcacgctctctttaccaataccactgatgtaaacggtgttcgtggcatcatcagctaccagctcacgtggttgcaacgggcgtacctcttccgtgcgcttacgatcatccagcaccagacgacctttcacttcgcccgttttggcatctatcgccgtgaccgcactatttacggtgttaccaaaccacaacgtctgagtcgtgttattgatggtggcaccaaacggcttgagatcgttatggatcgcctgcgtcacttccagagtaaccggatcaagacgataaaccacgccgcctttatccagtttgcggctttgcgaagtggcaagccacagcgcgttttcttgctggctataagccatttcgtaggcacctttacctaccgctttacgcagcatttcttctgcggcctgcgtactgaatgatgaagcaacaagcaatgaacctaacagtaatgaaccacgcaggcgcgatgaaaacagatgacgtaaatgcatgacgactccctttgatgaaccgatattttttctgcttcacaatgcttcgctaagcgtaatcatcgttacgcccttgttataaatgggaatggtaatcattattttctcaaatgtggagcatttcttaccgttacgactacaattttctcaattacttaacgtattgtgccgtttagttttccataaatttacaatttcattaccatgacggtgttttcccattcttaacctggcttttttcatgaagattttttccgtccgacagaccgttttgcccgcactgcttgtcctttcccccgttgtttttgccgctgatgaacagaccatgattgtcagtgccgcaccgcaggtggtttcagaactggataccccagcagccgtgagcgtggtggatggcgaggagatgcgcctggcaacaccgcgcattaacttgtctgaatcactgaccggagtgcctggtttacaggtacaaaaccggcagaactatgcgcaagatttacagctgtcgattcgcggatttggctcccgctccacttacggaattcgcggtattcgcctgtatgtggacggtattcccgctaccatgcccgacggacaagggcaaacatctaacatcgatttaagcagtgtgcaaaatgtggaagtgctgcgtggccccttctctgctctgtatggcaacgcgtctggcggtgtaatgaatgtcaccacccagaccggacaacagccaccaaccattgaagccagtagttactacggcagttttggcagctggcgctatgggctgaaagctacgggcgcaacgggcgacggcacacaacccggcgatgtcgattacaccgtctcaaccacacgttttacgacccatggctatcgtgaccatagcggcgcacagaaaaatttagccaatgccaaactgggcgtacgcattgatgacgccagcaaattaagcctgattttcaatagtgtggatatcaaagcagatgacccaggtgggctaaccgaagcagaatggaaggcgaatccacaacaagcgcctcgtgcagaacagtacgacacgcgaaaaaccatcaagcaaactcaggctgggttgcgctatgaacgtagcctgagcgcgcaagatgatatgagtgtaatgatgtatgccggagagcgagaaacgacccagtaccagtcaatccccatggccccgcaacttaacccgtcacatgcgggcggcgtgattaccctgcaacgccattaccaggggatagacagccgctggacacaccgtggtgaattgggcgttccagtcacgttcacaaccggcctgaactacgaaaacatgagtgaaaaccgcaagggttacaataacttccgcctgaatcgcggcgtgccggaatacgggcaaaaaggtgagttgcgccgcgacgaacgcaatttgatgtggaacgtcgatccctatttacaaacccagtggcaactgaccgacaaactttcgctggatgctggcgtgcgctacagctccgtgtggtttgattccaatgatcattacgttactccgggtaacggcgacgacagcggtgatgccagttatcacaaatggctaccagccggatcgttaaaatatgcaatgaccgatgcctggaatgtctatctggcagcagggcgcggttttgaaacgccgacgattaatgaactgtcttatcgcgctgatggacaaagcggtatgaactttgggttaaaaccctccaccaacgatacaattgagatcggcagtaaaacgcgtattggtgatggactgcttagtctcgcattgttccagaccgacaccgatgatgaaattgttgtcgatagcagtagcggtgggcgtacgacttacaaaaatgccggaaagacccgtcgtcaaggggctgaactggcatgggatcaacgtttcgcgggagattttcgcgtaaaagcgtcctggacctggcttgatgcgacctatcgcagcaatgtttgcaatgaacaggattgtaacggtaaccggatgccagggatcgcccgtaatatggcctttgcgtcgataggttatataccggaagatggttggtatgcaggcacggaagctcgttatatgggcgatattatggcagatgatgaaaatacggccaaagcgccttcttatacactcgtcggcttattcaccgggtataaatacaattaccacaatttaaccgtggatttatttggtcgtgtcgataatttattcgataaagaatacgttggttctgtcattgtcaatgagtcaaacgggcgatattacgaacctgcgcccggacgaaattatggtgtcggcataaatattgcgtggcgatttgagtaattatctttaagcccggtatttgccgggcgtattttatttatcggctgtattgctggcacaacatagcaacgtttttttgcatagtgaggttttcgacagccagagcaactgccattaattccagttcgtagcggatccgattgatttcatttaattgacgttttcccacttccggaactgtaaatgcttgcgctggtgcgacaaagagcacatttaccgaaaccagacgtaaggaaccggcgcgccatgcggacgcaaggacagaacccaacatcggttacgctgcgtttgttgccccataatgctctcctgtgcttttggcatgaatccatcaatagtagcaggctcacaggattggttttgtttgcagccgtcacatcccctctgcaacacgcaataatttcatagaggaatccgttgcttcgggctgttttcgatagtattgataacatcatcatcattattttatcgaggccagacatgtccatccgttttgcccgcaaagccgactgtgctgcaattgcggaaatttataatcacgccgtgttgtatacggcggctatctggaatgaccaaacggtggatgcggataaccgcattgcctggtttgaagcgcggaccatagcaggttatccggtgctggtgagtgaagaagatggcgtagtgacgggatatgcctcgtttggcgactggcgtagttttgatggttttcgccataccgtggaacattcggtttatgtccatcccgatcatcaggggaaaggtctggggcgtaaattgttaagccgattgattgatgaagcgcgggattgcgggaagcatgtcatggtcgccgggatcgaatcgcaaaatcaggcctcgctgcatctgcaccagtcgctgggatttgtcgtcaccgcgcaaatgccgcaggtaggtactaaatttgggcgctggctggatctgacatttatgcagttgcaactcgacgagcgcactgaaccggacgcgatcggatgaatcagtcacttacccttgcctttttgattgcagccgggattggtctggtagtccagaacacgctgatggtgcgcatcacccagacctcctctaccattctcatcgccatgttgctgaactcactggtggggattgtgctctttgtttctattttatggtttaaacaaggcatggcggggtttggcgaactggtgtccagcgtgcgctggtggacacttatacctggcttgctgggatcgttttttgtcttcgccagtatcagcggatatcagaatgtgggagcggcgacaactattgcagtactggtcgccagccagctgattggcggtctggtgctggatatcttccgcagccatggcgtaccacttcgggcgttgatcggcccaatttgtggcgcaattttacttgtggttggcgcctggctggtggccagacgctcattttaatcagaggatggtaccgcctttggttaactgttcgtggcgcgcttccatatcttctttatgtttgcgaccgtgatgagcaatagcggtgcgcaaacgctgctgctgggtgtagcgatcttcccgacttaactccgcgtcatcgctcagggcgattaataattcgttcatatgggcaatgacgctctcttcaatcgcggcatccacgcgcgcgatgacttcatccagatgcgacatactttctccttagccacttgtgaaatttatcgattcatccaaatgatataagtctgcgtggtgccgtcaagccagtgcataagatttaaaacagagaaaacaacagcgccaccgggaaactcatcggccatgttgcccccaccagaaaggcgcttaagaaacggatgcgtttcttatcgtgagaaagaaaccaggtgataagaaatgcgattgctgccataaccgcataaaaaacaagcatatgttgatagagagacatgtacgggcgtccagccagatgaataaaacgcgcgcaaatatgcgtcattttttgacgtgcatcaagttttttcaccagttagagaaaaaatcatcaaacagcaacttgcccttatctatcttcagaatgagtattattgcggattttcttaacccgtactatacacataggggcaatgataaaaggtggcaaaaatgaatgtttccagtagaactgtagtactgataaatgtctttgctgctgttggtttgtttactcttatctctatgagatttggctggtttatttgatgtagtgattttgcacgcagcacgtactgtcagagaaatcagtgctctgacagtacgcaagatcatctcatactcttacgatctgcaatattatccttaatgtttaaccatgacgtggcggacgacagtgtaatcctccagcccataaagtgacatatccttgccgtaaccagaaagtttctgcccaccgtgcggcatttcacttaccagcatgaaatgggtattgacccaggtacaaccatattgcagccgcgcgctgacgcgatgcgccctgcccacatctttcgtccataccgaagatgcaagtccgtactgactgtcattcgcccagttcaccacctgttcttcgttgtcgaagagcgtaacactcactaccggaccaaatacctctttttgcacgatggcatcgtcctgtaatgcgccagccagcagcgtcggcgcatagtaatagccattacccttgcgcttttcaccgccagtgatcactttgatgtgccctgtcgctttcgcctcttctaccgccttgctgacgcgttcgagatgcgccagcgagcttaaaggtccaagctccgtagactcgtcatccggcgaacccgattttaacgttgccaccgcagcaccgagtttttccaccagcgtatcgtaaatgcctttttgcgcgtagatccgacaagccgcagtacaatcctgtccggcattgtaatagccaaaagtacgtacaccttcgaccactgcttcaatatccgcatcatcaaaaacaatcactggcgctttgccaccaagttccatatgagtacgcttaatggacggcgcggtatggctgatgatgtgttccccagtggcgatagaacccgtcagcgacaccatccgcactttgggatgtccggtcagcggatctcccaccgtcttgcctctgccaaacagcacgttaatcacgccagccgggaagatatctttcgccagctctgccaacttcaacgcggtcagcggggtaatttctgatggtttaagcactacgcagttccctgccgccagcgccggagccagtttccacgcagccatcatcagcggataattccacggtgcgatagaagccacgacccccaacggatcgcgacggatcatcgaagtatgaccttcaagatattcacctgccgccagaccattcaggcagcgcgccgcaccggcgaaaaagcgaaagacatcgacaatcgccggaatttcatcattgaacgcgctatgcagcggtttgccacaattacgggactccagttcggcaaaaacctgaccattttcttcgataacatcagccagtttcagcaggcattccgcacgcgcttttggcgtggtttgcccccattcggcaaatgctgcatctgccgcgcgaacagcagcattgacctgctctgcggatgcctcggcaatctccagtaaaacgtcccccgttgccggattatagacaggctgtttttccccttcgccgctaaccagttctccgttaatcagtaacttatgttgcatagcatattcctgtatcagtggttattgaccattgtcgccttcgcgggttagccaccaggcccccaggatcggcaaggttgttaccaacataaccagcagtgccaccacgttggttaccgggacatcacgcggtcgcccaagctgattgagcaaccacaacggtaacgttcgttcatgacctgccgtaaaagtcgtcacgatgatttcatcgaacgacaaggcaaacgccagcattcctccagccagtaacgccgaactgagattcggcaacactacgtagcggaaggtttgccagccattggccccaagatccattgacgcctcaaccagactccacgaggtgcggcgaaaacgggcgatgacattgttaaacaccaccactacgcaaaaagtcgcatgaccgaccacgatggtgaaaaatcctggctccagattgatggttttaaaggcggttaatagcgccagaccagtgacaatgcccggcagcgcaatgggcagcaacagtaacagcgaaatggcgtttttgccgaaaaagtctcgtcgccacagcgcggcagctgccagcgtccctaacaccagcgcgattaatgtcgccagcgccgccactttaagtgacagtgtcacggaatcaaggatatcactacgctgtgctgccacgctaaaccagcgcagcgtcaggccttgcggtggaaaactaaacgccgcatcttcagtgttaaacgcataggcagcgataatcaggatgggaaaatgtaggaaaaccacgccgccccaggccgccagtttgaggaaaaacggtgcgcgttcagagtgcatcgaacgctcccagacgtttcacaaacgccagatagagtgcgatgagaacaatcggcaccagggtgaatgccgccgccatcggcatattgccaatcgccccctgctgggaataaaccatattgccgataaaatatcctggagggccaaccagctgcgggacaataaaatcgcccagcgtgagtgagaaggtaaagatagagccagcggcaatacccgggattgccagcggcagcaccacatagcgaaaggtttgtcgtggacgtgcgccaagatcagccgacgcctgcaacaatgacggcggcaaacgctcaagcgccgcctgcaccgggaggatcatgaacggcaaccagatatagagaaacaccagaaagcgccccagcccggaagttgacagcgtattgccgcccaccgccggtagcgtgaggaacgcagtcagcagtggttccagccccagatgttgtaaaaaccactgcgccacgccatcttttgccagcaataacgtccaggcataggctttaacaatgtagctcgcccacatcggcaacattaccgcaatataaaaaaacgctttcatttttccgctggtatagcgcgccatataccacgccattggaaaagccagaatggcgctggcgatagtcaccgccacagccatggtcagcgtgcggacaatgatgtcgtaattcgccggattaaacagcgcacggatattcgccagcgtcagttccggcgttaccgacatggtgaaatcgtcaaaggtataaaagccctgccataacagcgtcagcagcgagccgaaatagacaatgccaaaccacattagcgggccaagcagcagcaaaaacagccccagccccggattacgccagaagaaaccgggcaccttacccagacctggacgtgaaggtgattgcaatacgttcatcgccattcacctctcctcaaccagcgccaccatcacatcacgcgaccaggaaaccatcacctgttgtccgggcgtgagcgtggcaggcagttcttcgcctgtcatattggcctgactcaccagcagtttttcaccgccgctcagtgtcagttcaaaacgagttgccgcgccctgatactgcaccgcctggatcgtgccattagcctgcatttctccaggggtgttgaggcggatatgttccggtcgtagtgcgaagcttcccgtcatgccacaaagtttctctgccatcagtccatcaaaaacattcgatgtcccaacgaatcccgcaacaaacggcgtgcgcgggcgcatatagagatcgcgcggagaatcgacctgttcaatgcgtccattattgaaaaccgccacccgatcggacatcgataacgcttcgccctgatcgtgggtaacgaagataaaagtgataccgagagactgttgcagctttttcagctcaagctgcatttgctcgcgcaatttgagatccagcgcgccgagcggttcatccagcaacaacacacgcggttcgttcaccagtgctctggcgatggcgactcgctggcgctgaccaccagaaagttgtgacggtttacgttgctgtacaaaccccaacgccactttctcaagcgcctcttgcgccattgcgtgccgctgctttttattcacgcctttgaccatcagcccgtaggctacgttgtcaagaatcgacatatgcggaaatagcgcgtagtcctggaagacagtattcacgtcccgctcccacggtggcagattgctggcgggcgtaccaaaaatagagatagccccgccggaaagctgttcgaatccagcaatcaggcgcaggcaagtggttttgccggagccggacggccccagcatagagaagaactcaccatcttttatcgcaatactgacgccatttactgcgcgcacgtcaccgtacaaccgtgagacgttgtcaaactccactgcgtacgtcataaaacaccccagcgaagttagcgaccgcccataatggcaatgtaatcctgcgtccagcgactgtagggaacaaacttgcccccttctgctataggcgttttccagaaggcgattttatcgaaatagttaaaaccgtttgtttcacaacctttctcgcctaataacggactggctttacacccttgcggcactactggtaacgagccaaaccaggccgccacatcgccctgcacttttggggttaatgaccagttcatccatttgtaggcgcaaaccggatgtttcgcttcgctatgtagcatggtggtgtcagcccaaccggtaacgccctccttcgggaaaacggtagcgacaggctggccttcggctttcagggcgttggcctgatagggccatgcactggaagcaaccacaccctcgtttttgaaatcgctcatttgcacggtagtgtcatgccagtagcgatggatcaaactatgttgatcgcgcagcactttcagcaccgcctgatactgttcttcggtgagttgatacggatcgctgatgcccaactgtggctgcgtggctttgacgaacaacgcggcatccgcaatgtagatagggccatcataagcctgtacccggcctttattgctcttgccgtccggcagattctgctcaacaaaaaccacttgccagctatccggcggcgtcgggaaggttttagtgatgtacatcagcaggttcggcccccattggtaaggtgtgccgtaaactttgccgccaacgttaaaccagtcgcctttaaccacgcgcggatcgagcgctttccagttgggaatcaaggcggtattaattggctgcacgcgtttgcccataatcaaacgcagcgaggcatcgccggatgccgtaaccagatcgtaaccccctttgaccatcagactgaccatttcatcggaagtcgcggcggttttaacattcaccgcgcagcctgtctctttttcgaattgcgttacccagtcgtactgtttatcagtttgtccgcgttcgatgtatcccggccaggcgataatatccagtcgcccttccggattctctaaattggtaggcggttcggcggcgtgagcggtcattattgtcatgctgagcgcacacaggctgctgcgggcaaatgtcttgctcataaggtcttactcctgtcgtaattaattgttcagccgccgtgccgtaaaaatatctccttgtttaaccatagacggcggcttgcaggcacaccttcggccctgagaaaatttaatcaggttgtgagctaccgcgcattatgccgtctgtaaggttatcttctggagtatagacaaggagttaggatatatgactgctattcgaaattcatattacccaacctgagaggaattaaattaaacgctattacagccgttcttgaataagtttgcctaattgttttaccgcctgttcttcacgttctccccactgccacgcggtattaaaacgaaaaaaacgtgaccagttttcaccggtagaaaacatattacccggcgcaatactgatatgatgcgtcagtgccaccaggcttaattctcctgcatctaacggctcggggagctccagccagagaaaataaccgctgtcattgtgatgaattttgacttccgcaggcagataacgcagcaaagcctgccaggcgcgttgtttacgttccgcaagctggcgacgcaggcgacgaagatgagcatcgtatcggcgagtagaaaggtaatccaccagcgcaagctgcatcggtgagctggtggaaagcgtactcatcaactgcaagcgttgaattttacgtgcatgttttccggcggcgacccaaccaatacgaaaaccaggcaccagacatttcgaaaacgaagagcaatgcaaaacaccatcgtggcgatcccacgctttcgcaggcagcggtttttcccgtccaaaataaagttcgctataaacgtcatcttcaatcagcgttacgttgtactgattgagcaacgctaccagccgcacttttttctgcggcgttaaggtaaatccaagtgggttctggctattagtcatcagccagcacgctttcaccggatactcctgcaacgccagttccagcgcctgaagatcgatcccttctttaatatccgtcgctaccgataacgccttcagccgtaaccgctccagcgcctgcaacgcgccgtagaaacaaggattctctactatcacccaatcgcccggttcagttaccgcttgcaaactgaggtttaatgcctctaacgccccggcggtaatgacaatttcatcaggtgaaatggtgatgccctgtaaggcatagcgacgagcaatagcctgacgcagttctacgtttcctggcggtaagttttcaatcacgctcatcgccgtggcggttttgcttacctgcgccagcgagcggtttagttgttggagggggaaaagtcgcgggtcgggaaaggccgaggcaaacggaactaccgacggatcgcgactggcctgcaacatatcaaaaatataggtgttgatatcgactgcttcatctcgtgtgactggaatgactgtcgctttcggcatttttattgcctgtggcgcaacgtaataacccgattgcggtcgcgcgataatatatccctgactttcgagcaactgataggcatggctgacagtcataaagctcatgccagaaagcgccacctggtcacgcaacgaaggcaaacgatcgccgggttgccagatacccgacgcaatctgctcgcgtaattgttctgcaagctgctggtattttttcattatcgaatcgtaattatgtgcagatgattcggcagtctatatcagttgttaaaaatgacaacttttcattaactgtaatcaaaccatcaccagcgataactctttgccaagcgcattagccgcgagctggacggcgtcgatttttgtcgcatggtgcaaattaaataggcgagtaatctcctgtttatgtttgccaattcgccgggctaactcttgctgagtgatttctgactgtaaaaaagcatttaacagcaataccttagaggcgacgctcaaaggcacttcaataaagtgatcgtgactatttaatggcgaagtttacctccgtgtgtaatgtgctcgaaaatagcactaaatcgccgcaacggcagaatgcaatgcaaaatcaggaaggaagattccagaatttctttgctctaatttgcaaaactgaataataacctcaagaaacgatcggcatcatagcggcaaaaggttagaaaaaggtggcgggatgttttcgaaggcgttatcggttgtcttattaacgtgtgcactgttctcaggacaactcatggcagggcacaaaggacatgaatttatgtgggtaaagaatgtggatcatcagttgcgtcatgaagcggacagcgatgaattgcgtgctgtggcggaagagtcggcggaaggtttgcgcgagcatttttactggcaaaaatcgcgcaaaccagaagcgggacagcgttgagtcgtgtgttgccggatgcggcgtgacaccttacccggcaggcaatatcatgcagatttgatgagtggtgagtaacccgaaaactggcgttttacccttttcgcttcggcaatgttttcagcagatcatccggacttacggatgccactacgcttcccggtaacggcattttcagtatgtgatttttgattttgccaatgacgtgcatctcgcatgggcggcaatcaaactttagcgttaatacttcatcgccgttaaccagttgcattggcgtcgccttccagcttttgatattgcctttcgcctgtttcgggcacagattgaaggcaaagcgcagacaatgcttggtgatcatcaccgggacttcgcccttctcttcatgtgcctcatacgccgcgtcaatcagttgcacaccatagcgatgataaaattcacgcgctttctggttgtatacgttcgcgaggaaactcagatgcgtttgcggataaactggcgcaggatcagcaaccggtttacggctgccgcgctggtaactggcaagacgcgcagcatcaagcatatcggcggcttcacggcggaactggtttaacagactgtttggtacaaacagcgcccccggcaaattaatttgcacattgcgggcgtaatagatggtttgccccagttttgccagaccatccttcagattgttcattgctttttcggcgttattggcttcgtcgaactgcccgtccagcgtatgtgtgatgctgacaccctcttcactggtgagggtcagaatcagttgttcctgccagccgcccagttcaatgtctaccgccacccgacgttcgctggaggtttttgtcagtgcctgctgccagttatgatcaagattacggtttagtgggtgatgcgggcgaattttgtgcaaatctgctggcatttcattgggccagacgcggtactgattttctccggttttctctaccgtattggcacgaaaaccgacgacttcacgtttaatcatcacgttcaggccatcgccatttgccagtggctcggtaacggcaacatcaatatgatctttcgctactttcaatacttcgcccaccggcaggccgataaatttcggcgaatcgaacgcgccaatatcgcctttacgggcattcacaaaataatctgtgctaccacggtggaaagtcttttccgtcgatggaacaaagaaatgttcagtacgacctgatgaagcgcgcgccagatcgccacgttcttcaataatggcatccagcatctgacgataatgggcggtgatattcttcacgtagctcatatctttgtaacgcccttcaatcttgaaggagcgtacgccagcatcaatcagcgcgccgaggttggcagtctgatcgttatctttcatcgacagcagatgtttttcataggaaaccacccgcccctgatcgtctttcaatgtgtatggcaaacggcacgcctgcgagcaatcgccacggttggcgctacgccctgtttgcgcatgagaaatgtagcactgacccgaataggccacgcacaatgcgccatgaataaagaattcaatggtcgcgtccgtggcctggtgaatcgcgcggatctgctcaagattcagctctcgcgccagcacaatctgcgtgaagccaacatcagagaggaacttcgctttttctactgtacgaatatcgcactgcgtactggcgtgcagttcaatcggcggaatatcaagttccagaatccccatatcctgaacaatcagcgcatcgacaccggtctggtagaggtcagtaatcagccgttgcgcgggttccagctcatcatcatgcaaaatggtgttaagcgtgacgaaaatttttgcaccataacgatgggcaaacggcaccaactcggcaatatctttcaggctattactggcattatgacgggcaccaaaaccagggccgccgatataaacagcatcggcaccgtgcaaaatagcttcgcgggcaatggcggcatcgcgtgccgggcttaacagttcaagacgatgagaagatacggtcactttcttatccagtagctgaaaaatggcggctattttagccacaagcgcgacgttgcgaaatagttttcccgcttaactgcgcgggtaatggatgagggaatgaaaatgtacggtttgctctccaccattacgatagacatgcgtgacgtctgcagcaaatcgaacgccttccccacaattaaggctctgccattcaccatcaacacacagatcaagttgtccatcaatgacgacgacatgttcgattacccccttttcatggggcgtcgattcgcttattgcaccgggtgccatctgaatcgagaagtgttcaaagcagagttgtggatcataaggaaacagcgaagtgatcaccatcgcctgccgttgtggatcataaactgaaggtgtagcggactgcggcggggaaataaatgttgaaaatggcacgttcaacccggtggcaattttccataatgtcgcgaccgtcgggctggattcattacgctcaatctgccctaacatcgctttagaaacgcccgtcgcttctgccagtcgcgaaagactccagccgcgctgctgacgtagttgtttaagtgtggtggataaaaagcgagcgagattttccatgcgactcctccggcaaaacggaagtttatcacttgtgcgttataacggacaaatgctacggtacctgtacgttataacgcacgaggtgactatgcgtctgttttctattcctccacccacgctactggcggggtttctggcggtattaattggctacgccagttcagcggcaataatctggcaagcagcgattgtcgccggagccaccactgcacaaatctctggctggatgacggcgctggggctggcaatgggcgtcagtacgctggctctgacattatggtatcgcgtacctgttctcaccgcatggtcaacgcctggcgcggctttgttggtcaccggattgcagggactaacacttaacgaaaccatcggcgtttttattgtcaccaacgtgttaatagtcctctgcggcataacgggactctttgctcgtctgatgcgcattattccgcactcgcttgcggcggcaatgcttgccgggattttattacgttttggtttacaggcgtttgccagtctggatggtcaatttacgttgtgtggcagtatgttgctggcatggctggcaaccagggccgttgcgccgcgctatgcggtaattgccgcgatgattattgggatcgtgatcgttatcgcgcaaggtgacgttgtcacaactgatgttgtctttaaacccgttctccccacttatattccccctgatttttcgtttgctcacagtctgagcgttgcactccccctttttctggtgacgatggcatcgcaaaacgcaccgggtatcgcagcaatgaaagcagccgggtattcggctcctgtttcgccgttgattgtgtttactggattgctggcgcttgttttttcccctttcggcgtttattccgtcggtattgcggcaatcaccgcggctatttgccaaagcccggaagcgcatccggataaagatcaacgttggctggccgctgccgttgccggcattttttatttgatcgcaggtctgtttggtagtgccattaccgggatgatggctgccctgcccgtaagttggatccagatgctggcaggtcttgcgctgttgagtaccattggcggcagtttgtatcaggcgctgcataatgagcgtgagcgcgacgcggcnnnnncattccattcattaattaattaatgaatgaatgnnnnngcttctttcatttcggtgttggtatagttcaaaattttatccagaactttctgccctacctgggtagaaggtttcggtaccggataataagtgattgggttccagacgatgctgtcatatttgctttgatcaaaactcgggtctacccaacgtaaaacaggtttacctgttgccgaggttgtttcttttaaatcagagtaattgtttaaaaaaccagaatatttatctggctgggtgattttagaggcacaaccagacagagccaacaagccgcataaagctgcaactttcgcaaatgatgtggtacgcatgaatagtttcctgagatgattatattactttctaagttatagcaaaaagcgccgcttcgtgttgtggcaaaaaaagtgttggtgaaaataaattttttagccccttttcagacgacatagtcaatgccgaaaaaggggctaagtcaatcatcagtagttaaatttcagtaagttaagcggctaaaaaacttcgactactgtgattaatttcacatcccttcgataaaaaatatgcttaccgaaaagaagaacagtaaaccatctcagcgtggggaattttcacgcgctttgttcttaccggatcattttttacgtgccagcatcgtggcgaaacgcagtttaatacgattaccgttggcgtcggtgcggtgcagctcgccgacgtcttcattgtatttcaccctctcccagccttcgtaatatcgacgtaattccccctctttgaaggcaaacgggaagccgacggtacatggataatcagcggtatccatcgccgccacaatcaggttgtaaccgccaggtttagtgcaacgttgcatattggcaatcagccctgggatggttttagcctcaaggaacatcagcaccacagtagaaagaataaaatcgtactgtccatcaaatgtgaggttattcagatcaacgacccgggtgtgtaaattatccagattttcaatggacttaatgcgctcgacgttggcgatactcatggcatttttatcccatgcgtcaacatcataaccattggctgccaggtaaagactgttacgaccattgccacagcccagatccagcgttttacccggtttaaccactttcaccgcttccagcacttcagagtgtgtgcgggttaattcatatttatcagtaaaatagttttcatcacgaatgatcattctttgtcctctgctttcattaaaacggcgcgctcggttctgactaacaattttccctgcatcagaagcgcaaaagtacggatgagcagtattgcaataataaaattggtaaagataaacagcggcaccgccagcgtatggaaaaatccattatcgctgccactccccagatgcaaaccggtggttgccagtgcagatacaccgaacgagaaactccagaatgaagcattaaatggctgggagagataccatggcatcagacgtagcataaacagcagttgcagcagtccataaccgaaaagcattttcgccagcgtgtcaccctcgccgccgttgacgctcagccaggcactacaggccaccagcgcaggagcgagctgaatgccgagtgatgtccgcagtgccgtgggtaattctcccgaactgcgcagacgctgcaagatcaccggttccaggcttagccatgagaaaacgcctgcgcctaaaaacaccagaccggcgtcggtgtagcccaacgcaccacaggccattgcgctgataaagttgttggcaactgtcggcagatacagtccaggcgtggtagcttcttcagggtgagatccgcgccataatcccgcagtttgccatgcggcataagccaactgaaccacgacaccaaaactgaacaggcacaccgccagtgggcgaaaccacggaacaaaaccaatcgccaccagcatcgtcgttgccggaaacaaactcacaaaactgctcagcactggatggcgcacttctgccagcacgctatgcggaaagcgtatgagtcgggtaataaatgcgccagtcaataatccccagatgatcatcgccagaatcaccagcccatcacccaaccagtggctgacctgccaaagctggctggcatagcgccaggcaaatcccatccctatcgtccccaacacaataccaaagtagcctgccggcaaattgagcactttatcgctctgcatcttcttactcattttgtttaatttataaagtatatttgaaatgcattttatggaattttctcgagcatagccagagccgcagaatttgctacggttatagtaagtcacctgtgggaaaacgctatgcgtaaatatcgtctaagtgaagaacagcgagcctttagttatcaggaagatggcactaaaaaaagtgtgttattacggcaaattatcgccatgagcgattttaacgatgtgatagcaggaagcgctggcggctggatcgatcacgaaacggtgttagcacaggaaggaaattgctggatttacgaccagaatgctattgcgttcggcggaacggtgatttccgggaatacgcgtatcaccggcaccagcgtgctgtggggagaggtttacgcaacggataatgtctggatcgataatagtgaaatcagccagggtgcatatataagtgacagtgtcaccattcgtgactcattagtttgtggtcaatgtagaatatttggtcacgccttaattgatcaacattctatgatcgtcgccgcacaaggcttaacgcccgaccatcaactcctgctacaaatttatgatcgcgcaaaggttagcgcctcgcgtattgtccaccaggcacaaatttatggcgatgccgtcgtccggtatgcttttattgaacatcgcgccgaagtttttgattttgccagtgttgaaggtaatgaagagaacaacgtctggctatgcgattgcgctaaagtctacggtcacgcgcaggtgaaagctggcatagaagaagatgccattccgacgattcattacagttcacaggtggcggaatatgccattgtggaaggtaattgtgtgttaaaacatcatgtcttgattggcggaaatgccgtggtacgtggcggaccgattctgctcgacgagcacgttgtcatacaaggtgagagccgtattacaggtgcggtgataattgaaaaccatgtggagttaactgaccacgccgtcgttgaagcctttgatggcgacacgattcatgtccgtggtccaaaagtcattaacggcgaggagcgcattacgcgaacgctgctggcagggttattgtgaatcgataatacgcgcgtataagttcacatcatcataggcatcattcaggaactcagcctgtttaaggcaaccttcaaggataaaaccattgcgcaacgctacctggttgctttgcggattgtccacccgacatttgatcacgaagcgtctaagttcaccagactgagcgtaatgatgaatcaatgcctgcagcgcctgagaaatgatcccctgcccctgatgagattcgtccagccagtagccgatttcagcggttttattcagtggttcaatacgattaaaagagataacgccgataagttcatcttctttgaaaatcatgaacattttggcatagccgcgttgatgcaacatcacattaccctgcaccgtttttcgcgtgtcctcttcactttgaacaaactgcggccagtttagcgactgctgtaaccaggttttatttttacagattaactgataaagaggtgtgacatgactttccgcaacagcatgtaattcaagtgattcgcttacttttatcgtttcagtcatcttatctccagtcaatccatgcagctgttaaaaaagccgcctggctggcggcttaggaaagtttacacctctttgacgctcacctgctgcaggattttgagcatctcatcttttaactgtagcttttgttttttcatgcggaccacttccgcattgtaccctcgaccgtcggaaccttcctttctggcaatttcatgatcaagtttattgtgtttatcgaacaaggacataaagcgaggattttcgtttttcagacgggatattaaatctcggtattctggaaacatacgcactccctgttagtggctgacaaggtgtatctgaaatacacaccatcagattactcatttaacttagggaaaaatgcgagcgggatcgtgtttaaccagacggcacctcccgaagaagatgccgaagaaaaaacgattaactcatcacgcggtcatcaacatactgacgtttatccggcgctggcgggaaatactgatacagccatgtttcactgatagcgtcgccctgacaacgcagatacatccgcatatcgaccggatcagtggagtccgaagtcggataccagtcaaactgaatacgataaccatcaatgggttcaatatagagaatttcgatttgcttcgcttccccactggaaagcgtaatcaccggctcaatgccttttggcgcggcagctttcagatcaccaccaacgaaatcgacggcaaaacgtcgcgcccatttttcgggatagtgttcacctggcgcccaaccttccgggaaaccgcccatgccggtacgcgtcgccataacgcgcgctaatgggcaatgaacaggcggttgcgcactccagtacagacgatactggaatgcaaactcatcacccgcttttacagctttttctggctgccagaagcagacaatgttatccagcgtttcgcccgttgttgggatttccatcaggccgatggtgcccttaccccacttgttacgcggttccacccacagacttgggcgtttgttataccagcccataatgtcctgataatgggagaaatcacgatccagttgcaataaaccaaaccctttcgggttgttgtcggtgtaagcattgaactgcaatttttgcggattgttcagcggacggcaaatccactcgccgttgccccgccacatggacagacgatcagagtcatggatttgcggatgaatggtgtcgcacatccgacgttcattagtaccgcagctgaacatactggtcatcggcgcaatgcccagctgtttaatgtctttgcgcgcatacaggtgattttccacatccataatcacctgatttttctcacaatggatagtgaacttataggcaccagtaatgctggcgctatcgagcaacgcataaacggtaaaggtggttgcccctggttttaccgtatcaaaccagaaggcggtaaagtcggggaactcttctttgctgtcggtgtaagtgtcgatcgccaggccgcgggccgacaaaccgtattgatatgtgtcatcaacggcgcggaaataactcgcgccgaggaatgatactacatcacggcgcgccagttcgggggctttaaacacgcgaaaaccggcaaaaccgagatcgctttgcccttctaattgtttggtatccacacccgcatcgttgtatttgaacaactccgggcgaaagtgaatttcacgcgccagatgtgttgctggatctacagaaaacatacgaacgcggcgacggaatcccattcccatatggaaaaactgagcgtccagttgacggttctcaacgttatgccagagcgatttttcggcgtcgtattgaatactgttataagcctgcggcgtcattgtcgccaaagtgtcaggtaacggacgtggtgcaccacgccatgctgtttgcgctaagtcgtgcgccattgactgtagaatggagaagtcaaaacgctgggtttgcccgtcggcaatatcagaatcggccgcgaatgccgcctgagaaaaaagagaagcaatgccgctggtaccgcacacggcggccatagccattgaacctttaataaatcgtctacgatccatacctgaaagtgagtccttctggtgttgtgaatggtcccgcgctggtcattttcagcggcaagaaagtgcttatttatgaccgctcactctagacaatatttattaataatccaattgttgaaatcagagaatatgcataaattggcattttttttatgtcgatgggatgagcctgattcgtttgtaaaatcaggcaaatttttgcaaaggcggatggtcagaatttaaagcaaaccacagcgacgtttactgcgttcttccgcttcctgataaagctggaactcatccaaaaccggacaccccaacgcctgctcaaatgcttcgcgactggcatcaccgtgattgcatgcccgcgtttcattacccagatttgactggaagatccccgccgcgctaacgggcaagaaatcttcataggtaatgggttgcgccactacccaaccacgttctattaagggctgtggatcgtctccgggatgaatcacctgacgatgcgcctcacccgaaggcgtcagacggtaccggaaccatcccagcccttgctgacgcattaaaaactcactgtcaggaaaagtgcggaaggtttcctgtaaatgcatttggtgagtgagattatcctgcccggttccagcgttccgcagaagatcatcatacagttgtcgccctttcggcgttaatgccacaccacgctgctcaatttcaccaaagcgcgcggtatgcgtgccctgtttctgccccgcaaacaacaccgtctcttccagtgctttaaagctggtctggcgtagtaaaatcggcacctcgcggcgcggcggcccttcgatcagaactttgggttcaattccgcattcaggcatcatcgactgcacccggtcaatatccagcgtacgtggcgtcagatggttgatatggcatccaggaaaacagaccacatcagcaatcaaccgattttcgttgtgcaaggcgcgataggtttcttcatctaccgttgctgactggtgccagcgaaacgtttccagggcttcctgcacaaactcctgtgcctgtgtttcgttaaaaccgccctgctgctcatattcctctaacagttgtcgacaacgtggggtgaagatatcgcgctgacgcagaatctccgccgctttctggcgcaaaatttcgttctcgataagctcaagacggagtaacgaggtaaaaacgcggaagggattacgcgccagagaagcatcatcaatgggccgaaatgctgtcgaatgtaccggcacccctgcctgcgagagatcgtaatagctcaccgggtacatccccataatggcaaacatccgccgaagagtagcaagctcttgtgcagtcccaacgcgaatcgccccatgacgttcaacattcagtcgcgccagctcgtctgcatttaccattttttcgtgcagttgaggattgttttccagcaccgccagatttacatcagctaccagttccagcagcgtgccgtactgcggaacttcttgctggtacatggctgacattgcctgcgaaaactgttcccgaatctcatccgccgtgatgctgttcgccatagtgtctgcctccagtggtcagtaatctggagtgtaggtaaccgcattcactccggctggaagaatttacaaactgtgatctcgccgcgaaaacatcaatattatccattttgctgtaacatagttgctttaattgttaataatattttgcaatcaagttatcataataaaacaacttcacttgtcagcgacaccgcttcgtttttaacatcgcttatggaaaaaaatagtctgtttagtcagcgcatccgtttgcgccaccttcatacattcgtagctgtcgcacaacaaggaactttggggcgcgcggctgaaacccttaatttgagtcaacctgcgctctctaagacattgaatgaactggagcagctgacgggcgctcgcttgtttgagcgtggtcgtcagggggcgcaacttaccttacccggcgaacaatttttaacgcatgcagtcagagttcttgacgccatcaacactgccggacagtcgcttcatcgtaaagaaggtcttaataatgatgtcgtcagggttggtgcgctacctactgcggcactagggatattaccttcggttataggtcagtttcatcagcaacaaaaagagacgaccttgcaagttgcgacaatgagtaaccctatgattctggcgggtttaaaaaccggggaaatcgatatcggcattggtcggatgtcagatcctgaactgatgaacgggcttaattatgaactgctgtttcttgaatcgctgaagctggttgtccgccccaatcacccgctacttcaggagaacgtaacgctaagccgggtgctggaatggccggtcgttgtatcaccagaaggcactgcgccacgccagcattcagatgcattagtgcagagccagggatgtaaaattccttcgggttgtatcgaaacgctgtctgcttcgctatctcgtcaacttacggttgaatacgattacgtgtggtttgtcccttctggcgctgtaaaagacgacctgcgtcatgccacgctggtggccctgcctgttccgggtcatggtgcaggcgaaccgattggaatactgacccgcgtagatgcgacgttctcttctggttgccagttgatgattaacgctattcgaaaatcaatgccgttctgaaaggtgaagggatctgtcgatccctcctttaacattttcacaccgtagcaaaactaactggttcacaagctccgcgaggttctgccgacacagaatgtttgttgagacggaatacgtccaccgcctcagttagtcgtgccgcctgttcttcaagggacaccgctgccgttgaggcctcttctaccagagaagcattctgttgcgtcaccttatccatttcagaaatcgcctggctaacctgcgttatgcctcgactttgttcacccgaggcggtggcgatttcctgcatgatatgtgtgacactcgcgacggcatcaacaatagtgcacatgattttccctgccgttgccacctcatccgatcccaggtcaattaatctgactgattcactgatcaagccttcaatctctttcgccgcctgggcgctgcggcttgcgagtgtccgtacttcgctggcgacaacggcaaatccagggccttgcgagagtaacacgattctgacattcacactgacccgacaatcgctctacgaactgcggttccgggacggtgataaggaagttgctgcgctcatggcctgcacgtccaggtaagggcaagcgcggggattttcccccgcgcatctgactagcggattcattttctcatggcaccccttttacacttcagttagtgcatgtttttttcgatgcactaatagaaccatcattacagacaaatttgccgcctgccgtacagtgtgagatcccccctttcgaaccagaacagggtttgcgcccggcatcggcataaaaggaaacaagcgttcccataaccaggataagtgccagttttttcatataacctccatgatttatcgaatcttatgttcgatttgaacgttatacgctggtttattttgataccgttgatgagatcaaagatcgggtgaattgattaaagataagccagatggacgtatagacaaggattatggttttatttgtcatacaaataaatataataggcgcttccgatgtaggcccgtattcttcgcctgtaccacgggtcggttttagtacaggcgttttctttaaatatccttcaggaacgtttacgcggcatcatgcgtagaagtgtgttgtccttccagaaatagtggtgtgccagtgcagccgcagcgtgcaacccgatgacaaaatatcccagattcgccagcgtttcatgccacgactttaagctatcaacccgttcgaaattggcctctgaagcgtaaggcatcgtcaaaccaaacgcaaaccacgggttgccccggttatacatcatcaccaaaccaatcactggcagcgcaataaacaggagataaatcaccaaatggcccaaatgcgccagtcccgtcatcatcggttttggcttaggtataatcggcggggttgggcatttcagccttaacaaaagacgaaccaccatcagtacgagaattgagatgccacaggaaacatgaatcatgttgatgaggggccgatcgctacgtgggaagaaaccacgaaactccattgcgcaatacgctacgataaccagcaaaaagaccagccagtgaatgctgatttgtaaccttgagtatttatttcccataacatttcctgctttaacataatttgccgttaacataacgggcttttcttaaaatttcattaaatattgttcacctgttttcagtacgttacgtttcgctgcaagaatgtagattgcccatcccgccatcctggtctaagcctggaaaggatcaattttcatccgaacgttcctgacaggagaagaccatgagtaaagttggtattaatggttttggtcgtatcggtcgactggtgttgcgtcgattacttgaagtcaaaagcaacatagacgttgtcgctattaatgatctcacttccccaaaaattctcgcctacctgctgaaacatgattcaaactacggaccgttcccctggagcgttgattatacggaagattcacttatcgttaatgggaaaagtatcgcggtttacgccgaaaaagaggctaaaaatattccgtggaaagcgaaaggcgcagaaatcattgtcgaatgtacaggcttttatacctccgccgagaaatcgcaggcgcatcttgatgctggcgcgaagaaggtgttgatttccgcccctgccggtgaaatgaaaaccatcgtttataacgtcaatgacgacactctggatggcaacgacaccattgtttccgtggcgtcatgcaccactaactgccttgcgccgatggccaaagccttgcatgacagtttcgggatagaagtcggcacgatgacaaccattcatgcctataccggcacccagtcactggtggatggcccacgtggtaaagatttacgtgcttcacgcgcagcggcagaaaatatcattccccacactacgggggcggcaaaagccattggtctggtgatcccggaactgagcggcaaactgaaaggtcatgcgcaacgcgtgccggtgaaaacaggttcggtcactgaactggtgtcgattctcggaaagaaagtgactgccgaagaggtgaacaacgcgcttaaaaaggcgacaaacaataacgagtcatttggttatactgatgaagaaatagtctcttccgatatcattggcagccatttcggttcggtgtttgatgccacgcaaacggaaattaccgccgtgggcgatttacaactggtgaaaacggtcgcctggtacgataacgaatatggcttcgtcacgcagcttattcgcaccctcgaaaaattcgctaaactctgacgcgcacaggcggaggaaaaaacctccgcctctttcactcattacgactgtaaataaaccacctgggtctgcagatattcatgcaagccatgtttaccatctgcgccgccaataccggatttacgccatccagcgtggaagccttgcatagcttcgaagttttcacggttgatgtaagtttcaccaaacttcagccctttaatggctttcatcgcgacgttcagattttgggtatagattgatgaggtcaggccgtaatcactgtcattagccattgagatagcctcttccagcgtgtcaaatgcgaccaccggcagaaccgggccaaaggtttcctcatgcataatcgacatttcctggcgaacatccagcagcaatgtcggcggataataatatcctttcccctctaccgctttgccacccaacgccactctcgccccttcttctactgcgcgcgccactttttgctcaaccctttccagcgccgcggcgttaatcaacggtcccatcgcaatgtcgttgcgttcagcggggttaccaaattgaaccgcctgcatcgcttcccccagccgattgacgaactgatcataaatgcttttctgtacataaacacgttctgcacagttacacacttgcccactattaatgacgcgtgaatcaacgatggctttgactgccagttcaagatcggcatcgtccattacgatagccggtgctttaccccccaattccaggcacactttggtgatgtttttcgccgcagtcgccataatcttttcacctgcagagacgctgcctgtcatactgaccattgcgacctttgggttacccgccagttcttgcccaacggtttcaccacgcccgagtacaaggttaaacacgccgcgcggaaggcctatttcatcaacgattttggcgaatgcaatcgcattgtttggcgtaaattcactgggtttaatgacgatggtattaccggtcaaaagagcgggagccattttgcgggcaatgaggaagaacggaaagttccacggcagaatgccggtagtcacgccaagcgcacgtttaaacagaaggatattttctcctggacgatcgctttgaataatctcgccctcgtaacgccgtgcccactccgccatataatcgatatagtccgcagtaaaagccacttcgacttcagccaactgctggatcttgcccccttcttcgacaatcagcgcactgatttcactggcacgttcccggatcccggcggagattttgcgcaaccaactggcgcgttcaatagcaggcaacgcttcccattctggttgtgcacgttctgctgcatcgattgccttacgggcatcctcggcctgaccatcgggaatgcgggaaatgacaacctctgtagcagggtttaccacatcaatccatgcgtctccacgccaggtaacaaactgtccatcgatatacataggatgttgaacgggtactgacatgggcgactcctgtgatttgcatgtttgtttttggtaaatttattgttaattaacatcaattatcagagagacggcatcgtgaaaggacaattctgtgaagggcttcataaaaacaagtgtaaaaggaattaaaggcagaaataaaagtcagaagtcatgcccgtttgcaaacaattggttcacgaacgggcaatttttaacgtaacgagcgactttccatcgcctcgatgagcaccgcatcgtgtttcagcgtttgccatgcctggatgacttctgccggaaaatcaacgtgaacgataaaatctcgcccgcgggggccgtagccatcgctatcatcgcgtaaacgcggcagctcgccagtgagtagcgatagataacgctcaaccggccataatccttgcaacggattaacaaagattacactgtctgcgttatttcctaactgaggaacgaatccgggataacttaaccagcgtggtgcatcgggattatccccggttatacggcggaacgtcgccatcgtgcgccgctgcatggtggggtcctgaacaacgatagccgtatgaactcgttctacggcctgattcaatagcgcgatgctaaagcgtgcgttttcaccgcagtttgttgactggtcttcaatccagattttttcatgcggaatatgccagaactgatgagcgatatccgccaggatggtagcttcagctctgccagtggtgcggatagtgttgtagtgtggatgctgtgcgatggcgctatacaaaaaagttgtcgagtgaccgataccaccactaatcagtaaaggaatttgctgatcgcgggcaatcttacatgccgcatcgatagtcggcataaccgcattgcctgcaaggatcacgcaatcggcctgatacggcacctcaccggagaaatcatcctgcgccagccactgtccgataacatttatggcatctatggttgccggcgaaagcgtcggaaacggggtaatattcatggttcctccttatcgttcccttaagaatactgcgtgagataatagtgagaagcggagcactctgaaaggaggaagtcgtatttccttaactgccactccgccagcctgacatatcttttaaggaaatgctgtagataaacattattcatcttgcagcagagaattgtatttttctgaactcctgaatcttttcccttatcgtttttagaattaataaaaaacccggcgctaaatgcttaccgggttttagatttatcaggcaaatagcagtgttaaccgctaatctgctccatcgcctgcaaaatacgcttatccgaaatcggataaggcgtgccaagttgttgagcgaagtaactaacgcgcagctcttctatcatccagcggacctctttcacgtcttcatcctcacgacgtgcaggcggtagtttgttgatccattgctgccacgcctgctggacgttttcgactttcagcatctgagcacggtcgcgatgtggatcaatcgccagtttttccagtcgtttttcaatcgcctgcaaataacgcagcgtgtcgcccagccgtttgaagccgttaccagtgacaaaaccgcgatacaccagcccgcccatctgcgctttaatgtcagaaagccccagcgccatggtcatatccacccgccctttcagacgtttgttgatattgaacaccgcagtgaggatttgctcgacctgcttcgcaatatccaccaccgtgtcgttcagttcagcgcggactttttcatgcagcgcagcaaagccttcttccgtccagaccggaccgccgttggcgtcgattaatttatccacaccgcatgagatacagtcatcgatcagctccagcactttgccatacgggttaaagtacagccccagcttggctttgtttggcagcttttcgtgcaagtacttgatcggcgatggaatatttagcagcagtaaacggcgaagaccgctccacattgcctgcttctgttccagcgggttatcaaacagtttgatcgctacgctgtcacgctcatccaccagcgccggccaagccttcactttgtagttgccgcgcttctgctcgtagctttccggcagttgaccaaaactccagatatgtaaaccgctctgctcgataccgtcatccgccacggcagacagcgtttcctgcactttgcctttcagggcgtctttcagatcctgtaatgagcgcccttcttttagcttcttgtttttgtcatccaccacgcggaaagtgattttcaggtgatcgggcacctgatcccagtgccagtcttcgcggtcaacggtgacgccagtcatccgccgtaactctcgttcaaggctgtcgagcaacggcaattccagcggtgtgacgcggcctaaaaacgcttcggcgaagtttggcgcgggcacaaaattacggcgtaccggcttcggcagcgatttaatcagggcgatgatcagctcacgacgcagaccggggatctgccactcaaacccactctcctcaacctggttaagtagcggcagcgggatatgcacggtcacaccgtcagcatccgcgccgggctcaaactgatagctcaaacgcagtttgagattgccctgatgccagaagttcgggtaatccagtttgctgattttttccgccccttctttgatcaacatgctcttttcaaagttgagcaaatcaggcgtttcgcggctgacttttttccaccagctgtcgaaatggcgtgcggagatcacatcgtggctgatgcgctggtcgtagaactcaaacaacgtttcgtcatccaccagaatatcgcggcgacgagttttgtgttccagttcttccacttcggcccgtagtttcaggttttcacggaagaatgcgtgacgcgtctgccagtcaccttccaccagcgcgtggcgaataaagagttcacgacataacgccggatcgatctggctgtagttgaccttgcgcgcggcaacaatcggcaaaccataaacagtgactttttccgttgccatcaccgcgccctgcgcccgttcccagtgcggttcgctataggtgcgtttaatcaaatgctgagcaactggctccacccattccgggtcgatccgcgcagcaatgcgtccccacaggcggctggtttctaccagttccgccaccattacccatttcggcggttttttgaataagccggaaccggggaagatggagaaacgcgcgttacgtgcgccggtatattcttgtttatcggcatctttcatgccgatatgcgaaagcaaaccggtcagcaacgcaatgtgaatttcgcgataatccgccggttcgctgttaaccggaatgccaagttctttcaccacctggcgcaactgggtgtagatatcctgccattcgcgcacgcgcagatagttgagataatcagtacggcacaggcgacggaaggcgtttgaagaaagcgccttttgctgctcgccaagataattccacagattcacaaacgcgaggaagtcagactctttgtcgtggaagcgacgatgtttttcgtccgatgcctgctgcttgtccattggccgctcacgcgggtcctgaatagagagcgcggaagtgataatcatcgcctcacgcacgcagccatgtttttgcgcttccagcaccatacgcgccagacgtgggtcgacaggcaactgcgagagctggcgaccgagcggcgtcagtttataggcgctggcctgttcatccgtggtgatcgcgcccagttcttcgagcagacgcacgccatcctggatattgcgtttatccggtgcttcgacaaacgggaatgcggcgatatcgcccaagcccagtgcggtcatctgcaaaataaccgaggccaggttagtacgcagaatttctgggtcggtaaactccgggcgcgagaggaaatcgtcttcggaatagagacgaatacagatcccttctgacacacgaccgcagcggcctttacgctgattagctgaagcctgcgaaattggctcaatcggcaaacgctgcactttggtgcgatagctgtagcggctgatacgcgccgtacctgggtcgataacgtatttaatccccggtacggtcagcgaggtttccgcgacgttagtcgccagcacaatgcgccgtccgctgtgcgactggaagacgcggttctgctcgctgttcgaaagccgtgcataaagcggaagaatttccgtatggcgtaagttcagcttgttcagcgcatcggcggtatcgcgaatttctcgctcgccgctcataaaaatcagaatgtcgccagggctttcctggctcagttcatctacggcatcgaaaatcgcctgcaactggtcgcgctcggtgtcatcagcttcttcaacaatcgggcgatagcgcacttccaccggataggtccgaccggagacttcgataatcggcgcattattaaagtggcgcgaaaagcgttccgggtcgatagtcgcggaagtgataataatttttaggtcaggacgccgcggcagcaactctttcaaatagccgaggagaaaatcgatattcaggctgcgttcgtgcgcttcgtcaataatgatggtgtcgtactgcatcagcaggcggtcttgctggatctctgccagcaggataccgtcggtcatcagcttgaccatcgtgttatcactgacgtgatcgctgaaacgcactttgtaaccgatgcaaccgcccggctccgtttttagctcttccgcaatacggttcgccaccgttcgcgccgccagccgacgcggctgggtatggccgatcagccctttaatcccgcgacccagctccatacagattttcggtagctgagtcgttttaccggaacccgtttccccggcgacgatcaccacctggtggtcacgaatcgcttcgagaatgtcctgttttttctgactaaccggcaaattgtccgggtaagtaatctccggtcgtgccgcttcacgcagcaggactttccctgccgcatggtcaatctctttcgccatctcctggaaaatggcctgttgtgcatcaggatttttaaccttcttcacgccgtgcagacggcgagaaaaacgcagtctgtcacgcagcatcagcgaatccagccgctgctgcaaggcagtaaaggtcaatttttgttgttctgtcataacgttagtgggcagtagtctgcctgattaattttcttttaaatgatagatatagagtaccacatcgcggctttctatgcgttgttcaataaattcgaacataggcttcgatttattgcgctatctctgtggcaggattgtgaataaagtgtcaacaagcaacggggcattgcccattcaaatatctataaggaaacaccatgagcaaggtattagttcttaaatccagcatcctggcagggtactctcagtctaatcagttgtccgattattttgttgaacaatggcgcgaaaagcactccgctgatgaaatcaccgtgcgtgacctggctgcaaatccgattccggtcctggatggcgaactggttggtgcactgcgtccgagcgatgcgccgctgactccgcgtcagcaggaagctctggcgctttccgatgagctgattgccgagctgaaagcccacgacgttatcgttattgcggcaccgatgtataacttcaatatctcgacccagttgaaaaactattttgacctggttgcacgtgcaggcgttactttccgctataccgagaacggtccggaaggcctggtcaccggtaaaaaagccatcgttatcaccagccgcggtgggatccataaagatggcccaacggatctggtgacgccgtatctgtccacattcctgggctttatcggcattaccgatgtgaaatttgtcttcgccgaagggatcgcgtacggcccggaaatggcagcgaaagcgcagtctgacgcgaaagcagccatcgacagtattgttgctgcataaccggacacgatcttgatgtggactgtagatattcagtccacatctcaatccgcttacctgttttcccataatttcagcatcgctttgtgctcttccttaagcacaatccgcgagcgtctggctcgaatataactaatcgcttcatcaacggttttacaatgtccgtaacataacagccatgccgccaccaccagcgcactgcgcgataatcccaacgcgcaatggaccagaacgctgccttgctcttcgcgtaatgtttccagcatcgccacggcctgtcggagctccccctcttccggaaccacccgatccaacatcggtacacaaaaatagagtcgatcttttgtcgctcgtccgcgagggaattcaaaggtgacgtccagaaccgcattctgtgccggaatatgtcgtggaaacgcccctaaataaacaccagcagtaattttgctcaccggctccaggcgaagacaaaaccaacgcatagacagccacatcccgatacgccagggcaatgtcagccagtaaacggcgggcgggagtttcccctgactatctttccctgttgttatcgcgccaagcccaccgtacccacggccaatgatgaatagcgataatactggccaacataaccagactgaccaccataactgaagcattatcattagctccatcaacacaatgcacgagcacgcgcctgcgacatatggcagtgctattttgattcgacgttgatcaggtttctgataattccaacgacggtcgacgggcaccatccagtcaattaacatacctaccgccagccccgtgatgacatcaataaaatgatgctgccaggtcgtcagcgtcgaaatggcgatgagtaaaaaccatccgccgcagactttacgccacctcacagccagatgctgacgaaagtgacgccaaagtagccagcagagaataatatgcagcgaaggagactggttataaggcagatcaaacagttcaagttgcgaaaatagccatcctgtcaccccactcacttcaggacggataaaactaaacttcagcggatagagaaaaaaaccgcagcaggccattaccgttgccagaataagccggtgaaccagtcggcgctgttcgaatgtcgagctacaaatgaacagcgaaaatccatataaaagatccagactccagtaaggaacaatagtccagggaagaaaagggatcgccgtttcccaaccgaatacctgactggggatatcatggttgttaagatcctgagtcgcggtgaactgattaagaaatccatatgtaaagaagaaaaacggggccagcaacaataaccagccagctccttgtagcaatacgttccggcgttcagttatcacgacgcaccgccatcgaaaccgtaaaaatgccccacacatcaatccgttgtgtgcatttatcgaatccggcatcatgcacgagcgaatccatctccccttgcgaacgcacgcgcattacccacggtttaccatctttatgactggttaacaccccggcaatcagctccagttgtgggtgccacggctgcccggtgtagatgagaatgccacccggatcgatggcattggcaagacctgcgagtgagttttttacctgctcattttcggggaaaagctcatacaggccagagacaatcgccagcgtaggccgcggagttaacgcgctgagttcctccaggttaaacgcatcgccctgttcaaaacgcacccgcccagacattccccgttgagcaatcatctcttgcccctgtgcaacatttaactcgctgtaatcacgtaacaaaatatcgcttacggcaggctcgtttgccagcgcatccagtacatagcgcccatgccctgcggcaatgtcaaccacgcggacggctaaacctttggcgtggagatgggcaacggcttgtttaatcagcatttgtaaatgggttttgcgctggcgaataccgcgccagccaacactgttcaggtagattttgtcgataaagcgcccgaatgcgttactgccttgcggttgattttgatagacataatccagcgaactgcctgaatcaaagccggtactcattccgagatgcaggcccgcagagtgcgccccgaacagtttcatcgcctttcgcataaagcgatacgccaaatcaaccggcgataacggcacgggtccaccagaaaggagccgccagcgatccgctgatggtcctgtgcggtcttcatgctgataatcaaatttttgcgacttgttagcatataaacggctgataaagctttgcattttttcaaatgcctgcgccctgttctcttcacccaacgtgtcgtgataaaagcctggcagcagatgcagctctttcagaggactacgtaaacgctgataaaaatcaatctgcggttggcgatgcaccacatagtcatcgcctgatatcagaagttgcgtggggagcgtaatcgccgccgcatcgctaacaatacgttcagacgttttatagagatcgagcaagatattgacggcaatcgcccgtgtgatcagcggatcattattgaaactcgccacccgttgccgatcgtgggtcagataacgccctttcacataggaattaataaaaaacagaccacgcagacgatgccataacgccagcccaggacgtgccagcggcacatacaatttaaccttaaaggccggagatgccagcactagtccgcgaatagcaggcgcataatcatgaacccatgtggcaaccatcactgcgccgacgctttgcgcgatcacaaccacctcttccagtccgacctggctgtcgctggcagcaaaacggacaaattcatcaacatcctgcactgaacgcgcaagagacggactataaccacgcggccccgaagtttgtccatgccctcgggcatcccatgcataaaaagcagtatctggcatcgccagttcatcaacgatatgttgtagacgaccagaatgttcatgaccgcgatgaaataagacgatgacctttttcgcccctggcagtaaagtgggccagtgccgataaaacaacgctgtattatcactggtggtaaaaaaatgctccccagggatgcgtgaattttccattttctctgttttccttcagtaacagcagtagcgaataaaataaaaaaataccggagcggtgaaaattaatgagtcaatcctgtcaaggagtccgccatgtcctggtaatagttttccgctatctttaacaccaacatctcgtttggtggctgacatcactacatcgccgcaaaaaccactaataccaattaacaaacccgctaataatacctgtaatgtatttagcggtgtcagtaacggtccaataatcagtgacgcaatcatggtggtgattactcctccaaccagaccttccagcgtttttcccgggctgactttggggaccacttttcttctgccgcagaattttccccataaatactgtgcaatatcgtttgactcggttaacgccaaaagaaataacaccagtaacgccccgccctggatatttatggttggcaacattaataaccaggcggcatgactcaaggtgaaaacggtcattatccagccacaaaaaatggcactcacggtatgcagaaaaccagaggggtcacctacaaaaactcgccaggtggctaatatcagaaacccagccaaaggtataaataacagaaacagctcaaagcaattaaaaccgataagcaaatagttaagaggaataacccaatataaccaacgcggaaaatgtacggatataagcgtacaatattctttcaatgccagaaaacttatcagcgcaaaaaacgtcaacgtcatccagcgtggacctgaaatcaccagtgaaaaacaaatgacgatgccccaccaggtacgaatacgtaatgttacttcatcgccttttctctccggtaaccgccataccagaaaacggtttatcagcgttgctaaaattaacaacgcgaagagtattgccagagatttttccagcattatctttcagcgctcatcaggagcacacttcgacaacgattaatcgcagtccagagaagcagaattgaagcaatgctccataaaagattattccattgcatccattgtggataaatggcaatggccagcccccacagaccaaatattaacgcgcgatcgcttttgccaaatggaccgacataactacgaataccgttaatcgtctgcgcgagtaaaccgcaaaactcggtcaatatggtgcaaaataacatgagtattacgagtgatgcgttactttccggtaaaaataaaaacggtaaatagagcgcaatatcggaaataacatcgccagtttcattcaaaatcgcccccagacgtgttttctgattgcactcacgcgccaacatgccatccagcgcattgagcgtcatacggataaaaagcacgatgggcaatagcaaaaagaggatgggttgtgccaccaacaccaacagcaatccggtaagaagagaaagcgccagtgcagcaagagtgatgtgattcgctgtaacatggtgcttataaagccaaaacatcgtcggccttaacagcgactgaaagagcggttttatctggtagagcgtcatttatcattccgtgatattcagtttgctctatggtgcatcaattccgacggcggagatatcacaacgcgcagcatcaacgtaaattcggaatatatcaagatgtggtggatgaatgccctacacatctgtttgattaccgtctggatatcagtgagataccatctatcactgtacgaatcaatgaatccatcgccttttcactgattatccagccgcaaatcctggccttaaacatatgcactccatgccattaaaaaagaaacaaaagggaaatgcatctttcccttttgtatattcgttattctcgcgaaataccatccaacgtagacaacactttctcagaaagatgcaatttttcagcagccatattctcccgtaaatgcgcaacagaagatgttccaggaatcaacaaaatattcggtgaacgttgtaacagccacgccagcgccacctgcattggtgttgcacccaggctcgtagcaacatcggaaagcgtggaggattgcagcggcgtaaagcccccgagcggaaagaatggcacgtaggcaatgccatcacgagccaaagcatcaatcattgcgtcatcagcacggtgggcaatgttgtattcgttctgcacgcagacgatttcggcaatctttcgcgcctctgcaacctgcgtcggtgtgacgttactcaggccaatatgttttaccaggccttgttgttgcatctccgccagcactgtcaggctggcctcaatcgatccttccgctgggccatgaccatcccccatcataacgcgcaggttaaccacatccagtacgtccaggccgagattacgtagattatcgtgtaccgctttttgcagctctgccggagaaaatgcgggtaaccaggaagcgtcctctccacgccgcgcaccaattttagtgacaattgtcaggtcgtcagagtacggataaagcgcttcgcggataatctgattggtgacgtgcggaccataaaagtcgctggtatcaatatgattgacgcccaatgccagcgcctcgcgcagcacggttatagcgacgtggcgatctcttggggggccaaaaaccccaggaccagccagttgcatcgcgccataaccaagacggttaacggattttgtaccgagagtaaatgtgttgctgctcatcgcaccctgccctgtaataaaacggattaagaaaaatcagtatagaaatgaatagagataaataatgcgagggtgtaaacaagattgcgggatgagttgtactgttgccctgaaagacacgaaaccccagaaaggttaagacacgtcaagcaccgcatccggcaataaaaaaaccgcaacctgtatcagcgttgcggtttatgtattacatgctaaaaattagaacgttttcttgaagtttagcatcacacctttatcactgatgccgtcttctttccagtggaatgcatctacctgcaacgcactttcctggctgctgtatttcacacccatcgtcgccaggctgttgaaaccaccgccactctgaccatcgtcaatgttaaaacgttggcttccagcgcccgaaatactcgcagtacgttgacttttcacatagctcagattcggcccaccttccagcgtggcgttcgcactccagccttctttccctgcatagtccagtttcagcccaacgatgctgtccaccgccgtttcgctgccgctgttcatgctcaggttaaagtcacccgcattgcgttcctgatagccaccttccagtgtgtgacgcagtttaaccccggcatatggagtgacgttcagcccttcacgcagctcaaaggtttttgctccttcactacggaactccaggtactgttgtttcacattagcatcagcggttttgttgacgtcgccgtaagctatcgagcgactgctgtcgagctggtgcacatcataacgcagggcgttattccagttcataccgttgtcaaaggccatctggtgtttcagaccgaagaactggctgtaaccgcctgtcactccgttatcgcctgcggtatctgaaccattaccctccagacgagcaatcccgtattccagactcaggttctgatgttcagtcagcgtcagagatttacgcagcgccatcatgtcgtactgtgtgtcgttacccagttcagcacgcgggtcgcctttcgctaccacgttgaaggccagaccgtttgcaacttccggtgctgcatcggacaacatgctgaagcggttacttaacactcgtgcttcattaaataccgttgttgcctggctgccgctaatttgtttcagcgcactgttcagttcagcagtcgttcctacgttcagactagtgtacaggtcgttattggtgtaacccgtatccagtacctgagcgacattattaactgaagaatccgtcacaacatccgtataggcgtttttggtcatcgtgacgtctacgttgccattagcatcggtgttaccttgtgcgctccacacgacagaggtcgatgtaatggtatcagcatccgtaagattgttaccttgaaccacattatcgaatgtaacagaagtcgcacttgttcctgacgtaaatccagtgttaacggaaacacccttcaggcttgcattgctcactttcaacttacctgcgctgccatcagaactggttcccacaacatagccatttaggttgttctggcctccattatctgaaacattgtcggtagatacgaaaactgacgagccgggcacatctggcagtgtgtaattagcataatgcacttcactattattgccgttattgccattgacaccttcaatgttaacgctattaccttgcttaatcagcccggaccccgtcaccccatctgcaatggttaccgtaccgttattcacgaggtggcctacggaacctagcatactaaacgcaaaggaattattagcgtatatgttgatagtaccattattctcgatcaccgcatcagccgtcgcactgctatccagctgcatacctatcataccggtatctgtcgtaccttgtgctccaagattaatcgtgccgttgttaatcaactgtgcatttttattcccttccatcgcaatagcgttattaccgctaatattcatggtgccatcattctgtgcaacataattactgtgggtgaatttcacagcaacgccgctgtctttatcaaaattgactataccactattttggttccagaagtatgcatggttggtactggcatcaacaccgctggtcgctagcgcttttgcagtaacatcaactgtaccactattaatgaaccgtccattattattcgcgttccagtaattaattgcgttaccgctatagttagcaccagaaattaacatatgaccggtattgtagaacgacccagactgatataagtgaatagcatttctgctgttatttagaatgaagtcaccgctgttgttaaacaccgcagtattataaatctccatcatgctggcattattgctatcactactactgctggcaccgagataccaggtaccctcgttattggtgattgcagttttactcaggttagcaccgttttgcacgaccccaccttgctggttattaaatgttcctcctgtctggaacatgcgcgagttaaccgtaccggtgttcccgaacgtgcctgcgtttagcgtcaccttcgccacagagccttcgttacttaactctccatcattgataatgatggcattattaatagtacccgtcgatgtattaactaattcaccgctactaatcgcaatatcagcaccggaaagcgaaccactgttaacaacattgccttcttttttgtcgttaatcgaggctttttgggtcagattttgtgtttcattctgcgcagtgattacatcgccacccgtgtaaagtaacgaggtataagagtcagtctcattatagtcattgcccgtcaggcaattagtgttaacacaaatcgttccatagttaagaatagtaccggatccatcactataaaacgcctgcccattgtcagcattgatattaattacgccagactgttcattaatggcagtaccactcttataggcggccataccgatcagagaatctgctcccagactactatcgtagttagcgtttttctccagattgatgataccctcgttaatcacggtattgctggcaccgtaggcggccatacctattccagcattataaaccgttattacaccaccctgtttattaacggccgtagcattttttcttggcccactgtaagtatttgtacctacggccataccaacgccatagctcctggcatcattaccaatattgctacgcaaagtggtggtatcatctgcatcaacccacagggcatccagtgtaatttgcccagcgttttctgctgtactctcatcaatagccaacataccaacgttgccgcgaccatacatctcaatgctgccaccgctttcattggacacgtatccgtgatcaaaggcatcaagccccatcatactgttcgcatcagagtagaaagtgttcgcctcattcagacccagagacgcccccaaattaatgacactttcttgttccatgactttcgcagtaatcgtaccattattaaccgcactaccgcctttagtcgtgaaatagccaactcctgcatttgctaacaagccatagttgtactgagaaagcgtaatattgccactgttacttcccgttgaattttcaccagaaatagcggcaaaaccgatatttcgagtatcaatatcacctttattgactaactcagcaccagactctacaaagatcatttgggattcagatctcgcatagtggtcataaatatctacctgcatgttaatcgtggcatccgccccgatctcaatcatggcgctattcttcaaccgaatcatccctgaataggctagaggtaaatcaccattaatcgtggagtccccgttcaggtaaacagacgacttcccatcaacagtgattactggtgttttgccatagccattgcgatttgatgcgacggtagaaccatcagtcaattgattttcttcaccaaccagctggataccaccattcagatacacggtattatcatcaccagatacgacaagcccggaaatattctcctggcttccatcaaagtcagcataaatacgtgaggtaagttcactgtcagccaccacagttaacttgccgtctagcgatacagtgttactgttgccgctaacgttcacaccaatagacggttcgtaaaaataatctaccgcgttagtcgcggtttgatctttatctaccaaaatgttaccagtgatatcaacggcattattgtcaccagagatgttgacgcccgttgccttctgcccgataacgttcagatctttcgccgccaacgtcacactgttgttattaccactgagcgccatgcctgttgaaaagtcaccaacattcatgctacctgcctgggagatggccccctcgctggtcgtgatgctcatgccagtagctgaattattgacgtcaatatgacccgtattggcaaaggtcgctcgatcaccgttaatcagcacaccaaccgaatctttatccgtgacagttatattgcctttattgattacagtggcgctatcaccagtgatatcaatgccgtgaccgccgccgctcacatccagtaagccgtcctgattcaccaccgcgttattacccgcgatttcggtaccggtcgaaccctgaccatcaacggtggtattgccgctgttgttggccgtcgcatcatcacccgtaatgcgggttccggtgccgccatcaaggatcgtgctgtcaccgtcgttgttgacaatggctttgtcaccgtttatctcggtgcccgtggaatccttgccgtcaacggtggttttaccgttattgttcacggtggcttcatcaccgttaacctgcgtgccggtgccgccgttactgatggcgttgtcaccttcgttattgacaactgccttgtcgccgtcgatctgaataccgatggaatccggatcggtgacggtcatgccgcctttgttgtccaccgtcgcgctgtcgccggtgatatcaataccgtgaccgccaccgctgacatccagtgtaccgtcctgattcaccaccgcgttattacccgcgatttcggtaccggtcgagccctgtccgtcaacggtggtgctgccgttattgtttacggtggcttcatcaccgttaacctgcgtgccggtgccgccgttgctgatggcattgtcaccgtcgttgttcacgaccgccttgtcgccgtcgatctgaatgccgatggaatccggatcggtaacggtcataccgcctttgttatccaccgttgcgctgtcgccggtgatatcaatcccgtgaccaccgccgctcacatccagctcgccgtcctggttcaccaccgcgttattacccgcgatttcagttccggtcgaaccctgaccgtctacggtggtattgccgctgttgttggccgtcgcatcatcacccgtaatgcgggttccggtgccgccatcaaggatcgtgctgtcaccgtcgttgttgacgatggctttgtcaccgtttatctcggtgcccgtggaatccttgccgtcaacggtggtgttgccgttattgttcacggtggcttcgtcgccgttaacctgcgtgccggtgccgccgttactgatggcactgtcaccgtcgttgttcacgaccgccttgtcgccgtcgatctgaatgccaatcgaatccggatcggtgacagtcattccacctttgttgtccaccgtcgcgctgtcgccggtgatatcaataccgtgaccgccgccgctcacatccagctcgccgtcctggttcaccaccgcgttgttacccgcgatttcagttccggtcgaaccctgaccgtctacggtggtattgccgctgttgttggccgtcgcatcatcacccgtaatgcgggttccggtgccgccatcaaggatcgtgctgtcgccgtcgttgttgacgatagctttgtcaccgtttatctcggtgcccgtggaatccttgccgtcaacggtggtgttgccgttattgttcacggtggcttcgtcgccgttaacctgcgtgccggtgccgccgttgctgatggcgttgtcaccgtcgttattgacaaccgctttgtcgccgtcgatctgaataccgatggagtcaggatcggtgacagtcatgccgcctttgttgtccaccgttgcgctgtcgccggtgatatcaataccgtgaccgccgccgctcacatccagctcgccgtcctgattcaccaccgcgttattacccgcgatttcagttccggtcgaaccctgaccgtctacggtggtattgccgctgttgttggccgtcgcatcatcacccgtaatgcgggttccggtgccgccatcaaggatcgtgctgtcgccgtcgttgttgacgatggctttgtcaccgtttatctcggtgcccgtggaatccttgccgtcaacggtggttttaccgttattgttcacggtggcttcatcaccgttaacctgcgtgccggtgccgccgttactgatggcactgtcaccgtcgttgttcacgaccgccttgtcgccgtcgatctgaatgccaatcgaatccggatcggtgacagtcattccacctttgttgtccaccgtcgcactgtcgccggtgatatcaataccgtgaccgccgccgctcacatccagctcgccgtcctggttcaccaccgcgttgttacccgcgatttcagttccggtcgaaccctgaccgtctacggtggtattgccgttattgtttacggtggcttcatcaccgttaatctgcgtgccggtgccgccgttgctgatggcactgccaccgtcgttattgacaaccgctttgtcgccgtcgatctgaataccgatggagtccggatcggtgacggtcataccgcctttgttatccaccgttgcgctgtcgccggtgatatcaataccgtgaccgccgccgctcacatccagctcgccgtcctggttcaccaccgcgttgttacccgcgatttcagttccggtcgaaccctgaccgtctacggtggtattgccactgttgttggccgtcgcatcatcacccgtaatgcgggttccggtgccgccatcaaggatcgtgctgtcaccgtcgttgttgacgatggctttgtcaccgtttatctcggtgcccgtggaatccttgccgtcaacggtggtgctgccgttattgttcacggtggcttcgtcgccgttaacctgcgtgccggtgccgccgttgctgatggcattgtcaccgtcgttgttcacgaccgccttgtcgccgtctatctgaataccgatggagtcaggatcggtgacagtcatgccgcctttgttgtccaccgtcgcgctgtcgccggtgatatcaataccgtgaccgccgccgctgacatccagtgtaccgtcctgattcaccaccgcgttgttacccgcgatttcagttccggtcgaaccctgaccgtctacggtggtattgccgctgttgttggccgtcgcatcatcacccgtaatgcgggttccggtgccgccatcaaggatcgtgctgtcaccgtcgttgttgacgatggctttgtcaccgtttatctcggtgcccgtggaatccttgccgtcaacggtggtgctgccgttattgttcacggtggcttcgtcgccgttaacctgcgtgccggtgccaccgttgctgatggcactgtcaccgtccttattgacaaccgccttgtcgccgtcgatctgaataccgatggaatccggatcggtgacagtcatgccgcctttgttgtccacagttgcgctgtcgccggtgatatcaatcccgtgaccgccgccgctcacatccagctcgccgtcctgattcaccaccgcgttgttacccgcgatttcagttccggtggcgcctttgccgtcgacgatggtttttccagtgttgtttactgtggtattgtcgcccgtaataacgagctcaccgttgtgattatattgccacttcgttgcaccatctgcgctcatcccttcaagggcaaccgtgttattcgtttcatcaatctgccaaagattaatagtcgccttacgcccattgctatcttgcagagaaatagtcccatcagcattctcggtataactgaaaactgaatcgcgaatagttaacgttttttctgttttatcgaggataacgtcattattaaacgcaatcggtttgggaggcgtcggggtatcatccggaccatcgtctggtattatctcatctccgccaggagttggaggaactggagtgtcgtctgaatcatcatcaggtggagttggtggaagtggagaattattgcgatgatgatcatcatcgtcgtttagttccactatggctaaggttgtgattaacgcagtagcagcacctgtgacaagccatggcatcaggttctgttcgactacagaggagcattcagagggtaagcgtttaagctcttctggactgagttttccaggatctgctggacaagtcacattggtatttttcttttcacctgtggtggtttctatttctgtaatatctgccgcccaaccctgaccactcagagctaatgcaatacaggccgacaatagagttttcctttgcataataaatccttctggcgaatataaagaaggtcggataccctgacccgaccaattgattatttaaaacatagaggacgtccaatattgccagtagattgttacctaatcaaacatattctctgacaatctggatttataatacagagaaataaataaacccgcgaaacatacaaattatgtatattatataaattataaattcaaatgcgtcacatagatatttatttaatgaaaaaagggtataaaatcaatactcgaataaataaattagagcggaaacataactcatccttataattaaaagagaaaaatgtttccggaaaatagattaatcgtcttctcctgtagcgttatcccgatattgcggttttgctattaaaattttcgcacccatttaccgtttatcccttgtacatattccccgggtttggcccgttctacaagcttttgcccggcgagtttcgcgatatcatccaccgacacattattctgctttgccagttgttgatagctcgctttacgttcggcattgatgtcggttactaatttctcagtttcagcatctgttttcagcgcaaccagataaccataaaatgtttcgcctacccgcccctgagttctggcttcatccagagtcaatgccattacattgctgcttaccaagccaacaagaaatgcacaaagaagtaatgttcttttcatcatcacctcaaaaaagatcgctacgggtctcaagcagctcttcgacatctttgtctgccttgatgatgatctcatgctcaattttaacgttcatattgatagtgatcggttccttaggtgcagcgacttcaatgcgaggcgtacagccaaccagcataaaagatgacgtcaacgcagccagtaaaattttcattgtttatcctcacactcttttccttgcggacagtcatttcccggcagacgcgcgttctgctccagccatgcctggagattatcgccaaagcgtaaactgcgccacagcgtaaaaatattctcttcatgatggtaattaagatttaccgtaccgcttttaccatcaacgcgactggtacctgtaatattggcctgcatggttaataaaccgagattatctaaattaatttttgtcgatgaacggctaatttccatatagcgcaaccagttaattgctgaatccgcggtcatattgtctttcaccaccgcatctgcggtgtctttatccagccgcaaggtcatcggcccgctatttgccagccagccgtctttcactatccatttttcgttgtttagccataacggcaatgcaccactaaatgccccggacatggcgaattgtttcggattgacggcgctaaccagttcgctggaggaaagattattcagccgcaacagcgccgggtcatgttgcggcatacgtaattgtttcatcagcacgttaccgcctaacacatcgacgctaacatcagtcaacagcaatggttcttcttcagtccacggataacgaccttgcaaatcagccgtaatatttttcgctgtcaccagattaatcacttcggcaattcgcaacgtaacgggaccgcgagtccccagatgccaggctccatcggcaaaacggaaaggcaggacaaaatcgacaccgttaacctgattatctggcatccaggcactaccgcctttcaatacgccgtgcccccccgcgcggaatccttgttcaggcgcagctgaaaatgcaacctgagcatacagttcaccatcgcgtaagttcatcttccagtcgggtggcaccagcggctggaatacagtcagtgattgtttaggccaccaggcgttaccgcgcagacgaataccgtcccagcgaccatttacccgaaccgggccaatctcaccagcatgtaaatcgcctttaaagaggaaatacgtcggatcacgcccatcgacactaaattttaaggttgatggcggtaacacactgccgccagtgaacagcgtttgcccggcgtccagtgacagagcgccgctgaaggagggatgctgtgcgtcacgtccccagacgacgggcttgtcgagaattaatcgcggcttttctaccgtcatcgtaccgtattgtaactggtcgaaaccggtggagagatcggtcagcgtaatcgtgctgtcatgccactcaccttttcctgcgacatcccaggtggcattcatcggtgtaaaactcccttttccccagtagcgccactgccagcggccagcgtcagggagaaaatcattcgccagcccatccatatgcagcacgaaatcgcccagttcattttcatgcgcctgcaaaatggcctgcaaacgtccgtcaacaccacgttgggtgacttttacacccgctaaaggccagcggatttcatcgatgtccagcgaatcaatgactcttccctttgaacgaagtaacgcgccaggctcaaaggtcagcgttgggtcagacagacttccacttagctgcgcaggtaaacgggcatataaaatgaggtccgcctgtttcgcttcaccggtcagctgcagaggcagctggctgttatccatgcttaattttcctgggccaaaatttaacaccgcgttgcctttacccgcttgcccctgggtcagcacactcagtcgcccgctgaccagagcgttctcgagccctgcctgccagttgtcgactttaacacccagtcggccacttaaaggaaaacctgcatacggccagctccagcgaccatcgcttacggtcaattgttgacgagtaatttgccacggcaaatcgagcaacggatcgccgttatcccgtgccagcacaatcaattgcccgctattttcctgccagtccagctcggcatccaccagtgaaggctcctgcggtaagtttaacgtcgcagtagcatgaccacttaccggaagtccatccggcacgagcggcatagtaaattcccccaccagttttaccggcggctgattttcaaacgcggcgacatccagttcgctgactgtaagttgttgccctttcagctggccttgaaatttaactttttcgccctgataacacagttgctggatatcggaggttaatgcgagagagagttttccctgccattcctgccagggagaaaaaatcagtttatcgatattgatccaggtgttaggcagcatggactgccactgcgcgagggtttttggagcggctggcgattgctccgtctgcggcaatttcgccagacaagcagaatcaagttctaccgtgccgacgctcaataaccagcgactgggatgtgaaaggctggcgttggtgatatgcgcaagctgacaatctcccaccagataacggagatcggggatgattaaacctttacgcgtaatgcgtgggctttcatctaatgcaatacgtgtcccgagcggtagccagatgcccgccagcgtgggaacccacagcccgagcgtcatcagcagcgttaacggcacaagaataatcagtaataacagcgcgagaacggctttatatttacccagcatgggtagttaatatcctgatttagcgaaaaattaagcattcaatacgggtattgtggcatgtttaaccgttcagttgaaggttgcgcctacactaagcatagttgttgatgaatttttcaatatcgccatatctttcaattatatttgaaattttgtaaaatatttttagtagcttaaatgtgattcaacatcactggagaaagtcttatgaaactcgccgtttatagcacaaaacagtacgacaagaagtacctgcaacaggtgaacgagtcctttggctttgagctggaattttttgactttctgctgacggaaaaaaccgctaaaactgccaatggctgcgaagcggtatgtattttcgtaaacgatgacggcagccgcccggtgctggaagagctgaaaaagcacggcgttaaatatatcgccttgcgctgtgccggtttcaataacgtcgaccttgacgcggcaaaagaactggggctcaaagtagtccgtgttccagcctatgatccagaggccgttgctgaacacgccatcggtatgatgatgacgctgaaccgccgtattcaccgcgcgtatcagcgtacccgtgacgctaacttctctctggaaggtctgaccggctttactatgtatggcaaaacggcaggcgttatcggtaccggtaaaatcggtgtggcgatgctgcgcattctgaaaggttttggtatgcgtctgctggcgttcgatccgtatccaagtgcggcggcgctggaactcggtgtggagtatgtcgatctgccaaccctgttctctgaatcagacgttatctctctgcactgcccgctgacaccggaaaactaccatctgttgaacgaagccgccttcgatcagatgaaaaatggcgtgatgatcgtcaataccagtcgcggtgcattgattgattctcaggcggcaattgaagcgctgaaaaatcagaaaattggttcgttgggtatggacgtgtatgagaacgaacgcgatctgttctttgaagataaatccaacgacgtgatccaggatgacgtattccgtcgcttgtctgcctgccacaacgtgctgtttaccgggcaccaggcattcctgacagcagaagctctgaccagtatttctcagactacgctgcaaaacttaagcaatctggaaaaaggcgaaacctgcccgaacgaactggtttaatcttgccgctcccctgcattccaggggagcttattcagataatccccaaagacctttcatcctctattcttaaaatagtcctgaatcagaaacagtaattgagaaccacaatgaagaaagtagccgcgcttgttgcgctaagcctgctgatggcgggatgtgtaagtagtgacaaaattgctgtaacgccagaacagctacagcatcatcgctttgtgctggaaagcgtaaacggtaagcccgtgaccagcgataaaaatccgccagaaatcagctttggtgaaaagatgatgatttccggcagcatgtgtaaccgctttagcggtgaaggcaaactgtctaatggtgaactgaccgccaaagggctggcaatgacccgtatgatgtgcgttaacccgcagcttaatgaactcgataacaccattagcgaaatgctgaaagaaggtgcacaagtggatctgaccgcgaaccagttaacgctggcgaccgcgaaacagacattaacttataagctggcggatttaatgaattaatagctgccacagctcccggcggcaagtgactgttcgctacagcgtttgccgttgggtaatgcacacatcccaatcgccgtaccatccagttggcgggcaacagaaagcgaaccgccgatcattgcacaatttgcttctccactactggacatcgacgcttttaaacctggcgctacgtgcgccgcagtcgcctgctgaacaggttcactactacacgccgacaacaataaagcggcacaccctacccaaaacgctgctcgcatcttttcttcctctgatcttcaagccaaacgacaccgccataaataataggcagcacagagggcggcgtcgagagctgtcctgcgcgttgccccgcatttttacttttttatggctatttttttgccctctgtttgatcaaaacattcattacgctgatgtgggggacacaaaagcgaaaatgcagaagaaagccatttgctaaaattgaacgattactactgggcgcgcagcaatttcgtgcgcccctcatttgcgcaatgtaagggtgtcatatgattactattgacggtaatggcgcggttgcttcggtggcgtttcgcaccagtgaagttatcgccatctaccctattacccccagttccacgatggcagaacaggctgatgcatgggccggaaacggcttgaaaaacgtttggggagacacaccacgcgtggttgaaatgcagtcggaagcgggtgctatcgctaccgtgcatggtgctttgcaaactggtgccctctcaacatcgtttacgtcatcgcagggtttgctgctaatgatcccaacgctgtacaaactggcaggcgaactgacgccgtttgtcctgcatgttgcggcacgtaccgttgccacacatgcactctctatttttggcgatcattccgacgttatggcggtgcgccagacgggttgcgcgatgttgtgtgcagcaagcgtccaggaagcgcaagactttgctctcatttcgcacatcgcgacgctgaaaagccgcgtgccatttattcatttctttgatggtttccgcacatctcacgaaatcaataaaattgtcccgctggccgatgacacgattcttgaactgatgccgcaggcagaaattgatgctcatcgcgcccgggcactcaacccggaacatccggtgatccgcggtacgtccgccaatcctgacacttatttccagtctcgcgaagccaccaacccatggtacaacgcggtctatgaccatgttgaacaggcgatgaatgatttcgctgccgcgacaggtcgtcattatcagccgtttgagtattacgggcatccgcaagcggaacgggtgattatcctgatgggctcagccattggcacatgtgaagaagtggttgatgaattgctgacccgtggcgaaaaagtcggcgtgctgaaagttcgcctgtaccgccccttctccgccaaacacttgctgcaagctctgccgggatccgtgcgcaacgtagcggtactggacagaaccaaagaacccggtgcccaggcagaaccgctctatctggatgtgatgaccgcactggcagaagcctttaataatggcgagcgtgaaaccctgccccgtgtcattggtgggcgctatggtctttcatccaaagaatttggcccggactgtgtactggcggtatttgccgagctcaacgcggctaaaccgaaagcgcgctttacggttggtatttacgatgatgtaaccaatctgtcactgccgttgccggaaaacaccctaccaaactcggcgaaactggaagccttgttttatggccttggtagtgatggcagcgtttccgcgaccaaaaacaatatcaagattatcggaaattccacgccgtggtacgcacagggctattttgtttacgactccaaaaaggcgggcggcctgacggtttctcaccttcgcgtgagcgaacagccgattcgttccgcttatctcatttcccaggctgattttgttggctgccaccagttgcagtttatcgataaatatcagatggctgagcgtttaaaacctggcggcattttcctgctcaacacgccgtacagcgcagctgaagtgtggtcgcgcttgccgcaggaagttcaggccgtgctaaaccagaaaaaagcgcgcttctatgtgattaacgcggcgaaaatcgcccgcgaatgtggcctggcggcccgtattaataccgtcatgcagatggcttttttccatctgacgcagattctgcctggcgatagcgccctggcagaattgcagggtgcgattgccaaaagttacagtagcaaaggccaggatctggtggaacgcaactggcaggctctggcgctggcacgtgaatccgtagaagaagttccactgcagccagttaatccgcatagcgccaatcgaccgccagtggtttccgatgccgctcctgatttcgtgaaaaccgtaaccgctgcgatgctcgccgggcttggcgacgccctccccgtttcggcgctgccgccagacggcacctggccgatgggcaccacgcgctgggaaaaacgcaatatcgccgaagagatccccatctggaaagaggaactctgtacccaatgtaaccactgtgtcgccgcttgcccacactcagctattcgcgcaaaagtggtaccgcctgaagcgatggaaaacgcccctgccagcctgcattcgctggatgtgaaatcgcgtgatatgcgcgggcagaaatatgtcttgcaggtggctccggaagattgcaccggttgtaacctgtgcgtcgaagtttgcccggcgaaagaccgtcagaatccagagattaaagccatcaatatgatgtcgcgcctggaacatgtcgaagaagagaaaatcaattacgatttcttcctcaacctgccagaaatcgaccgtagcaaactggaacgtattgatattcgtacatcgcagctgattacaccgctgtttgaatattccggtgcttgctccggttgtggcgagacgccgtatattaaattgctgactcagctctatggcgaccggatgttgatcgctaatgccactggctgttcttcaatatacggcggtaacctgccttcaacaccatataccaccgatgccaatggtcgtggaccggcatgggcgaactcgctgtttgaagataacgccgaatttggccttggtttccgcctgacggtcgatcaacaccgtgtccgcgtgctgcgtctgctcgatcaatttgccgataaaatcccgacggaattactgactgcgttgaaatcagacgccacgccagaggttcgtcgtgcacaggttgcagctttacgccagcaactcaacgatgttgccgaagcacatgaactgctgcgtgacgcagatgcactggtggaaaaatcaatctggctgattggtggcgatggctgggcttacgatatcggctttggcggtctggatcatgtattgagtttgacggaaaacgtcaacattctggtgctggatacgcaatgctattccaacaccggtggtcaggcatcgaaagcgacaccgctgggtgcagtaactaagtttggcgagcatggcaaacgtaaagcgcgtaaagatcttggcgtcagtatgatgatgtacggtcatgtttatgtggcgcagatttctctcggcgcgcagttgaaccagacggtgaaagcgattcaggaagcggaagcgtatccggggccatcgctgatcatcgcttatagcccatgtgaagagcatggttacgatctggcactcagccacgatcagatgcgccaactcactgctaccggcttctggccgttatatcgcttcgatcctcgtcgtgccgatgaaggcaaactgccgctggcgctggattcacgcccgccgtcagaagcactggaagaaacgttacttcacgagcagcgtttccgtcgtctgaattcgcagcagccagaagtggcagaacagttatggaaagatgctgcagctgatttgcaaaaacgctatgacttcctggcacaaatggccggaaaagcggaaaaaagcaacaccgattaaatgctctggataaggattatccaattctaaaaaaaagcccggacgactgttcgggcttgtcttcttatgtgttggaaaatcagtagcaatgcaatggcccaacagaaaataaaatctgtgacaataaaggcatataacccgcgcagaataacgtatagaaaattaaaagtataatttttattttgtatgtgttatttccaatacattcaccagacttattatcatttctgaagaattatttaattaaggttttacttaaggcgtaacaaatgatatttatcggctaactgaacttctcctttaggatgttttcactccccaaaatggggatgaaaggcaaataaaataactaaaggatttattcaatgaaaagcaaagtactggcactcttaattcctgccctgctcgctgcaggtgctgcacatgcagccgaagtttataataaagacggcaacaaattagatctgtatggcaaagttgatggcctgcattatttttctgataattcagcgaaagatggcgaccagagctatgctcgtctgggttttaaaggcgaaacccaaattaacgatcaactcactggctacggtcaatgggaatacaatattcaggcaaacaacaccgaatcttcaacaaaccagtcatggacccgtctggcatttgccggactgaaatttgcagattacggttctttcgattacggacgtaattatggcgtaatgtacgacatcgaaggctggactgatatgctacctgaatttggcggtgactcttataccaatgcagacaactttatgactggtcgtgccaatggcgtcgcgacttatcgtaatactgatttcttcggtctggtaaatggtctgaacttcgcggtgcagtatcaaggtaacaacgaaggtgccagtaatggtcaggaaggcaccaacaacggacgtgatgttcgccatgaaaacggtgacggctggggtctttccacaacatatgatttaggcatgggctttagcgctggtgcggcatacacctcttctgaccgcaccaatgaccaggttaaccatactgcggcgggtggtgataaagcagacgcgtggactgctgggctaaaatacgatgctaacaatatttacctggcaaccatgtattcagaaacgcgtaatatgaccccgtttggcgacagcgattatgctgttgcaaacaaaacccagaactttgaagtcactgcacagtaccagtttgattttggtctgcgtccggcagtctctttcctgatgtctaaaggccgtgacctgcacgctgccggtggtgcagacaacccagcaggtgttgatgataaagatctggttaaatacgccgatgttggcgcgacttactatttcaacaaaaatatgtccacctacgttgactataaaatcaacctgttggatgaagatgacagcttctacgctgccaatggcatctctaccgatgatatcgtcgctttaggtctggtttatcagttctaaatccccctgcccgctgttttggcgggctttttctgcctattcatcctcctttgatctaaattaaaaatgtgaactccgtcattacacaaaaagtgtcatctggcgttacactttatgcggatactaaaacaggaggttttatgaacagaacgattcttgtccctatcgatatttccgattcagaattaactcaacgcgtgattagccacgttgaggcagaggcaaagattgatgatgcagaggttcatttcctgacggtaataccttcgctgccctactatgcctctctgggtttagcgtattccgcagaattaccggcaatggatgacctgaaagcggaagccaaatcgcaactggaagagatcattaaaaaatttaaactgccaaccgacagagtgcatgtccatgttgaggaaggctcgcccaaagaccgcattctggaattggcgaagaagatccccgctcatatgatcatcattgcttcccatcgaccggatatcaccacttatctgctcggttctaacgccgcagctgtagtgcgtcacgcagagtgctccgtgctggttgtgcgctgacactaacgcccgcacattgctgcgggctttttgatttatttcgcaaatgtgctgacattttcccctctaatcattacaatttaaatttatgaattatgcattgataatcgctattataatatcgttcccctgtgcattattatcagtttttctggtattaaaagactgggcgctaataggagatgcaatgaaccacgcaatgtttcctggcatagttctatgcctggattataggtatgccgctgggaattggtgcatttattgtaggactgttttgtgcaattgcaactggctatctgaaagataatagcatcataaagaaagataccattataggtatcgttttttcaggaatttttgtcttgactatcaacaggcacaagtcagcggattacagatatcattattacattacggtttactctgcatggtatcgcctaccatttttgccacattaaaagcagtcggaattattctgtctatatactattaatagctccagggtctattgctgtcctcatcacgcatcgctttcataaggcattacttatcgccgtaacgatatcaataacaatatcaggtgtatggttattatattttctcgacagagccccagcgccgacaatcgtcctcttatttgctgtagcatttcttttcgcgcttataataatcaattttcgaaaacaataatctcaacagtagaataaagaggcaaatcaatcattacatatataagatggtgctaatattgcaccgcctttaaattgaactttatcctttcacccttacacaatttaaggaatgcagatgactattttatcagcacccagcctttttcctggtaatcgaaaacttgaaaatcattaactctaagaaattctgccaaatcgttgaaattactttaaattagactcgaaaaaatcaatccctgatggggcttttacttatcaatttaatcgtgtagatatcgacctccatctgcccgcctcagattcgtacctggtggaggtcttttttcgttacctcttcccccctttagttcagtataaaatcatcaaactaatgctgttcacactatttacctccagcattctatataaataatagaaataaaaaccccaatacatagtgcattggcatgaccaaacatcaatgccattatactcgcctctgttaaatactcgctagttaatatgataggcacgcatgatataacaatccatatgctaatacataaatacatcagtatttttctcatagtcagtccctgtgattaacaatcaaggcatagttaagcatatttcacattcaaacgtaaacattattaataacattatgtcaatcgaactgacatcacgattcaagccctcttcagactgaaggttagagcagcgtagaacatttcaaaacaatacactaaaaaaatacctgaacaaaaaacttaattcttttttattgtgaactttagtaattttgtcatgcaactctttattacatttaggcctatcttatttcatggcaacgcagatacaggaccatttcttgtgctatggataagtaataagctagttacatcttattaagagaaccattttcacatatcaagatatcatcaccacccacaatgaattaagtatttttcttattctttagattagatacgtaatgaatccctaactccattcgggtgtcatggctctttcatttgaaacacattcatgtctaatgtaatatttccatgcgcaaatataaccaccaaccatactcatcatttattacagagaattattttattcaccgaaaagtttcacaaaatatcccctgatagaaaactaaaaaacactgcataatatcgctattctggcactcgcgaaaaattatattctgcacctgttgtagcgttctatttctccgcctggcaacgaatgcacaatgtccgccacagtttctgttctaatttcttcctgtgttaccgcatcctgtacgggtagcgcaacaccagcatgctaagcaaggctttcccatcagatttcactacgactatttgggagcgagatggaatgcagcagtaaaacgtgctggtattcgccgccgtaatccgtaccatacgcgacatacttttgcctgctggctgttgacggcaggagcgaacccggcatttatagccagccagatggggcatgaaactgcgcagatggtgtatgaaatttacggtatgtggattgatgacatgaacgacgaacaggtagccatgttgaatgcgcggttatcgtagttgcaaagtttgccctcaatatgccccatttagtaccagagaactgaaataatgcaagaaaatcaacaaattacaaagaaagaacaatacaacctgaacaaattacaaaaacgtctgcgtcgtaacgtgggcgaagccattgctgacttcaatatgattgaagaaggcgatcgcatcatggtttgcctctccgggggtaaagacagctataccatgctggagattctgcgcaatttgcagcaaagcgcgccaatcaatttttcgctggtggctgttaacctcgatcaaaagcaaccgggcttcccggaacacgttctgcccgagtatcttgaaacgctgggcgttgagtacaagattgttgaagagaacacttacggtatcgtgaaagagaagattccggagggcaaaaccacttgctcactgtgttctcgtcttcgtcgcggtatcctttatcgcaccgcaacggaactgggggcgacgaagatcgcgctgggtcaccatcgtgacgatatcctgcaaacgctgttcttaaatatgttctacggtggcaagatgaaaggtatgcctccgaaactgatgagcgatgatggcaaacatatcgtgattcgtccgctggcctactgccgcgagaaagatattcagcgctttgccgatgcaaaagcgttcccgattattccgtgcaacctgtgcggttcacagcctaacctgcaacgtcaggtgattgctgacatgttgcgtgactgggataaacgttatccggggcgtatcgagacgatgttcagcgcgatgcagaatgtggtgccgtcacatctgtgcgataccaacctgttcgattttaaaggcattactcacggttctgaagtggttaacgggggtgatctggcgtttgatcgcgaagagatcccactacaaccgtcgggctggcagcctgaagaagatgaaaatcagttggatgagttacggctgaatgtggttgaagtgaaataaccaggatagcgcccgatgcgcaagcgtatcgggctactcttatggaggccggataagacgcggccagcgtcgcatccggcaatcccgaagaagatgtttactcttgcaccctgcgattcaacatttcattattttaataaccgcacccggcacgtttttcctttaatcttcccgccctgtagctgtttccatgctttatgagcaacagcctgacgcaccgcgacataaacatgcgccggatgcacggcgattttgccaatatctgcgccatcaagcccgatgtctcctgtcagcgcacctaatacatcacccgggcgcattttggcttttttcccgccatcgatacacaacgttgccatttctgcttccagcggcacaatggaactattcgctggcagcgtttgccagttaagttttatctgcaacatgtcagaaatgatattggcccgctgtgcttcttccggggcacagaaactgatcgccagaccactatttcctgcacgagctgtacgaccgatgcgatgtacatgaacttcagggtcccacgccagctcaaagttcaccaccagctcaagcgattttatatccagaccacgcgcagcaacatcagtcgcgaccagtacacgggcgctaccgttagcaaaacgtaccagggtctgatcgcgatcgcgttgctccagatcgccgtgtaacgacaatgcactttgccctacttcattcagcacgtcgcagacagactggcaatcttttttggtattgcaaaacaccacgcaagaggatggctgatgcaagcttaataaccgttgcaacagaggaattttgcctttgctggatgtctcataaaattgttgttcaataggtggcagagcatctgttgagtcaatttcaatcgctaaaggatcgcgttgcactcttccgctgattgcggcgatggcctccggccaggttgccgaaaacagaagcgtctgccgagatgctggcgcaaaacggatgacatcatcaatggcgtcgctaaatcccatatccagcatgcggtcggcctcatccatcaccagcgtattcaacgcatccagtgatacagtgcctttttgcaggtgatccagcaaacggcccggcgttgccacgataatatgcggcgcatgttgcaacgaatcacgctgcataccgaacggttgaccaccgcacaacgtcaaaattttggtatttggcagaaaacgcgccagccgacgcaattcacctgccacctgatccgccagttcacgcgtaggacacagcactaaagcctgggtttgaaatagcgacgcatcaatttgctgtaacaagccgaggccaaaagccgccgttttgccgctgccggttttcgcctgcacgcgaacatcttttccggcaaggatcgccggaagcgcggcgtcctgcaccggcgtcatggttaaataacccaactcattaaggtttgtgagttgggcgggaggcaaaacattcagggtagaaaaagcggtcacaatctattctcgtggtcatcgacgcaaagtcagcaggcgcgtatcctcgcagatctacgctcacgatgcgacaatttaatcggttcttcatcgggtggtgggtcaggcatgggttgcgggcgagggatcggatcgggtactggaacaggatcgccaggaatcggttcagggacaggaatttgcaaataaataagtgtcgtcatatttccctccggtcattgggtggactcttaaagggtagacgctgataaataacaggcaaaaaaaagccgactcatcaaagtcggcgtcgtacgaatcaattgtgctatgcagtaattcaaaaaaggaagtaagacaatatggagcgcaacgcccatcgcttgacgttgcattcacctgcaagagagatattgccctgaatgggtagagagtttattgacttcgctcaaactttacggcgtttttgtatacagatagccggaaaaattgcttttgttacaaccatttactacgatgcaaccataaagcaacaccaccaataagaacaactaacagaatacaaaaaattgaaaatccaaattgccatccgccgccagggatcccaccaaggttgacgccaaataaccctgtcagaaacgtactgggtaaaaagaccattgccatcaacgacattgtataggtacgacgagctaaattttcctgcatcacctgagcgatttcatccgccatcacgccagtccgtgctatacaggcgtcgatttcgtcaagaccgcgcccaaggcgatcggcaatatcctgcatccgacggcgttggtcatcgctcatccacggcaaacgttcactggcaagacgagcataaacatcacgttgcggtgccatatagcgacgcatcacaattaattgtttgcgcagcagagccaggaatccacgcggtggaatttgctgatcgagaagattatcttcgaggtcgataattttatcgtgcagctgctcgataaattcgctggaatgatcggtcaacgcatcgcacacatcaaccagccatcccccgcaatcggtcggaccagtgccctcttcaagatcgctcaccacatcgtccagcgccagcactttgcgttgtcgggtcgaaacaattaaccgcccgtccatatatacacgcatggcgaccagttgatcggggcgttcatcggtgctgccgtttatacagcgcaatgtaatcagcgtgccttcaccgagacgactgactcggggccgtgtgctctcgcccgccagcgcatcacgtacgttattgggaagcagcggtgttgtcgccagccattgggcgctatcatggtgtacataattaaggtggagccagcagggatgcgcttcatcaatcacatctgtattttccagcggtttaacgccgcctctaccatccagcatccatgcaaatactgcatccgggacattaacgtccgatcccttaatcgcttccacagtgcctccatcatcaacgcattattttgtagtctagccttctggccctgttacgcaacatctcatcaccccattaccctgaaatgattaataaaattctgtctaaattgaatacaaaaagcaaaatgcttttccgtatacaaaccgtgtgaagtgttaaatagcgtctatcattatcagaattatctgatcatatgacgtggcttttttgcgatcggatagcaacaaaaattgataaaaataatgggatctcaatgattacacacaacttcaataccctggacttactcaccagtcctgtctggatcgtttcgccctttgaggaacagttaatttatgccaacagcgcggcgcgactgttgatgcaagacctcacgtttagtcagctacgaaccggtccctattccgtctcctcacaaaaagaactgccgaaatacctctccgatctgcaaaatcaacacgatattatcgaaatactcaccgttcagcgtaaagaagaggaaacagcattgagctgtcgacttgttttgcgaaagctgacagaagcagaaccggtgattattttcgaaggtatcgaagcgccggcaacgctgggtttaaaagccagtcgctcggcaaattatcagcgcaaaaaacaaggtttttatgcgcgcttttttctgactaactctgcaccaatgttgttgattgacccctcacgagatggccaaatcgtcgatgctaacctcgccgcgctcaatttctatggttataaccatgaaacgatgtgccagaaacatacctgggaaattaatatgctcgggcgtcgcgtcatgcctatcatgcatgaaatctcgcatttacccggtggtcataaacctttgaattttgttcataaactggcggatggttcgactcgtcatgtgcagacctatgccgggccgattgaaatttatggtgacaagctcatgttatgtattgtgcatgatattactgagcaaaaacggctggaggagcagctggaacatgctgcccaccatgatgcgatgacaggattactgaatcggcgacagttttatcacattaccgagccaggccaaatgcagcacctcgccatcgctcaggattacagcttgttgctcatcgacaccgatcgttttaaacacattaacgatctctatgggcattctaaaggtgatgaggtgttatgcgcccttgcccgcactctcgaaagttgcgctcgcaaaggcgatttggtgtttcgttggggaggcgaagagtttgtcttattgctaccaagaaccccactggataccgcgctttcgctggctgaaactatccgcgtaagcgtggcaaaagtgagtatttcgagcttaccacgctttactgtcagcattggtgtggcgcatcacgaaggaaatgaaagcatcgatgaactgtttaaacgcgttgatgatgctttgtatcgagcgaaaaatgatggacgcaaccgcgtgctggcggcataagccacggatgcgtctcgtgatcaacgactgcgcttagcgtggcgctcccagttttcttgcttcgcctgcgctgttttacgtagtgcgacgtaacacgccccgctgccgccatgatgcggtagcgcggtgcaatatgcctgaacatcatcaaattcggtcagccagcgcgccacatagctgcggacaatattggcatgcgatttatcatcccgtcctttgccatgaataatcaggacgttacgcaaaccatccgccagggcttgttgaatgaaactgaacatcattttgcggcactcttccaccggctggcgcaaaagattcaggctcgcctgttgcggatatttaccactgcgcagcttatccagcaccccatgttgcaaaccttcccgccgaaactccagcggctgacttagcgggatgatgtcgagaaatccagtggtgaggaaattatcaagttgcagcgtgtcgatacgctgcggcgcacgttggttacgcgttggatgccagtggacatctgtagcacgtttcagcggctggacatcttccatggcgtcaagaaacagcgatttgtcgtcaaggttcatgtaacctcctatgcaccttcacacgtcgtgattcagacgggttaattgttcatacttactgcatcgttcccttcacagattgaaacaatactctacttcatacctgtgagtatctgcgcaggcggggcattttatactagcctgttagcagtatcgaacagtttagcccgagtttaattcagcacaggctccgatcaggatgatttattcatagcaggaaccaacaaaaatgcgataaataacagaccactgattagcagaaaggtatccgaaaatgccatagtttgcgcctccctcagcatcaattgactcaataatttggttgaagccagtatttccgatgtctggtcacttccactgcgattaaaaaacaaagcacttctggaaatgaagtcattcatcgtatggggaacagaaaccattttttcacccattctcgaaaaatgaaaattagttcgattattgagaatagagccacacagggcaataccacttgcgcccccaagattacgtgttaaattaaatacaccagaggctaacttcagccgttcttttggaattccccccagcgttaatgttacgatgggggccatcgcaaactgctgcgaaatccctctaattgcctgtggaaacagtaactcctgccatccccattcgtgggttataggggtaaaaagatacattgaaaacacaaatccgcccagccccgccatcaacagccattgcagatttatttttttacttaaccagaagtaaaagggaacagaaaataactggaaaatacctgttgtgcaaacggcaaaacctatctcttcggcatttaatccgcgaacctgccccaaaaacacaggtattaaatatacagtagagaatattccaacccctccagaaaaagaaaagaaacatcccagtgtgaaatatttatccttaaaagcatgaagatccattatcggattggatattttaagtgtacgcgcagcaaataaaataaaactcaccaatgccagaactgatgtcagcaaaatagtattatcatccagccatccccagcgcgctccttcttcaagggtatattccagacatcccagtgtcatggccaacaggataatactcggataatcagcaactttcagtaaagagagatcaggtttatcaaaattaaccagaaaaggaatactcaaaactaaatatatgcccggtaatatattgatataaaatagccatcgccagtcgaggttatcagtgatccagccccccagagttggccctagcgtcggtgacagtgaggccagcgcactgactaccgcagcagccaaccccaactctttaccctggtaataaataaacgccgtcgtgaaaactaaagggatcatggatgcgccagcaactccctgtaaagcacgaaaaaaaatcatgatctgaatattccatgcaagtccacaagcgatactcattaaagtaaatattcccgcggatagagtaaaaagccaacgagtggaaaatacccgtgacagccacccagagagcggaataacaataatctcggcaattaaatagctggtctgaagccaggccatttcgtctttacctgcggacagaccaccacctatttcatttagggatgacgatacaatttgaatatcaagctgagcaataaataatccaatacacatactggcgaaagcaatatgtttacgcatagacatcatctctcatcaacactgacggtgacggacagtcccgggcgaagaagttgctttaattcctttgcgtcgtcaaatgcaatccgtaccgggacacgctgaacaattttggtgaaattgccagtggcattttctatcggaatcaagctgaaactggctcctgtcgctggggaaaggctttcaatgtgaccgtgaaacacttcccctttgagaatatcagcacggatctcagccttcattcctggcttcattcccgctatttggttttctttataatttgcatcaacccacaactcactgactggtactagtgaaactaacgatgtgccgccttccacccaactgcctgtatgggcgctgcggtttgcgacaatgccatcaatcggcgcacgaacaagggtatattccagatccagtagtgcctgagtcaaagcggcctgaacttcttcgatacttgcacgtacgttttcttcctgagcagataaaactgccagccgttgcttctccaccaggaaatcgttcgcggctttgcgctcctttgctgcgacctgctggtagtcaaacctggcgttatcaataatttgttgcgatattgccgctgattgtgcgagtttttcataacgttcagtatctcgcaggcgcttttgctcctcatgttttactgcctgccatgtttcactggcactttgaattatcgactgctgcatcgcaatagtggcttgaatgctttcgagattggctttgctactttttatttttgcctcaagcctggcgacatttgcacgataatcccgatcatcgagacgcaggataatatcgcctttttttacactctgattatcgcgcacctctatagcagaaatataaccagaaactttacttgccaccgtggtgatattaccacctatgtaagcatcatccgtcgtctgtataaatcttcctttgcttacccaccagataaaaaagacaacgccagccaaaagaataccgatcgctaccaccccaataagctgttttttagaaattatcatcactctttacaccgtatatatccggaaacttgcatacgtcatatttaaaatttaacatggcttatttgatgatttctgacaaaatatctactgtaaatgacaatcacactgcaacccaaagcatcaccagggcatcacattatcggactggattcggaacatctgaatggaggcacagttccctggcataaacatctctatgcccagttgctttacccggctgaaggagtcgttcgtgtatgggctggagaaagcgtctggctagtgcatgccagcagcgcgctttggctgcccccacaaatgccgcataagtttgttgcgacaggcaacgtacttttaaaaaccgtactggtttcagaagcggaaagtgaaacgctgggaaaagtttgcttcatgacgggtatttcacccctgttaagagaattactaattgcaattaaccaacttccaccgtcgcaaagtaccacagataaacaacagttacgtttttcagccctcgagacactgatacttcaggaaataaaaatgggggtgaaaatgtcacttgaactcccttggccaaatgatgagcggctacagcagctttgtgagaatttgctaaacaaccaagggtatctgccaacactggataatctagcggataaaattaacgtcagtagccgtacactcatgcgcttatttgttaaagagacgggattaacatttcgccactgggttcagcaaatgcacgttatttctgcagtgacgcttcttgatgatggatattcgttgaccaaaattgcccatcgtctgggctatgcctcagctgaatcgttcggcaatatgtttaagcgtcgaacgggctactcgcccggtaaatttactcgtcgattaacgatgcatgattatgcaatcacaaggcaaatgatttaacttatattttcgtgaaatctgtcactgaagaaaattggcaacggatgggtaaaaccgttataacactgtcaccggtcaccaggaccccaggccggatttaagacgaggatgcactgctgtgtgtactgtagagtctggcggatgtcgacaggctctatttttttattcattttttagctctgtaaataaccacattctcgccgggattggggaatgagtgacgagatcagtggtgtctggcggctatcacgccacagaatcaaataacagatagcctacggtaaaatttcgctgactggaattatcccaccctcgatccatgtgatggcttgccctcatttcttcaggcagaaaaatcaaaaaatcgctttatgcttaaatactgcgacaaaccagacgcgaaacctggtacttactttttgttagtattaatctttttggtggtatggctgctgatgttgctggcgtggtatcttgttggcttgccgataggtccgggtatttacccacgtttgtcttaagagagaacggatgctgagattacttgaagaaaaaattgccacgccactgggtccactgtgggtgatttgcgatgagcaatttcgcctgcgggcggttgaatgggaagagtacagcgaacgcatggtgcagctgctggacatccattatcgcaaagaaggctatgagcgcatttctgccaccaacccaggtggtttaagcgacaagcttcgtgaatattttgccggtaatcttagcattattgatacgcttcccactgccacgggggggacgccatttcagcgcgaagtctggaaaacactgcgcactatcccctgcgggcaggtaatgcattatggccaactggctgaacaattaggccgccctggcgcggcgcgtgccgttggtgcggcaaacggatcgaatcccatcagcatcgtcgtaccttgccatcgggttattggccgaaacggcaccatgaccggatatgcaggcggagttcagcgaaaagagtggttattgcgccacgaaggttatcttttgctgtaaacattaaacaatttgtgccagcttgttcacacttttatgtaaagtcacccttaacaacttaagggttttcaaatagatagacatatatttacatctaatatcggaattctctgctgttaaggtttgcttagacttacttgctccctaaaaagatgttaaaattgacaaatatcaattacggcttgagcagacctatgatcccggaaaagcgaattatacggcgcattcagtctggcggttgtgctatccattgccaggattgcagcatcagccagctttgcatcccgttcacactcaacgaacatgagcttgatcagcttgataatatcattgagcggaagaagcctattcagaaaggccagacgctgtttaaggctggagatgaactaaaatcgctttatgccatccgctccggtacgattaaaagttataccatcactgagcaaggcgacgagcaaatcactggtttccatttagcaggcgatctggtgggatttgatgccatcggcagcggtcatcacccgagtttcgcgcaggcgctggaaacctcgatggtatgtgaaatcccgttcgaaacgctggacgatttgtctggtaaaatgccgaatctgcgtcagcagatgatgcgtctgatgagcggtgaaatcaaaggcgatcaggacatgatcctgctgttgtcgaagaaaaatgccgaggaacgtctggctgcattcatctacaacctgtcccgtcgttttgcccaacgcggcttctcccctcgtgaattccgcctgacgatgactcgtggtgatatcggtaactatctgggcctgacggttgaaaccatcagccgtctgctgggtcgcttccagaaaagcggtatgctggcagtcaaaggtaaatacatcactatcgaaaataacgatgcgctggcccagcttgctggtcatacgcgtaacgttgcctgattcttccgcataactcactatccttctgtcatatcattaaatttttctgatttattgatctgacagaaggttcatcactgtttcattcaccagatatgggttaatcttttaattacaaactgcgttgacagttgttgtaaggagaccctgtatggctatgtatcagaacatgctcgttgttatcgatcctaaccaggacgaccaaccagcattgcggcgagctgtttatttacatcaacggattggtggcaaaattaaagcctttttgccgatctatgacttctcatacgaaatgaccaccctgctctctccggacgaacgtaccgctatgcgtcagggcgtcatcagccagcgtacagcctggatccacgagcaggcaaaatattatctcaatgctggcgttcccattgaaattaaagtggtctggcataaccgtcctttcgaagccatcattcaggaagtgatcagcggcgggcacgatttggtgctaaaaatggcgcaccaacatgaccgtctggaagcggtgatttttacgccaacggactggcatctgttacgcaaatgcccaagcccggtgtggatggtgaaagaccagccgtggccggaagggggtaaggcgctggtggcggtgaatctcgccagtgaagagccgtaccataatgcgctcaatgaaaaactggtcaaagagacgatcgaactggcagaacaagtcaaccataccgaagttcatctggttggcgcttatccggtaacgccaattaatatcgcgattgaactgccggaatttgacccgagcgtttataacgatgccattcgtgggcaacatttgctggcaatgaaagctctgcggcagaaattcggcattaatgaaaacatgacgcacgtagaaaaaggtctgcccgaagaggtgattcctgatttggcggagcacttacaggcggggattgtggttctgggcacggtcggacgcaccggtatttcagcagcattccttggcaacacggcggaacaggtgattgatcatcttcgctgcgacctgctggtcattaaacctgaccagtatcagacacccgttgaactggatgacgaagaagacgattaacgactcttcaataactgacaaggcccgagttatcgggcctattttttacttactgctcttcgccgccaaggaaataaattcccaacgggattgccagcaacacagtaaagaccaggctataaacaaaaatcatcgatgactgaatcacatacattgatgtcgtccactcagacagcggaatattgtactgttctataacgccgccgatggtcgcgcgagtcacaaccgacgccgcaataatgaaaaccgccaacaaaccaaagagaaatttcttccctttcgctgacttcagtttcgccataatcatgatgtaatccttgtgcagacaaatttcttgttacctaaacgtaacaataccatgacatttcaccgttgtctgctctgaaaatctcacctcttagctggatttacaatcaacgcattgattagttagctaatgttgctacttccttccctgactattgatgatctgaatgaattgtcgcggtaaaatagtcccgccaggggtttccggcatgacgacaattatctggaggagcctgataaaacaatgatcgctgaactgtttacaaataatgcgcttaatctggtcattattttcggtagctgcgcagcattgattctgatgagcttttggtttcgccgtggaaatcgtaaaagaaaaggatttttattccatgcggtgcaatttttaatctacaccataattattagtgctgttggtagcatcattaactatgttatagaaaactataaactcaaatttatcaccccaggcgttatcgattttatctgtacgtccctgattgcggttattctgacgattaagctatttctgctgattaatcagtttgaaaaacagcagattaaaaaaggtcgcgatatcaccagtgcgcggatcatgtcgcgcattatcaaaatcaccattattgtggtgcttgttctgctttatggcgaacatttcggcatgagcctttctggcttgttgacctttggtggtattggtggtctggctgtcggtatggccggtaaagatattctgagtaacttcttttccgggattatgctctatttcgaccgtcctttcagtattggcgactggatccgttcaccggacagaaatatcgaaggtacagtaacggaaattggctggcgaattaccaaaattaagacctttgataatcgtccattgtacgtaccgaactcgctgttttcgtcgatcagcgtagaaaatcctggacgaatgaccaaccggcgcattaccacgaccattggtttacgttatgaggatgcggcaaaagtgggcgttattgtcgaagccgtacgtgagatgctgaaaaatcacccggccatcgaccagcgacaaaccttactggtttatttcaaccagtttgctgattcgtcattaaatattatggtttattgctttaccaaaaccacggtatgggctgagtggcttgccgcacagcaagacgtttatttgaagattatcgatattgtacagtcacacggcgcggactttgccttccccagccagacgctgtatatggataacattacaccgccggaccagggtcgctaaatcagacatcactggcgttatccacaagggtaacgccagttcccatcacattaatgcttcacaatatacatagtccgactgtacgccacatcttcagggttattaatgggataacctttcagccacggcttgattaatcgtccattggtatattgataaattggtgcaatcggtgcttgctccatgaggattttttctgccgcgttgtaatcggcattacgcgctttaacggtattttccgtcgatgcctgggccagaactttgtcatatgccggattgttaaagcgtgaaatattcccggaatgcgttgacgttaataatgtcaggaaagtggagggttcattataatcccctacccacgaggcgcggataacatcaaaattgccggtattacggctatcgatataggttttccattcctggttttgcaatttaacatctacgcccaggttctttttccacatcgatgctacagcaatcgcaattttttgatggttttctgaagtgttatacaaaagcgtcaacttcagcggtttttgcggaccataaccagctgcgctcaacaaagtttttgcctgcgcattcagttcttcctgactcatttgttcaaacggcgaaggttccggcgtaaatcccgcggtaacatctggtgtaaaatgccacgctggcttttcgcccgtccccaacactttttcggtcatcaggcggcgatctatcgtcatacttaatgccaggcgaacgcgctgatctgccgtcggccctttttgcgtgttaaacgcataataataggtcccgagctgcggcggcgtataaacctgccccggaatatccttcaacaacttctgatacatatttttcgggaaggattcggtgatatcaatatcccccgcgagataacgcttagtggctgcggattcctgattaattggcaggaaggtcactttttgcagtaccgttttggcgttatcccaataatgggtattcggcactacgaccagtttttcattgactacgcgctctttaagaacataagcgccattgccgatcagatttccgggtttcgtccactctttactgctttctacgttggctttttgcaccgggaagaaggcaaagttagcggttaaattcacaaaccacggcaatggtttatcaagctggattttcaaagtatgggcatcaactgcggtgacgccaagctggtcaggcgcggctttaccatcaataatcgcctgtgcgttgttgattcccgccagcgcggcaaaccatgcaaatggcgatagcgttttcgggtccaccagacgttgccagctgtagacaaaatcttgcgccgttaccggtgtgccatccgcccattttgcgttatcgcgcagggtaaaagtccatatacggttgtcattacttttccactgagtcgcaacgccggggacaatctcccctttctcgttctgattcaccagtccttcaaacagatcgcgaatgacctgaatctccggcaggcccacggctttagcgggatccagcgacgctggctcatctttaatgtggcgcaccagctcctgcttctctgccagtactgtgccgctcggaacttcagcagcatacgaaagagaaatgctgctgaccaacagcgcacaacacgtgactgaaacagagtgcttcataagtttccctctaaccgacattaaaattgatgcgtaattatttgtttcgctttaaagaaatgcaaacaacttccatcaaaaaagtgacaaaggaagcatcaaatgttttaagtatcaatatatcaaatcagatttagtgtaaataatagtctccaaaatgcggtaaagcacatagaactccgaacactacgttcgggcttcgcacattcaaacccgttttcggtatcataatcagcatctgtcgccattgtgcgaagaataaaaaataaccaaaacgttgaaaggaactgagaatacgttaagagaagaattaaattaatgtatcagcaagtagtgctaaacagcacctttatacttcagcctatctataaataatgagaatgccgagccagcatgtcgacggtgtggatagtacaggtgataaccgggtaaatctggtgtgaatttatccaaaacacgtatcagtttttttcctttaatagcccgctcaacctgatcataaggtagatacgccaatccatgcccatcaattgcagcatcaatgatcaggtctatcgtattcagtaaaagctgaccttccatgcgaacacgaacttcacgtccaccgcgtattaatctccagcgatttgctgtacccgatgtgggaagatacaaattaattgcctgatgatctattaattgtgacactgacgttggagcacttcgacgagaaaaataatccggtgagccaacaatagccattggtatgtctggcccgattcgaatggcgatcatatctttatccatctccccacccagacggacgcctgcatcaaaacgttcagaaacgacatcggtcaaaccataatcaatggtaagctgaatatcaatttcaggatgcgatttcaggaatgtgcgcatagctggtaacaatatcgtttttgctgcatgttctacagtagtaatacgtattgtcccggatgggcggttctgcagatcgctcagggatgtcagggcagaatctatgtcatgcaacatagggccaagaacagacaaaagatgctcgcccgcttcagtgggtacaacgctgcgcgtggttcgcgtcagaagccgcaatcccaatcgttcttctatacggcgcactatctggcttaaagctgactgcgccatgctcaggcgggctgctgcgcgagtgaagctacgctcctctgcaacgacgacaaacgccatcagatcagcgatttcttcacgcttcattcagtatctccatacaatctattaatcatttaaatgataggtctaatcatgattttgggtctaatcaacttaatgatcaatatctatagtgatatcaccaaccgttaaaacgaaccgacaactccatgaggaacggaatgatgaataataaagtcagcttcactaacagcaataatccaaccatctctttgtctgcagtgatctatttccctccaaaatttgatgaaacccgtcagtatccggcaattgtggtatctcacccaggtgggggcgttaaagagcaaacggccggaacctatgccgaaaaactggcggaaaagggatttgtcactattgcttatgacgcatcttatcaaggtgaaagcggcggcgagccgcgtcagttagaaaacccatacattcgtactgaagacgtcagtgccgtgattgattacctgacaacgctttcttatgtcgacaatacccgaattggtgcgatgggaatttgtgccggagcaggatatacagccaatgctgcaattcaggatcgccgcatcaaggccatcggtactgttagtgcggtcaatattggttcgatgttccgtaatggttgggaaaacaatgtgaaatctattgatgccctaccatacgttgacgcgggttcaaacgcccgaaccagcgatattagcagcggagaatacgccactatgccactggcaccaatgaaggagtccgatgcgccgaacgaagaactgcgtcaggcctgggagtattaccacacccctcgcgcgcagtatccaacagcaccgggttacgctactttgcgcagccttaaccagattattacctatgatgcttaccatatggcggaagtgtacctgactcagccgatacagattgtggcgggcagccaggctgggagcaaatgcatgagtgacgacctgtacgatcgagcatcaagccaggataaacgctatcacattgttgaaggcgcaaaccatatggatctttatgatggcaaagtctatgtggctgaagcaatttcagtattagctccgttctttgaggaaactctgtaatgaaacatattcaaatccgtaatagtgatatggcctggcatattgctgccaataatctaggaaaagtttcatgaacaatgtactgattcttggtgctggcggtcagatagcccgccatgtgattaatcaactggcagataaacaaaccattaaacaaactttatttgcccgtcagccagcaaaaatccacaaaccctatccaactaatagcaagattattatgggggatgtactgaatcatgcagcactgaagcaggccatgcagggacaggatgttgtgtatgccaaccttacgggggaagatttagatattcaggcaaattcagtgatcgctgcgatgaaagcctgtgatgttaaacgtctgatctttgttctttccctcggtatttatgatgaagttccaggaaaatttggcgaatggaataatgcagttattggtgaacccctaaaaccattccgcagggctgcggatgcaattgaggcttctggactggaatatacaattcttcgccctgcctggctgactgatgaagatattattgattatgagcttacctcacgcaatgaaccattcaaaggtacgatcgtatcacgtaagagtgtcgcagcattaatcacagatatcatcgataaacctgagaaacacattggtgagaatataggcatcaatcaacccgggactgatggtgataagcccttcttcatgtaaatcaattatatagctaccatcgtactgtactatgtgcagtacgatttattaaacttattaaggtgaactgatcaatcagatgcgattaacatgtgtagaaccagtaagaataaaatacgccatgtatataacattacgacaattctaatatctgcacatcaatgaaaatacaaacaacttccggcaaaaaagtgatacaagatcgatgacatagcgttgaagaaaaggatttgataatccgcaaaatttgcacaacactgcctgtaatacttcctgaaccagagacgatcatgaccgtaactcgcccacgcgccgaacgcggcgcatttccgcccggaacagaacattacggacgttcattattgggcgcgccgttaatctggtttccggcccctgcagccagtcacgaaagtggtttgattctggctggcactcacggtgatgaaaactcttcgatcgtcacgctctcctgtgctctgcggactttgacaccttctttgcgccgccatcatgtggtgctgtgtgtgaatcctgacggctgccagttagggttacgggccaatgctaatggtgtggatttaaaccgaaactttccggcagcgaactggaaggaaggtgaaacagtttatcgctggaacagcgccgctgaagaacgtgatgtcgttttactgacaggtgacaaacctggctccgaacctgaaacccaggcgctgtgccagcttatacaccgcattcaacctgcctgggtggtctcattccacgatccgctggcctgtattgaagatcccagacacagcgaattaggtgaatggctggcccaggcgtttgaattgcctctggtaaccagcgtcggttatgaaacgcctggctctttcggcagttggtgtgcagatctcaacttgcattgcatcaccgcagagtttccacccatctcctccgacgaagccagcgaaaaatatctctttgcgatggcaaacttgctgcgctggcatcctaaagatgcaattcgcccgtcgtaaactgaagcgccggttccacatctaccgccagccaggtcggtccgtcaagatcggcgaaactgacctgcggcaccagcggtaaagcggcgctaatggcacgagaggtacacaacatgcagcccagcatcagacgaaaaccttgtgcacgcgcttcagtcgccagcgccagcgcttccgtcagaccaccggttttatcaagcttaatgttaaccatctcatagcgccctttcagcgccttcagattgctacgagtatgacaactttcatcagcacaaatcggtaacggatgaataaaattctccagcgccgcatcgtcctgcgcaggaagcggttgttcaagcatcgcaacgcctaaatccgccaatagctggcaacgcgccgccaacccttctgcacgccaggattcatttgcatcaacgatcagcgtcgcatcgggcacagctgtgcgaattgccaccatccgctcactgataagatggttatccagcttcactttcagtaatttcgcgcctgcctgccagagtgttgatgcactattggccatctgatcaggcgtaccgatgactatcgtctgtgccgtggtgactgtctcgggaagcgttatgccgatcaaatcagccagcgattgctgctgttttcgcgccgccagatcccacaatgcacaatccagcgcattacgtgctgcgccggcagggaggattttttgcaactcctcccgtgtcagccctttctctaattgcggcacgacgctcataatttgcgccattaccgaggcatcactttctccataacgcggatacggcgtgcattcaccggtgcctttaataccttcttcttccagttcaaccaccaccacgcgcgcttcactgcgacttccccgagcaatcacaaacggggtatgtaagggccaggcctcctcaaataccttaacggttctcatctttactccttattgtcgcggtggtctgcggattaagcgcaaatagcgtttgctgtgttattgacagttagcataaactaggtgtgacgttaactatatgtaaacaggaaagataatcatgtcacaaaccgttcatttccagggcaacccggttacagtcgccaattccatcccgcaggcaggtagcaaagcgcagacttttactctcgtggcaaaagatctgtctgacgtcaccctcggtcagtttgcgggtaaacgcaaagtgctgaacattttcccgagtattgataccggtgtttgcgccgcatcagtacgtaagtttaaccaactggcaaccgagatcgacaacaccgttgtgctgtgtatctctgccgatctgccgttcgcccagtctcgtttctgcggcgcagaaggtctgaacaacgttatcaccctctccactttccgtaacgctgaattcctgcaagcctacggtgtggcaattgctgatggcccactgaaaggtctggcagcgcgtgccgttgtggttattgatgaaaatgacaatgtgattttcagccagctggtggatgaaatcaccaccgagccggattacgaagcagctctggctgtactgaaagcataagttaatatgcctgatggtgttgcaccatcaggcatattcacgcttactcttcgttcttcttctgactcagaccatattcccgcaacttattggcaatcgcggtatgtgaaacgccgagacgttttgccagtttgcgcgtgctgggataattgcgataaagctgggttaataccgagcgttcaaaacggctggtgatttcgtccagcgaaccttccatcgcatcttcgcccacggctaccgttgcggcgtcataatccggcaacaaaatatcctgtggacgcagctcataaccgtccagttgtgtcagtgcgcgatagatagcgttctttaactgccgcacatttcccggccacgcataacgcgtaagtacagtattcagatcagcggccagtttcggacgcggcacgccctgctcgtcggcaaagcgggcgacgaacagctcggttaacggcatgatgtcctgcggacagtcacgtagcggcggcagattgagcgtcaacacgttcagacgataatagagatcttcacggaacacgcctttttgcaccagttcgaccagattcttctgcgtagcacaaatcacccgcacatcgacatgcacctcatggtcttcgccaacccgacggaaggtgccatcattaaggaaacgcagtaatttcgcctgcatccgtggtgacatctcacctatttcatccaacagcaccgaaccaccgttcgcctgctcaaagaaccctttcttcccttccggagcatgaccaaacagttcactctcgaccgcatcttccggtatagacgcacagttcagtgccaggtaaggtttgctcgctctggggcttgcctgatgacaggcatacgcaaagagatcttttccggtgccggtatcacccgtaatcagcagtggcgcgcttagcatcgccagtttctgcgcctgttcgacaacatgcttcattttcgggctgacagcgacaatttgactgaaggcgctgacatcctgggcggcgacattttgcaactgacggcccatacgaatcgttgatcgcagcatcaccaccgcaccggtcaggacgtgttgatcattttcatcctgaagataaacaggcgtaatctccatcaggaaattctgcccattaataacgacatgctcgttatgcgaatcttgcggttcgctttccagccagcgtaaaaaattaaagccgttaatcaattgcgcggcggtatggttgcgcaggcgatccaatttttgcccaaaaagctgacagctcgccgggttcgccatatccactttgcttttcatatcgacagagagcacaggttcaggcaacgcctccagtaacgcgctcaacgccagatgctcacgttcggaaggcatccacgggacagtacgcacatcggtaacacctgcaatacggcgtatttcggccatcagactgctgaaactctcaaactccagttcagcaaaattgaggtagattcgcccaatggggtcaatctcaataccgcgtaaatcaatgcctcttagcacgagtagatcgagtaattcgcgggtcagaccgagtcggtcttcacaaaagacttccagacgcatgggaaccttcacctgaaaaaagaacaattaatatgatgatatgacactatttggatagcaggaaggtttctgtcaacaatcattgacacaaagacggaaaaacgggcacttcggcgtaaagatatccggtcagcacccgatattgcattatttttcgctgggcgttttgcctttttgcagcgtctctttcacctgaccgataagctgacgacggaaatccccgaggcgaggtttgtcatcgtcaatccacggcagcgggcggcaaagctccatagctttaatccccagtcgtgccgtcagaagtccagcaccaatcccctgagctgcccgggtagacaaacgcgcagcgagatcttgcgacatccagtccatccccacttcgcgcaccagttcgctggctccggcaaaagcaatattcagcaataccagcttaaacaggcgcaaacggctgtaatatcccagttcaatgccatacagcgtggcgatgcgattaatcaaacgcagattgcgccaggcgataaacgccatatccaccagcgccagtgggctaacggcaatcattaacgttgattccgctgccgaacggctgatttcgcgccgcgcctgggcatctaaaactggctggaccaggtgagcatacaggctgaccacttcacgatcgttctgcgtttcatggattgaggcataccagcgctgcagcgccggatgtgactgatcgatgcccgcctgctgcgccagtttttcgcagaatgcacggcctttacccgtgccgtgactgtgcaacaaatcgcgcgcttcgtcgcgttcatgggcgcgctgtcgcaagcgccataagcgccgccactctgttaccacagaacctacgccagcgccgataatcaatgccccagcggcacatccacccagcgccacccagtcctgggtttgccaggcgttcattgtccactgcacgccctgcccgacaacgcttgcgccaaacagagccagcccgcccatcaccattttgcgccacaggctgcgtttcggacgtaacgctgcatccattaccgcttcaacttgcccctcttcttcctgcgcttcatcgagcgtggctggggcaaaattttgcgcctgattttcgtcaaaggtctgctgcgccctgaattttggattctgatcgacctccagtggaccgtcgaaatcaatacgtggttttaacggttcggtcatcgcaatttatctcctattaaaaattccagcgcagcatcaagacgaatatgcggtagcggtttgtcgacatccatcacctgcggacgaaacgcctcaaactggaagccttgcttatcccagaacgcctgaccaggcaaacgtgcgggaacttcgccaggataaacagtgagcggtgcgccatcgctgagtcgattaccgcgcagcgccgggattttctcaccgttaacatcaataattccgctggtggtcgcctgaacagacgccagccccaggcagtccatactgatcccttcgaacgccgcattttgccaggcatcctgaatcagttgttgcagcaatgaaaccatattggcgtgctgatcgatggtcacatggtccgctttagtggcagcaaacaatagcttatcaataaccggcgaaaacaaacgccggaacagggtacgctgcccgtagtggaaactttgcatcagctgcgtcagcgccagacgcatatcattaaatgcctgtggtccactgttgagcggttgcaggcagtccaccagcacaatctggcggtcaaaacgcaggaagtgattcttatagaaccccttcaccactttctcgcagtaataattaaaacgctcgcgcaacattccggcgttggtgtgtttatcggcctgcgccagtttagactcgccccaggcatcgacatctggccatgggaagaattgcagcgcgggcgctcctgccatatcgccaggcaaaacaaagcgtcctggctgaataaagtgcagcccctgctgtttgcagtgatggagataatcggtccacgcggcggcaatgtctgccagccggttttcgtcggcaggcgctagcgggtccagcccttcgcacatcattcgccatttcgccgaccattcgccgcgctgaccattgagtaagcccgtcatctggcgcgaccagctaaaatagtcctgtgccagcatcggcaggtcgagcagccattcgccgggataatccacaatctcaagatacagcgtggaggtgtccttaaagtggcgcagcagcgaatcgttcgatttaaaacgtaacgccaggcgaatttcactgacgccgcgcgtaggcgtcggccaggcgggaggatcgccatataactgcgccaacccttcatcataggtgaagcgcggaatgccaaagtcacgctggggaatgcgttttacgcccagcaggcgctcttcacgcaccgcacttaaaagcggcaaacgtgctccggcatgaatattgagcaactgattaaccatcgcggtgataaacgctgttttgccgctgcggctaagtccggttacagcgaggcgcagatgtctgtcgacaccccgattcaccagcgcattgagttcatttttaagtcgcttcattgctgtcctgtgctgctctgaagaccagaaaaaaaatcgttcgtaagaatatgaatgtgggggccaggccattgattatcaactacccgtgttgtcatcgacgggcgaactccataagatgtgcagcattcacgttcggacggagttcctgacctatgtcccctactatttatgatattgccagggttgcaggcgtatcaaaatccaccgtatcacgcgtgctgaataagcaaaccaatatctccccggaagcgcgcgaaaaagtgttacgggccattgaagaattacagtatcaaccaaacaagctggcacgcgcgctgacctcttcgggttttgatgccattatggtgatttctacccgttcgaccaaaactacggcgggtaatccgtttttctcggaagttttacatgccatcaccgccaaagctgaagaagaaggtttcgacgtgatattgcagacgtcgcacaacctggcagaagacttacataaatgcgaaagcaaaattaagcagaaaatgattaaaggcattattatgctaagttcgccagcggatgagtcattttttgcccaactcgataaatatgatattccggtagtggtaattggcaaagttgaaggtcaatacagccatgtttattccgtcgataccgataattatggcgacagtattgcgctaaccgatgcgttaattgaaagcgggcataagaatattgcctgcctgcatgcgccgcttgatgttcatgtttcagtggatcgggtaaatggttataagcaaagcctggctacgcataatattgcagtgcgtgatgaatggattgttgacggcggttatacccatgagacagcattaaaagcagcacgggaattattaagccagtcaccgttgcctgaggcagtgtttgctactgacagcctgaaattaatgagtatttatcgtgcggcggcagagaaaaacattgctattccgcagcagttagcggtggtgggttatagtaatgaaacgctgtcgtttatattaacgcctgcaccaggcggcatcgatgttccgacgcaggagttaggtcaacgaagctgcgagttattattccagttaattgccggaaaaccgtcaccacaaaatattaccgttgctacgcatatgtcgttgaaataaatgtatgccggatttggcgctcgccccgcatccggcaatttagcacattatcagaacgagtaattcaccccaacacccgcataatggaatttatcgctgtcgccttcgtcgtgatcctgccactcaaacgcgtattccagcgaaacggaaagaccattctggaaatcataaccgtaaaataaacccacacggttaaaatcatggccttcacgttcaatatcatcctgccagtcccagttactccagcgatccagcccaatgcgcgtatacggcgtcaccgagtggttgccgagcgtcagcggcaaataggcgcgaatttcttgcgtggaaaactcaccgttattgcggctatcatccatattgaaaccacgctcgagataatagttcactcgcaaggcaagcgtttcgttgaaggtatattgcagacctgtttccgtttcgacacgggtatcagcataaccggtcgtattcagatcgttggcaaatttatacatcgacagccaaccgttgaaacgtaaatcgtcagtcagtttcacatcccagtctggcgcaattttccagcgctgcatattcgccgtgtctttacccggttcatcaacgtagtgataaccataattacggaaaccaccagtcagaccgaaactgaaatcatcgctttcgaggaactgataatgtacctccagctccgggcgatcaaaccacgttccacgtttacccgcgctataatctaccggcccttcctgataataggccagagaaattctccacggcccgttggcggcattaaaatagacagaaggctccgccagcccatccatatcttcgccataaccttcgacgttttctatttcgtacatcgcgccgatattaaagtgccagtcgttcttttcctcggcctgtgcgcaggccattcccgcacacatcaccagtgcggtacagagtaataactttttcattattgttccttgtattatcctaggagaatgccttccccctgtatttagcaaattgctatttccgtttctgcatcaaagaaatgacatttagtcatatcaaaatgaatagtgatattttctcctgcatgataatcatttaacgcaccagcacggaccactaactcgtgccccccaaccgtggtgtagagcataaattccgcaccggttaattccgccacgctaattttggcggaaatgttattttcctcttgcgcgtccggatgaatatcttccgggcgtattcccattacgatgggcttatgcaaactttcctgtgttttcagaaccgctaatttctcttcgggtatggttaatttaagcgtttccgtaacgaatttatcgccatcgatcgtgccgcgaataaaattcatcgctggtgatccaataaatccggcaacaaacatattcgcaggttggttataaaccgttttcggcgcaccgacctgctgaacaatcccatccttcataatgacaatccgcgtcgccatggtcatcgcttcggtctgatcgtgggtcacgtagatcatggtggtgttcagtttctgatgcagcttgctgatctctgcgcgcatttgcacgcgcagcttggcatccaggttagagagcggctcatccattaaaaacacgcccgcttcgcgcacaatcgcccgcccaagcgccactcgctgacgttgcccgccggaaagcgcgcccggcttgcgtttcaggtactcacgcaggccgagaatttgcgccgcccagttcacccgctcatcaatcacctctctggcgattttttgcatcttcaggccaaacgccatgttgtcgtagaccgtcatatgcggatacagcgcgtagttctggaacaccatcgcgatattgcgtgctttggctggaacgtcattcattcgtttgccgtcgatcaacagatcaccgccgctgatctcctcaagcccggcaatcatacgcagggtggtcgatttaccgcagcccgacggaccgacaaacacgatgaactctttatcggcaatctccaggttgaagtccttcaccacatgcacctggttatcgtagatcttttgaatatgttgtaacgaaagctgtgccatgttgattcctttgctatacgttttgccagaaggccgataaccgcggccaggtcagggagtccgttgagggcaacaataattgcgccccggttaagcccgcgccgatccccaccgagcgcataccgctggcgttaatggcttcaatgcccgcctgcgcatcttcaatgccgatacatgcctgtggcggcacgcccagccctgcacaggcggcgagaaagatttccgggtccggtttcgaatttttgagttgggaagcgtccgcgcagaaggtgaaaaactcgcgcagctccagcgctgctaaaatcgtcggcgcattcagggagacagaagccagcccaaccggaatctgctgtgctcggagatctaccagcaaattgtgaatgccaggcagcacagcattaaccgtcagttcgcgcagtgagtggacgtaaagcagatttttgcgatacgccagttgcgcccgttcctgtgggttaaaatcgccctctttacccccgtgctgcagaattcgccgcagggactcatcgcggctgatcccttttaggaattcgttaaactgcgcatcaatgctgatgccaatttcagcggcaatctgctgccacgcctggaaatgcagatgtgcgctatctgtgattactccatccagatcgaaaattaccccttgcagtttcattcaccctcctgatgcgtggtagcggtcccattgaagggcaaaataaaatcccccaaacagaaaacagattcttcagcgacgtaaataagctgaccgttcaagcgcagtgaaacgggcgcagaagttcgaatcgcaatacgctgcgcgtcgagagtgacctgtaattcgcagccctgccagaacagagggaaagacaactgttgccactgctcaggtaacgccggattgagatgtaattcaccgtcacgcacgctcaccccggcaaaaccctgaatcgcccccagccagatagcgccagttgcggcagcgtggataccgtcatcacagctatgtggatcagcaccaagatcgatttcagtcccctcgcgccagaactgataactttgggtcagcaggccacagcgtgcggcaacaatgccgtggattgctttacttaatgacgagtcgtgaatagtgcgcggttcataaaat
